United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 22

SEQ ID NO: 113184 - protein, 1109 aa, Glycine max
  Coding DNA Sequence Number=SeqID_21499
  Homolog annotation: Hit_ID=A7PVZ1; Match level="QueryCoverage=99%, HitCoverage=92%, E-value=1e-153, Identity=51%"; Hit description =Chromosome chr8 scaffold_34, whole genome shotgun sequence
MGYFLKAFCRLLRMGNLCSKRERDEMQDPTVHPWGGLTTTREGSLTLLDCYLYSKSLKGLQIVFDGARARERERELLYPDACGGGGRGWISQGIVSYGRGHGTRETCALHTARLSCDTLVDFWSALGDETRQSLLRMKEEDFIERLMYRFDSKRFCRDCRRNVIREFKELKELKRMRREPCCTSWFCVADTAFQYEVSDDSIQADWRQTFADTVGLYDHFEWAVGTTEGKSDILEFENVGMNGCVQVSGLDLGGLSACFITLRAWKLDGRCTELSVKAHALKGQRCVHCRLIVGDGYVTITKGESIRRFFEHAEEAEEEEDDDLMDEEGNELDGECSRPQKHAKSPELAREFLLDAATMKLLEEEEKEKREEEERKERKRTKEREKKLRRKERLKGKEKDTERKCSESMDVPGSPEISKEELSPAADVEKNNSIRGRSSVIVTEGDYPKIQDEDFTGEGSNLRTQDCSYDDCEGVIANAHHHTYDDWDGDIANAQDMNGTSTVEQSKFYCQRLRFRKDFRLDAPTKWSDRHHNAVASENGVAVGRSEPIHHSDNFGVSSRGINGLNRQSRINVAKSNSRNIGHKCSERFYGSNSWMNDRYDFHSCNCSPNNRTNRVSWETKPASKSESTVDTSKQFYRGSKYNHVDFMHESNGRTKGRVISGNYSSRDLPQSKKVWEPMESHKYARSNLDSDVTLGSTGHGFQFNTVRFSVDEVGGSGEIDEGDSNLKRSGMGEGCQNDLDAEVGGSCSSTEIASEAGMCVMGGSALNNSSDPNQGNTSSSDNCSSCLSEGDNNTTSSNRENTESSTSDSEDTSQQSEVRDSSTCIDNGLSGSHGAEMKKIHNANDEGLTSRSPFGPSLDVARGDVSGNPVVKIAHKFDNGFSSISMCSQPQSMLPPVPNQNIQFPVFRTSSAMGYYHQNPVSLPAAPTNGLMPFPHTNPYLYAGPFGYSLNEDPRFCLQYGGLQQPTPLFNPVAFPVYQPIARAKGLNTEESTLMSKPTSMLPEHLNRSSVEKVSLTGANSQKAALNGEVGHGNSAKSKDSGFSLFHFGGPVDLSTGHKSATASSNGDNVGDFNLKSSVDQVDDDHECNKKEATVIEEYNLFAASNTL

SEQ ID NO: 113185 - protein, 47 aa, Glycine max
  Coding DNA Sequence Number=SeqID_21500
MGPRRDGNATLLDHGGTAVWDLVSGEKRNFLRIGSANSIIGSENSNS

SEQ ID NO: 113186 - protein, 153 aa, Glycine max
  Coding DNA Sequence Number=SeqID_21501
  Subcellular localization annotation: CTP_CleavageSite=61; ConfidenceScore=5.10e-01
MSSKVILMMPKNQELSKVSSKDSRIKFQDSRLKNQGTSFVVQVEGTSTWVVVTENKRGYISCGSVQVEGTSTWLFKENKGGHIPCGSLLVKVFTRLKRNLKDRRLLGDWICEKGRYNKQKGEEIKKKRRKSEEAQVQQGAQRRTRPARKKSRR

SEQ ID NO: 113187 - protein, 552 aa, Glycine max
  Coding DNA Sequence Number=SeqID_21502
  Gene Ontology: Mol. function=metal ion binding; Cellular component =cytoplasm; Biological process=histone H3-K9 demethylation
  Homolog annotation: Hit_ID=A7PS36; Match level="QueryCoverage=68%, HitCoverage=42%, E-value=1e-144, Identity=64%"; Hit description =Chromosome chr14 scaffold_27, whole genome shotgun sequence
MVSLSGVEIDLPRIKLNTDDNFCRIPITDYHRCCPSCSYDLCLNCCRDLREATADHNKEPQTEQAKISDRNILSKFLHWRSNDNGSIPCPPKEYGGCGYSSLNLSPIFKMNWVAKLVKNVEEMVSGCRISNVDGPLETGLNDLRLCQYSHREASNDNYLYCPAFDDIKTDGIGSFRKHWKTSEPIIVKQVFDGSSILSWDPMVIWRDILETTYGKAKDENGMVKAIDCLDGSEVDIELAQFMKGYFKGHILENGWPQLLKLKDWPSPSASEEFLLYQRPEFISKLPLLQYIHSKWGLFNVVAKFPHYSLQNDVGPKIYISYGISDELGRGDSVTNLHFNMRDMVYLLVHTNEVKLKNWQITKIEMMQKDKANKESEAKESGILKYLQGGVHLIPYLTLGAFSTPTRKSSTMGGRFGSALHCQETWSVLSMSRLGGAAAVAPLVAEHNWFIYLVFGMHNRKNVEVFCYALSVNDGTEWRQRIQSEAEHFVDVSAMSLDAIAKMINEDKIHILVNLNGYTKVGGFETTCTQLVKISGEKKFKTKKKENLRRILA

SEQ ID NO: 113188 - protein, 207 aa, Glycine max
  Coding DNA Sequence Number=SeqID_21503
  Gene Ontology: Mol. function=kinase activity; Cellular component =nucleus; Biological process=cell division
  Homolog annotation: Hit_ID=Q39877; Match level="QueryCoverage=49%, HitCoverage=29%, E-value=7e-35, Identity=70%"; Hit description =Mitotic cyclin a1-type
  Pfam annotation: Domain name=Cyclin_N; Domain location=15-159; Score =96.8; E_value=6.9e-26; Accession=PF00134.14; Description=Cyclin, N -terminal domain
MPRALTSRSTVSLTFRNDYLCAMERKRRPMFNYMDRVQHMVTVNMRGIFMDWLVEVVVEYKLLSKTLNLSMSYIHRFLSVNPMSKSRLQLLDVSSMLIASKYEEVNPPGVDKFYSITNNTYEKAEEAGIHVKRLHSAEGAEILPRPAVVIVMVLGSHSYGAIKRLKLGWYVIFVTSTPSKVHKAVDACKNVLRRLHSKKITERELDR

SEQ ID NO: 113189 - protein, 133 aa, Glycine max
  Coding DNA Sequence Number=SeqID_21504
MTRIVELLVINNGAFKMCTLTGVDDHGSDKEGGSGALGALDGPWYRWAAAARKWMSPFAFSIIQPFDEGFADFNWLNQRRIQNDEVWASWDVIWLRNEGDMRIGSFWRKGTPKLVIFMTAASETWLFIEDGVM

SEQ ID NO: 113190 - protein, 89 aa, Glycine max
  Coding DNA Sequence Number=SeqID_21505
KIQLNRLEVQSINQFIQLKLDARDNSFKHKMVEMPMGSELEWSPPLLLLVMVLVAPQSQAPRRQRPYPFQRKKAGLLARPPVHQTPPCS

SEQ ID NO: 113191 - protein, 601 aa, Glycine max
  Coding DNA Sequence Number=SeqID_21506
  Gene Ontology: Mol. function=metal ion binding; Cellular component =ribonucleoprotein complex; Biological process=histone H3-K9 demethylation
  Homolog annotation: Hit_ID=A7PS36; Match level="QueryCoverage=56%, HitCoverage=43%, E-value=1e-120, Identity=56%"; Hit description =Chromosome chr14 scaffold_27, whole genome shotgun sequence
  Pfam annotation: Domain name=Ribosomal_L22e; Domain location=6-96; Score=43.2; E_value=3.8e-10; Accession=PF01776.8; Description =Ribosomal L22e protein family
MSGVKGKKKAASFVIDCAKLVEDKIMDIVSLEKFLQDRIKVGDKAGALGDSITVTRDKSKIIVTSDSNFSKRYSLRHAPLLQALGFIETPYINLDNPLAMELMEVYESMGDTLAFQYGGSAAHNKIRIREIPVLDKLQYLHVLLSSVLPVIKQIRREQCFQVELEKKLRDLQEATADHNKEPQTEQAKTFDRNILSKFLHWRSNDNGSIPCPPKEYGGCGYSTLNLSPIFKMNRVAKLVKNVEEMVSGCRISNADGPPETGLNDLRLCQYFHREASDDNYLYCPASDDIKTDGIGSFRKHWKTSEPIIVKQVFDGLSILSWDPMVIWRGILETTYEKEKDENGMVKAIDCLDGSKLAHFMKGYFEGHILENGWPQLLKLKDWPTPSASEEFLLYQRPEFISKLPLLQYIHSKWGLFNVVAKLPHYSLRNDVGPKIYISYGISDELRRGDSVTNLHFNMRDMFHRRDELLRLWLLGELRHKVLHHDGTGGSAGNSGGDGEALLLAVDLDGPVAGLRAEGDASAGAEGSAVGAAVGAAGFFLREGLPAAASDLAAGEGGGGAAVLVLEDDVKEREVAVVGVERERESEAIVVSSSLREFCSFF

SEQ ID NO: 113192 - protein, 99 aa, Glycine max
  Coding DNA Sequence Number=SeqID_21507
  Subcellular localization annotation: CTP_CleavageSite=30; ConfidenceScore=5.50e-01
MYPLLFSVTTTQVDVPSTCTTKDVPSNVLRQSSQTGRIKKFSDCVILNSLKREKGGTKEFRQLVLHSFGKGRRETQKEFRWLVLGEFFLAKGEENEKDE

SEQ ID NO: 113193 - protein, 151 aa, Glycine max
  Coding DNA Sequence Number=SeqID_21508
MMQTLSINEFDEFKEELERRPWDEELTNFIDGNIDVAIVKEFYANYYDPEDKSPKQVRVRGHLIKFDEATLNTFLKTPVIVEGESLYAYSRFALLRLDPQELDAKLCILGSGFELNVDGQPLKILRRHDYSSSDMDIFSFLNLIPTSHTSD

SEQ ID NO: 113194 - protein, 185 aa, Glycine max
  Coding DNA Sequence Number=SeqID_21509
YILCGTSRGYIYLGLTENKRGYISCGSVLVEGTSIRFKENKGGYIPCGSFLVKGKVLQEQGKKIEDDEDAPLTRYVKERLGILFKHEVIAFQQKRDLNSRDWQALQGFSFNIKLSNSTFIFTHQVKPIIEKVNFDDETLVATEDLAIEVYDGPSPYRKYTKTPIKVSSDDDSRDDFLHKIEEQDA

SEQ ID NO: 113195 - protein, 71 aa, Glycine max
  Coding DNA Sequence Number=SeqID_21510
  Subcellular localization annotation: CTP_CleavageSite=36; ConfidenceScore=5.46e-01
MQNASMIGASFVAATRGSGATATGDTSGIATCTGALAMQGGLVGQLGATSLGSAFSGSFQLFQMTVYHTRR

SEQ ID NO: 113196 - protein, 246 aa, Glycine max
  Coding DNA Sequence Number=SeqID_21511
MANNPSRAQKKAKSSKRKQEKLDTWFIDENKKNDFKIIYAVNNARIPKFLDLEWFSQQGFNFPNLLEAQGLSKFIQMKGTFYPKLVKVFYTCAQADLEARKFEESADGYNKMQTYRGMLLGSTRNLRNRLDVGGLIAKDRMLVYLITYILTPMSSNHAQVTDNDLQIVYGLKSASRFIDYFHIDVFNEIVDFTRASNEKTKRHLKKLGMRFVEHEWIMAGEPPTETNMDQMEEEAEDEAQQEFAHQ

SEQ ID NO: 113197 - protein, 40 aa, Glycine max
  Coding DNA Sequence Number=SeqID_21512
MTFWLAEVGGGSKSWSNGGFDEMKMKKCNRLHATNTQVID

SEQ ID NO: 113198 - protein, 311 aa, Glycine max
  Coding DNA Sequence Number=SeqID_21513
  Gene Ontology: Mol. function=aspartic-type endopeptidase activity; Biological process=RNA-dependent DNA replication
  Homolog annotation: Hit_ID=Q69F85; Match level="QueryCoverage=18%, HitCoverage=3%, E-value=1e-09, Identity=51%"; Hit description=Gag -pol polyprotein
MNVCRTLKRLEEILGYLAEILPKLLTVEGREAAEKRRRDCRVESVRRRKQLESVGSKSPNMVMVVREGLGLWIDVNPPAPRSFGLTHTKDFDKEPLEKILRHSRRLFNTVEDPLAEGSLKCKEIVALQYENAHPRETHRSRKPRVNLLEGGEAKSTLNPFVPSIMEEIFSSNWKNLTMEKYDGTTDLDDHVDVYITQECFRKVALNIQNLDPAVAIHHLITVLRPRPFANRLYKKPTSDLDELWTRATKYMQMEELAKDQAFAVNILIMPKRANTPLDKGMQCLEGQDKRTHQACLPKGVRPQATAVQARV

SEQ ID NO: 113199 - protein, 204 aa, Glycine max
  Coding DNA Sequence Number=SeqID_21514
GTLTDAQRFPVAFINGNLASKSPYSEFISIEPVERETISVQAPTWTKYDYEHTSSEAFKALPTDEEYLSLGNLHAQMYERDQATAYPFGLHISRVINVKIIVDKNQILWTDTKKASTYGYDGRYNVEDHDVMQVLCPVRKYHYDDAYVCFTKDADNNSFFQRILQLPTIQYEGTYNLKKMTKEQMIAHVTQLHKAQQNKKVEEE

SEQ ID NO: 113200 - protein, 192 aa, Glycine max
  Coding DNA Sequence Number=SeqID_21515
MGWVQRRGQNRVRSDIPKSEPNHAFPSRAKSDPDQSEFSPSKSRQGRIGTHQFSFYCHAQVRATWVNSIPKGMLFIGIKSRTSLWNIHVHTLKPFGFSTLPLDYVEIEWKKCGGGDCGERMIKVVAIVGGDGGGDGGEDGGGGVGPKVSGGGSKDNNTKVGELSGDCILHGELELLIFFTLSFGEGFHYDNC

SEQ ID NO: 113201 - protein, 21 aa, Glycine max
  Coding DNA Sequence Number=SeqID_21516
MQGKEIARRFSNWQAHHRLCV

SEQ ID NO: 113202 - protein, 138 aa, Glycine max
  Coding DNA Sequence Number=SeqID_21517
MCKVTSFSRGARSFCKILTQLGLEVASKGQGARAPGTPGVDFGGADIDTVNNLLRVHTTLPLIALADEASTMILVVEMAPKLPANAGGGSNRTTIRPPCRIIIIIIDWWSNRFAKFSFIHHEQKWHLPPNLHPLAGSN

SEQ ID NO: 113203 - protein, 127 aa, Glycine max
  Coding DNA Sequence Number=SeqID_21518
MMMMIIRQGGRMVVRLEPPPALAGNFGAISTTKIIVEASSARAINGRVGTFEQIKEASNMVKDLLLTVSMSAPPKSTPGVPGALAPCPLEATSRPSCVRILQKDLAPLEKDVTLHIELLNCASRHLK

SEQ ID NO: 113204 - protein, 114 aa, Glycine max
  Coding DNA Sequence Number=SeqID_21519
MYYDEKWNIPRQGEFLGYSFTGTNPIRFGIPSGCGMEKLKDLIKQVAHTGIPPNGIHESQLVRQLFFRQPGHSKYSENLIEYDITELKNDQDVLKEEGKSGCQNPTSMKSMKVV

SEQ ID NO: 113205 - protein, 102 aa, Glycine max
  Coding DNA Sequence Number=SeqID_21520
MDISEDIDIPVILGRSFMLTTSYIVDMGKRKQELGFEDQKIDFNLFVENKPAPEHNVCLQPRVRALSAPPWHLRLIISAKLAKVWLSQNQFELNSAKPQTDR

SEQ ID NO: 113206 - protein, 55 aa, Glycine max
  Coding DNA Sequence Number=SeqID_21521
MAWNVLSHLCPRTACRNLPFGGRATRGSRVGLPWEENARSRHQRLFKENVGKTGK

SEQ ID NO: 113207 - protein, 89 aa, Glycine max
  Coding DNA Sequence Number=SeqID_21522
MDAPDLPEDGEDPLPDVDSPEDIMSASEADSTEESGPGGTTNTLLRLQVASISKLIGAKSPGAVLPCIHKNKNYHENYGRKECKRKIVK

SEQ ID NO: 113208 - protein, 196 aa, Glycine max
  Coding DNA Sequence Number=SeqID_21523
MVTESGMRTLLRWAIGDGVLMPGLVEMGYLFCAIARLPPSTTYEGVVPEDMSWGSGDLGDVRWGAIAQNQAWPIPTQPGHSQPIAMVAQLIHDCVVMECLEGVWETLEGNERCQFRGIVRLTTTSLVHLEQPARTLQQPVEWILPTPTPYRLVEPVQLIEVSSSEEDLEEDLEELPPEPAMDAPDLPEDGEDPLPD

SEQ ID NO: 113209 - protein, 128 aa, Glycine max
  Coding DNA Sequence Number=SeqID_21524
  Homolog annotation: Hit_ID=A5AY05; Match level="QueryCoverage=62%, HitCoverage=21%, E-value=2e-09, Identity=44%"; Hit description =Putative uncharacterized protein
  Pfam annotation: Domain name=zf-CCHC; Domain location=12-29; Score =27.6; E_value=4.6e-05; Accession=PF00098.14; Description=Zinc knuckle
MEINSSSTSRDIKCFRCQGVGHIASQCSNKGAIILPDKGGIESASLSDDEMSPLEDHSDVDVAELVSLQVKSRRRKGDSKQVDEFLQEGFIRESVSPCFVLVILVPKKDETCYLKSGYYQIRMKEADE

SEQ ID NO: 113210 - protein, 226 aa, Glycine max
  Coding DNA Sequence Number=SeqID_21525
MVERKRGILGGSVILFLVQSVKSLFGNKLVQPAGFKFQRQGWDPGVKKDAATVDEETTTTLESIESLNKEVFVKGGGITHGSGLDYGSDLLQCLETENKVLEGEFGLLLRVAIGTKGGVPNLILLLRVAIGTKSHVPILILIVAIGTKGGVPNLSLLLRVAIRTKGGVPILILLLRVAIGTIGGRMVPKYNESKDIQSSEHMEDEEMAQKGDLMIFQGGEDLTIGQ

SEQ ID NO: 113211 - protein, 114 aa, Glycine max
  Coding DNA Sequence Number=SeqID_21526
MVPRKLLPERNVVVYYTEFDEFKEELERRHWDEELTSFVDGSIDVAIVKEFYANLYDPEDKSPKKVRVRVATTQVDAPSTCTTKDVPSNVLRQSSQAVSPLKLCKGETKDISGG

SEQ ID NO: 113212 - protein, 115 aa, Glycine max
  Coding DNA Sequence Number=SeqID_21527
MANKGACKTTLNLKYALYLFLDSTFSSKVEAGSVMDVDAVIAAGGRACTAIGNSGLNAYRHSSWRDMVTRREMGTHPAIRPGGTWLTRREGAMPPLVLAGHANVGSPVTASCGTR

SEQ ID NO: 113213 - protein, 353 aa, Glycine max
  Coding DNA Sequence Number=SeqID_21528
MQQKVVLSESFENCLQMFKMCLQGGAIDENIVEEGCNKPTDERLKQLIHGCLNCCRCVGKTEGNHFVFVMSLVSAECGLMDVGGCHGDLMEALTKFVNGWHWKTILDGDRVQCPVINTTPPATILLLDHQHWGRKGVVTYLDQPGLKHIGYLAFELRFLVVWVSVWVNINRVDGSWKRWAYRWRMGNMAGGVLEGEELMVVGCGEEGNICRELDWGAQPGEGHRPRGVVRNYGPQFLGIRVDLLAYECAAITYHDTEGGDVGGGQREEMGQPSFLPYIRKFAGAGMPERALRLNCGVFGSETKGSSPSEGGGEVCSDDRQPIFRHTDNRGCGLCERLTLQVRSTAQRVWSEVG

SEQ ID NO: 113214 - protein, 97 aa, Glycine max
  Coding DNA Sequence Number=SeqID_21529
  Gene Ontology: Cellular component=plastoglobule
  Homolog annotation: Hit_ID=A9PIE8; Match level="QueryCoverage=69%, HitCoverage=22%, E-value=6e-10, Identity=49%"; Hit description =Putative uncharacterized protein
MQRVWLKYESSVKVWLGNGGAEGPLRMKEEYVEGVFVTPTIIEERVPEQLKGALGQAANALQQLPAPIRDPVASGLKVPLSKLLLIFYTPRLNKSSD

SEQ ID NO: 113215 - protein, 232 aa, Glycine max
  Coding DNA Sequence Number=SeqID_21530
  Homolog annotation: Hit_ID=Q6UUU1; Match level="QueryCoverage=47%, HitCoverage=93%, E-value=2e-33, Identity=60%"; Hit description =Putative uncharacterized protein
MANGNHPCLTHPQQSTIENKEWFKDYSGVVTRLQQRLVHSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFLLAAPSCALLFLPFGLPVSFRCMAALSHSTPDTQFR

SEQ ID NO: 113216 - protein, 41 aa, Glycine max
  Coding DNA Sequence Number=SeqID_21531
MAKERVSPIRDVRALDAQGSLKSTRPRAQRTPSGLSKVITS

SEQ ID NO: 113217 - protein, 493 aa, Glycine max
  Coding DNA Sequence Number=SeqID_21532
  Gene Ontology: Mol. function=structural molecule activity; Cellular component=lipid particle; Biological process=phagocytosis, engulfment
  Homolog annotation: Hit_ID=P53496; Match level="QueryCoverage=73%, HitCoverage=96%, E-value=0.0, Identity=95%"; Hit description=Actin-11
  Pfam annotation: Domain name=Actin; Domain location=4-383; Score =741.7; E_value=5e-220; Accession=PF00022.10; Description=Actin
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYSFTTTAEREIVRDVKEKLAYIALDYEQELETAKTSSAVEKSYELPDGQVITIGAERFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQHSISVAEKHPRYRHSPQGSRWCGVGVSEEGIPVGGLALDPARAKDNTGLDVDALNGVDKEEGIVAESGNGGDLVAKVDVVEGVDEVHHIAEEDGGVLHRDSAALLLIQVVHEPNATIELQVDDVAARGNASSFINEI

SEQ ID NO: 113218 - protein, 356 aa, Glycine max
  Coding DNA Sequence Number=SeqID_21533
MASSAQMLKDIARSHDSSLQFGHLFEDDTLISVEDEALRHAMNLSSDFHEYPGHCHGGVVLSMKSRERSSYGFNGIDKVFSQACQCFCNSHVAAGGGAMEFSEDRGYGLEALREDEVMTNGIVWVFLRVGLNAPTKLEEVGVGICRRVGSSDAIMDGASMISQNHEGIAQEVLSPLFNNCGDGGELPDIGGCMQELGAEWFAKKCYRVISMRQNRSHADAGSACLASKFQWNESLASSVNPDKPWKPRNALVDWGVGQFYTASIFAGTGSTPRQDTIWPKYSTYDVAKEHFESLRKNWWRLRTSKAVRSYSKCSEKGPEGSVHWYLKGRWGIAKPKRNYKKFVMVMVSAEGGLANV

SEQ ID NO: 113219 - protein, 84 aa, Glycine max
  Coding DNA Sequence Number=SeqID_21534
MVGAFSQNTVTLTGLPMILPSESDLTYYCVPQVEDCSVFDDHENLVEYHVLGLEQTPLPLGSDVSGLGRSCSVPLSNEATWNLR

SEQ ID NO: 113220 - protein, 99 aa, Glycine max
  Coding DNA Sequence Number=SeqID_21535
MQTEKMHWRHLGDTRAKTSAVECLDQLPKKYWVQCFNDDEKHWGDMTTNLFELVNSMFKSTRHLLVSSFVEEMYIKTTKLFATKGSTNPSNDQLWLAVL

SEQ ID NO: 113221 - protein, 72 aa, Glycine max
  Coding DNA Sequence Number=SeqID_21536
  Subcellular localization annotation: CTP_CleavageSite=52; ConfidenceScore=5.00e-01
MFHGQWYLPLMETSLINFSGVASQRLKTQRHSARLVKCRFHELAKPLIFGLSASFAKRPIWWLSAWTILEGG

SEQ ID NO: 113222 - protein, 134 aa, Glycine max
  Coding DNA Sequence Number=SeqID_21537
MGNKWKESSWLANFSCRCRATTLAAELATVGGDEGDPALWLRLLRGETLTSPLPFFLAPPKAEGGRIMVTGTGSPSKEVAEGHALLRWQEAPPPTQHKFANLLEKVDFLSEAPWCVSFEEELLIRMTSRSNRGY

SEQ ID NO: 113223 - protein, 220 aa, Glycine max
  Coding DNA Sequence Number=SeqID_21538
NIHSQNILPERNVVLYVTEYNEFRWELERGTLEAPEEGPHHFGVGDEDGYGLGLAHFWVDLLDGPDQLLSAWLSYTHHNLASTSAPSSSAPAPSAPIPPPPASAPTPSGTSAQSRVISVDVTKPTPWLMPSDAEYPRLGSALAHHEHGGIYGLGEAPTAQEPHPESQPQPEVTPEATPQTSPAATPLVEVSEDEDGTKDTDYAANLAAVQSTWDPWPTTA

SEQ ID NO: 113224 - protein, 41 aa, Glycine max
  Coding DNA Sequence Number=SeqID_21539
MDKSLKVGEDEWREKERNTKFYASNEPTNPRSSPRFSTKCA

SEQ ID NO: 113225 - protein, 97 aa, Glycine max
  Coding DNA Sequence Number=SeqID_21540
MRQLVACEDYPVLQGYSNSWDQHVPHEDSKPNNPKNKVNLQLIHVFPGGFQLSQRALRGRARARLTGAFSKGGKMRGVATNVYLWKTSEKPKETGQK

SEQ ID NO: 113226 - protein, 172 aa, Glycine max
  Coding DNA Sequence Number=SeqID_21541
MKLQEAKDSIDEEDPRPTSSTRSHIKSYNIRQRKTRPNYKRIVYGLGTLSKRFSCSKLGPSTSITPVEDQIEEMRETINKLNVELLAKANKEKILEEKMLQLIENHDHQSQEMRQQMQEQNEQICQQHEQMQRILQHLHILSIMLALSPSTTIADGTEHHVNDAHVDHPHDM

SEQ ID NO: 113227 - protein, 163 aa, Glycine max
  Coding DNA Sequence Number=SeqID_21542
  Homolog annotation: Hit_ID=Q6AUA8; Match level="QueryCoverage=51%, HitCoverage=9%, E-value=6e-07, Identity=32%"; Hit description =Putative uncharacterized protein P0017D10.13
MTKANVSHPRTIKWDEVTLPEKWVMDKATQSVPRPTPTIEQIKQDNSGKVEITFNRRNSFSSRIEALRSEYESARKENIDYLWKQDIIGDPTTNVITNWQIKDVITTKKLYPLLAMNPKDVGLLCPVINQEANPASCNEPKECWSLVFSVQPGRPSLENSHQE

SEQ ID NO: 113228 - protein, 167 aa, Glycine max
  Coding DNA Sequence Number=SeqID_21543
  Gene Ontology: Mol. function=aspartic-type endopeptidase activity; Biological process=proteolysis
  Homolog annotation: Hit_ID=A7PT07; Match level="QueryCoverage=99%, HitCoverage=9%, E-value=3e-26, Identity=35%"; Hit description =Chromosome chr8 scaffold_29, whole genome shotgun sequence
MVAMTYQTSHECSEETIIDILVAGFSGQLKGCAVKTDLNGKIITNNDNKEIPDAVNTLMFTIAQHFIGDPSLWKDSDEDTTKGKDHEALEGPMTRGRLKQTQHRSAPTLADFRWYRDIFLTRVYTRKDSQQPFWKEKFLAGLPRSLGDKVRDEIRSQSINGDIPYES

SEQ ID NO: 113229 - protein, 109 aa, Glycine max
  Coding DNA Sequence Number=SeqID_21544
MEIPENRRWMYQSQDMFQMQGEQTRCPCKKCKCKVFKFMDDVRRDLYEEGFMPNYYWWANYGEELPQFLPVVLQGSYYGSDGKREELNPHEQMIMDHVGTLIGQYIEQE

SEQ ID NO: 113230 - protein, 112 aa, Glycine max
  Coding DNA Sequence Number=SeqID_21545
MISRLSQEQFKNQEKDSRIKFQVKNQESRIIKIKIQESRKDSLKIKGTSTWVIVTENKRGYISYGSVLVEGTSTRLFKENKGGYIPCGSLLVKDFTRLKRNLKDRRSLGGWM

SEQ ID NO: 113231 - protein, 142 aa, Glycine max
  Coding DNA Sequence Number=SeqID_21546
MWHERTQTARTSDEFGVLEQIASTNGVSCMQRRNRQSKWRYGLRFGNRQSNWRVPWPEAAGLRPCHGSAVLQKKLRDCTALPSFASIALLFFFLISSYLVVVAFFLFGCCLLFLGCALFQSWYVIYLLFILREFSVLGLVGM

SEQ ID NO: 113232 - protein, 95 aa, Glycine max
  Coding DNA Sequence Number=SeqID_21547
MDGNCGYRAIAALLGMGEESWSLVRNHLYKNLTSWSEKTPCGACRPWIFFINGFLCFLNIMTVEWRRNKDDWRCHFKEKMSQEEVHHDRKPWIRA

SEQ ID NO: 113233 - protein, 167 aa, Glycine max
  Coding DNA Sequence Number=SeqID_21548
MRFPSLEDAPVSLRIALPPKDVGRGKFFKPKATYAMTKSQRLAVLKWVKELKLPNGYASNLAPNYKGNMYGQGTLSKMFSCSKSATSTSIAPVEDQIEEMRETINKLNVELLAKENKEKTLEEKMLQLMETHDHQSQEMRQQIPSTTITDGTEDHVNDAQVYRPHDT

SEQ ID NO: 113234 - protein, 103 aa, Glycine max
  Coding DNA Sequence Number=SeqID_21549
PFAKRKPRAKRIFCHALDTYSLNIALPSNTSSLRVRYSVLTVLYYLRDPVHLTGAVEIKNEVTSKVFKVNGRQLKLFHESPQVEEEFVADLSLILPILCDDVP

SEQ ID NO: 113235 - protein, 21 aa, Glycine max
  Coding DNA Sequence Number=SeqID_21550
MKNERVCVWVGFDPLKVEDDE

SEQ ID NO: 113236 - protein, 152 aa, Glycine max
  Coding DNA Sequence Number=SeqID_21551
  Homolog annotation: Hit_ID=A6N1H4; Match level="QueryCoverage=28%, HitCoverage=39%, E-value=3e-09, Identity=69%"; Hit description =Retrotransposon protein
MGDKLHRREGNSPDHQLRPLNDRSVIKEGRTRASSAGRSESENVGLEVTQTLVRIQCLENPRVPPQGSSTEGESGPKIRPKGRSRWTTGEYSCTTLCWSRGTEEARVIRGRENASSQSSSTRRYSAEVIHAILPGKARTTFNKWVPVPETDT

SEQ ID NO: 113237 - protein, 98 aa, Glycine max
  Coding DNA Sequence Number=SeqID_21552
MVSAKVITLPMVSLTRHEESIKAWYIHCGTSRAYIYLGCNTENKRGYISCGSVQVEGTSTWLFKENKGGYIPCGSLLVKDFNKVIGNLKNQWLLGDWM

SEQ ID NO: 113238 - protein, 286 aa, Glycine max
  Coding DNA Sequence Number=SeqID_21553
  Gene Ontology: Mol. function=motor activity; Cellular component=cell projection
  Homolog annotation: Hit_ID=UPI00016621D1; Match level="QueryCoverage =77%, HitCoverage=40%, E-value=1e-20, Identity=34%"; Hit description =UPI00016621D1 related cluster
GGPWVLEPVAFRGLHVLTFRGLHALAFRGLHVLTFRGLHVLAFRGSCTFTFRRLHVLASRGLHVLAFRGLHVLAFRGPHALAFIGLHVLTFRGLHVLTFKGSCTFAYVGLHALTFRGLHVLIFRGLHVLTFVRLHVLHFRGPNILIFRGLHVLTFIGLHALTFRGLHVLAFRGLHILHFRGLHVLAFRGLHALAFRGLHALAFRGLHALTFSGLHIRTLREFKGLVVSFINFGATLDPGGGPTMQVQPEEEAIMQLLCIPGQDFTRATAKRRVWIMRTNMTTLTQI

SEQ ID NO: 113239 - protein, 131 aa, Glycine max
  Coding DNA Sequence Number=SeqID_21554
MSSKHKPKYIYFVVPSYSVFFYSDLQDPPMLFAFGMTYQFKVVFHVDRNIIEVPSVYHKQWAPDYLDYVVLDYNGKKHHIRVRKFSNRVYIADGLKHFRRDMRIYEGVMITFVAPNKNWKFDIHFSPPLHA

SEQ ID NO: 113240 - protein, 147 aa, Glycine max
  Coding DNA Sequence Number=SeqID_21555
MGEAEEVQEKMKADMEAMKEQMATMMEAMKEQMATMMEAMKEQMATMMEAMMSMKKIMEADAVIVVATSAVAKVNPMLPSGLKQMNHPTSNMVGKDLGSTDDPMMCKLKTSTPSRRMACLPNYTPPNVAYTLNENLNNSTPILIENQ

SEQ ID NO: 113241 - protein, 169 aa, Glycine max
  Coding DNA Sequence Number=SeqID_21556
MHENEWHGACLLFDPIWEPIGQYLGVSNNYSPTIHNSHGCFLESPVESPTVATCPFAGERRRGSRVRFPKEERCAESPPTFICGNVGKTEGTGQNEILSSGVVFTFEEGINTSHVDKSGALAPTYPSSKRKSDLHSSFLRVNQAIRFTWKVIILRRWTLKMIHLLGKKN

SEQ ID NO: 113242 - protein, 275 aa, Glycine max
  Coding DNA Sequence Number=SeqID_21557
  Homolog annotation: Hit_ID=A5ZYK7; Match level="QueryCoverage=24%, HitCoverage=97%, E-value=2e-22, Identity=78%"; Hit description =Putative uncharacterized protein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISFLGPDGDWPSSAKAEGSLTARPTRRAGTKVGLSDPDGAEWKGRRSTDKSYSRDNRLIFPKSSHRREGLAPRCRLFATWGCSMFQGLGCSPIKAVRELGSERRETVRSISGVGVRALRGPFPSTRGPGRTHLWCASYRAHGKRWVAKASGSTAETAMGSLPQRGWSERSFENSRE

SEQ ID NO: 113243 - protein, 132 aa, Glycine max
  Coding DNA Sequence Number=SeqID_21558
  Homolog annotation: Hit_ID=Q2HV58; Match level="QueryCoverage=92%, HitCoverage=32%, E-value=8e-07, Identity=26%"; Hit description =Putative non-LTR retroelement reverse transcriptase, related
MSSYSCPLCDHEEESIYHLMFNYEKTRSLWWETMRWVNRVGPHSIDPKNHFLQFTQWNSKARTNKRWEFLWLTLSFSIWYHRNAMLFKNQPFTPEKVMDDALFHTWSWLKCVEKDFNMHFTFWSTNLKDVFS

SEQ ID NO: 113244 - protein, 205 aa, Glycine max
  Coding DNA Sequence Number=SeqID_21559
MKVMQKSSLAGRQSQNLEIGDNNKHYRLNWRNNADITSFYFTHFPDEANEELLWRHFKNWGDVREVYIAKRLNKDGRRYGFMRFKGVSDAKGLEKKNPIRRKYTDEARDKRADEAQTPTILINPDEGGEYWCNETWVGMLKKVMEVETLEDRITWELGYNVRTKFLGDDMVLLPGMSDDKAQLLIQSETESDDSLFYSLEKWTPK

SEQ ID NO: 113245 - protein, 140 aa, Glycine max
  Coding DNA Sequence Number=SeqID_21560
  Homolog annotation: Hit_ID=A6FJQ2; Match level="QueryCoverage=27%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVFSPFLELPRALSCSDPAAYRIPVRLSPFGKRRSLQAGLCARTPRSARPLRLI

SEQ ID NO: 113246 - protein, 156 aa, Glycine max
  Coding DNA Sequence Number=SeqID_21561
MGEVEEIQEKMKADMEAIKEKMATMMEAMMSVKKIMEANAVAIAATSVVAKTHEIPHHNLADFEPWLGYATEGQAVGGIPLQNPLEGPQYHPQLHLLHSMTSKNPHAMAEMGKLDHLEERLRAIEGGEDYSFANLEELFPIPNIITPSKFKVLDFD

SEQ ID NO: 113247 - protein, 80 aa, Glycine max
  Coding DNA Sequence Number=SeqID_21562
  Gene Ontology: Mol. function=aspartic-type endopeptidase activity; Biological process=DNA integration
  Homolog annotation: Hit_ID=A5AKU5; Match level="QueryCoverage=82%, HitCoverage=4%, E-value=3e-19, Identity=66%"; Hit description =Putative uncharacterized protein
MKKECPKYATWRVKKDSGATTHISMTMQGCLWSRPPSDDERFIFVDDDKKVAVEAIGTFRLQLKTKFYLRLLLYRLLNGI

SEQ ID NO: 113248 - protein, 102 aa, Glycine max
  Coding DNA Sequence Number=SeqID_21563
  Gene Ontology: Mol. function=RNA-directed DNA polymerase activity; Biological process=RNA-dependent DNA replication
  Homolog annotation: Hit_ID=A5AEK4; Match level="QueryCoverage=90%, HitCoverage=17%, E-value=6e-16, Identity=40%"; Hit description =Putative uncharacterized protein
MASTRKDWSIKLEDALWAYRTSCKTPIGLSPFQLLKSKWSGPFVIKKVRPYGAIELYDPQSQDPDRTWVVNGQRLKLYHGGEFEKVNTILHMISPIEVYASS

SEQ ID NO: 113249 - protein, 70 aa, Glycine max
  Coding DNA Sequence Number=SeqID_21564
  Gene Ontology: Mol. function=protein dimerization activity
  Homolog annotation: Hit_ID=A5C6E9; Match level="QueryCoverage=60%, HitCoverage=3%, E-value=6e-11, Identity=76%"; Hit description =Putative uncharacterized protein
  Pfam annotation: Domain name=hATC; Domain location=1-63; Score=13.8; E_value=0.0012; Accession=PF05699.5; Description=hAT family dimerisation domain
MWWKFNGVKYPTLQAIAKDILAIPVSTVASESIFSTGGSMSYKVVVECATVMNEMVSDDEGRMMDAGGTD

SEQ ID NO: 113250 - protein, 144 aa, Glycine max
  Coding DNA Sequence Number=SeqID_21565
  Gene Ontology: Cellular component=chloroplast
  Homolog annotation: Hit_ID=A7Q8B9; Match level="QueryCoverage=18%, HitCoverage=6%, E-value=7e-09, Identity=96%"; Hit description =Chromosome chr14 scaffold_63, whole genome shotgun sequence
MVRSRFEKDLRVSRVCQEGLLMPSFFFSSELFTKTCHGKEEGGTSTLGERSTTDSCAMIYFTGEVSAQLVELRSCNWVVAITGWMSNCPGGNDSILYLNRSSMDRTWTVVGVGGSPRVSSFGILGKRIKLALANSLMHYLPSTL

SEQ ID NO: 113251 - protein, 52 aa, Glycine max
  Coding DNA Sequence Number=SeqID_21566
  Homolog annotation: Hit_ID=P92540; Match level="QueryCoverage=92%, HitCoverage=41%, E-value=2e-08, Identity=62%"; Hit description =Uncharacterized mitochondrial protein AtMg01060
MDSYEAFRNKKIQSDDEFLRGPRKSIKVQSVRAPPCQGGSCGFEPRQSRPRI

SEQ ID NO: 113252 - protein, 60 aa, Glycine max
  Coding DNA Sequence Number=SeqID_21567
MGVVFVIGSAVDSFVVDLGMAFVDNWVVGKEVEWQSQHGFLPHPHPLYLPQFSHSSKQDD

SEQ ID NO: 113253 - protein, 61 aa, Glycine max
  Coding DNA Sequence Number=SeqID_21568
  Subcellular localization annotation: CTP_CleavageSite=35; ConfidenceScore=5.07e-01
THKTATVASSNQAQCQWARLDKHSIIATRSNHRTIASMPQSWSSMVELKAISVSKCRKVCH

SEQ ID NO: 113254 - protein, 140 aa, Glycine max
  Coding DNA Sequence Number=SeqID_21569
EFTGEGSSSPSMLVSTRAPPEKALLTMKGPSRPWLMAVKRLPSIRDLYLKWEYWLPSHKPRSTAFPHLHSPVHLRPIGGGVMMLDLEILAHFLHHFVIQIGAIVSNDFPRESVSTNQFPLYESDHHTPRDIGIGSRFDPF

SEQ ID NO: 113255 - protein, 98 aa, Glycine max
  Coding DNA Sequence Number=SeqID_21570
  Homolog annotation: Hit_ID=Q6UUU1; Match level="QueryCoverage=81%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLIPRLTPQFR

SEQ ID NO: 113256 - protein, 176 aa, Glycine max
  Coding DNA Sequence Number=SeqID_21571
  Homolog annotation: Hit_ID=Q6WAY4; Match level="QueryCoverage=84%, HitCoverage=27%, E-value=3e-15, Identity=33%"; Hit description =Putative uncharacterized protein
MGTNQTGKRFYQVKVKGLDVTSIKELGRLMGPLQMQAFRKTYGKILDLTIAEVSVEAIASLTQYYDQPLRCFTFGDFQLVPTIEEFEEILGCPLGGRKPYLFSGFLLSLSRIATVVKDSARGLDRVKQTQNGIAGLPQKYLEDKARDMENQEEWVPFMDVLALLIFGGRPLSKRRM

SEQ ID NO: 113257 - protein, 207 aa, Glycine max
  Coding DNA Sequence Number=SeqID_21572
  Homolog annotation: Hit_ID=A7PZ77; Match level="QueryCoverage=25%, HitCoverage=17%, E-value=8e-10, Identity=64%"; Hit description =Chromosome chr15 scaffold_40, whole genome shotgun sequence
MAAKVPLLCGDKFVSKHVDDKKEKKLKKVEDKMLGWVHGFATGFWWPRGSLFLNKTWICCRILVASWFAIDDLKVDMRWEKLQKGIGLEIVKQLASVGIKMVLTTRNEERDLQAHETLKASGLSHLVLFHQVDVADSTRKEYHFFCLTISLYSKSSTDVEDAGFDDVIIEDQTDKTRGAELNELDVEEEDATEEEGFRSSSPLRNDE

SEQ ID NO: 113258 - protein, 289 aa, Glycine max
  Coding DNA Sequence Number=SeqID_21573
  Homolog annotation: Hit_ID=Q9M1C3; Match level="QueryCoverage=98%, HitCoverage=98%, E-value=5e-28, Identity=35%"; Hit description =Putative uncharacterized protein T2O9.180
MRCKKHLPDLTSTIGVCASCLRERLQPLLAAQAQAQAQSERSTTNSNVDNNHRRRKPKPKPEENPPPLNFPRSVSPYVTHRKSDYDRLRDRLFYSTPQVSGAACDGGTALEKRRHGGRFWILSNLFRARSNKTESSHEPREDPTGPHPPQSWFSTILYARRHHDVRSPRADRGLSPSTAENFTQFSADSAQDRSDSGNSSETSPAKQNPTPVTGHRRSRMGPTGKGFTSMAFCLNPLVRAGPNRHWSHHNKGLAQEQGGGGAHHISNAASFCANRSRKLADFGRGAHNR

SEQ ID NO: 113259 - protein, 128 aa, Glycine max
  Coding DNA Sequence Number=SeqID_21574
MASMMKAMLGMRQLMEKNVATAAAVSSVAEADPTLLATAHHPPPNAVGRERNTLGHNSNPHLGYNRVAYPYGLPPNYTPPVMHDDAGHVSSPILEGEPPRQPDEVYEDHREYAQGDVDFYPPIPVEGP

SEQ ID NO: 113260 - protein, 73 aa, Glycine max
  Coding DNA Sequence Number=SeqID_21575
MMITKDDDKGEDKKLKDQSKNNSSESRTIQEFKIRIKKNSRFKRKVEFKNQESRIKIQEIKIQDSRFKNQEKA

SEQ ID NO: 113261 - protein, 146 aa, Glycine max
  Coding DNA Sequence Number=SeqID_21576
MEANWDRLLASKEGVGCINYNPVLAIRQLGYPMRRAPSEEGLTPFIAGEDNHSGGSRDEATSRRDRTRRLRYQQWKEGSKSSHGSDDESREGTYTGYPAVDFEQEASWTEDEEDKDVGLSPELERIITQEDLEMRPHQEETGLVDL

SEQ ID NO: 113262 - protein, 169 aa, Glycine max
  Coding DNA Sequence Number=SeqID_21577
MTGRLLVGSLAFESRILHYLIVRILLPRSSNLAQVSEEDLIVMWTFHKGLQIDWAHLVRYRMHKALRLNAPLPYPHLITLFLQHFNIPLDSEPYVPIKRSFLIGASIIASFGYIKEHDGSWVKKGARNVGGEGHEDSSLLSRFWKGLMVFKPLLVRGLILWNCKWICAS

SEQ ID NO: 113263 - protein, 72 aa, Glycine max
  Coding DNA Sequence Number=SeqID_21578
MTKACQKGVRKVNETKIKVRETNGDHQGKIGEELATQLAQASQVASSRSNRLLEEHLGKPKWAWLLFAPPFY

SEQ ID NO: 113264 - protein, 99 aa, Glycine max
  Coding DNA Sequence Number=SeqID_21579
MVVISLTKIPQPPFPRGYNLSQPTLWQEGDARLMGASSKEGKRAESPPTFIRGKRWKNRKRRSLRTLSVKGSGVVFMHGEGCFPCSYVFLNCDKEIRPT

SEQ ID NO: 113265 - protein, 114 aa, Glycine max
  Coding DNA Sequence Number=SeqID_21580
MISHPFMSPAQPRDLPRVRLVQQYDTFVEPDVHQQPMAAVAPDEAGADVHHLGHAVVAFGEIIDKLERLLNLRILTEGTKAYIVVEECVGIARRFIHQPVVGHRSRRRRHMDDH

SEQ ID NO: 113266 - protein, 74 aa, Glycine max
  Coding DNA Sequence Number=SeqID_21581
  Pfam annotation: Domain name=G-patch; Domain location=4-48; Score =2.4; E_value=0.095; Accession=PF01585.14; Description=G-patch domain
MSGAAMMVACVMLGHDYELGMGLGKNNDGMASLVDIKENCGKFGLSYKPTQTNSICIYVLGRSRSSGGKIRGLG

SEQ ID NO: 113267 - protein, 195 aa, Glycine max
  Coding DNA Sequence Number=SeqID_21582
  Homolog annotation: Hit_ID=Q84VI1; Match level="QueryCoverage=93%, HitCoverage=26%, E-value=4e-71, Identity=78%"; Hit description =Envelope-like protein
MDKKIRGIVSSILKDASVPEADEDVTTSSTPNVSVPDVEKDVPTSSGPNAEVLSSPSKERSTEEDDQAAEETPTPQAPEPAPGDLIDLEEVESDEEPIANRLAPGIAERLQNRKGKTPLKRSGRIKTMAQKKSTPITPATSRRSKVAIPSKKRKEISSSDSDDDVELDVSTSKRAKKSGRKVPDLPWKENWEELP

SEQ ID NO: 113268 - protein, 104 aa, Glycine max
  Coding DNA Sequence Number=SeqID_21583
MDEEQWMYDNIMSEEVDMNIENEEDAGVKVEHVDCSDAFNTSHLFATRDEVLHWARLVAHEIGFVAMIMRSDTNIGVKGRISFLLIAFERSDEYRPKKNDLVRT

SEQ ID NO: 113269 - protein, 35 aa, Glycine max
  Coding DNA Sequence Number=SeqID_21584
MVIFNHRDAAEGKGEEERGGTIHLGIAVEGAKSPE

SEQ ID NO: 113270 - protein, 159 aa, Glycine max
  Coding DNA Sequence Number=SeqID_21585
  Gene Ontology: Mol. function=oxidoreductase activity; Biological process=metabolic process
  Homolog annotation: Hit_ID=A9CHL6; Match level="QueryCoverage=48%, HitCoverage=29%, E-value=1e-22, Identity=74%"; Hit description=Short- chain dehydrogenase
  Pfam annotation: Domain name=adh_short; Domain location=53-158; Score= -58.6; E_value=0.089; Accession=PF00106.16; Description=short chain dehydrogenase
MVVGVNVPEGNNIFRPTSSRYAYLAAVDVLATLAAYHHRQRSMVTLRHIKQQLGDIGRAIAAALSESHAKVVLVDIDAEALSNALSLLSGSGFVAKTCDVTDPADLSRLAADVAELGDVATLVNNAGAARLSVCTTRPPKYGGRTMPLISKHRFSASRF

SEQ ID NO: 113271 - protein, 78 aa, Glycine max
  Coding DNA Sequence Number=SeqID_21586
MVGAFSQNIVTLTGLPMILLSESDLTNPLCGVSRYVLLSVPGWFFTDMLARNVITHSLCVVVFGSCDDLELVFGGADE

SEQ ID NO: 113272 - protein, 160 aa, Glycine max
  Coding DNA Sequence Number=SeqID_21587
MNRWMTMKNLMLEDTGTPRSDRIIYVRGRGCHNNPTGSYRLYDPNAHQIVYSRDVYVDEQRSWKDYTENFSVSRRQVQLSWDNSEVINDPTRFNHDASPAGVRGRPVRNRQQPVRLQDYELFPDNAVTNDGDLIHLALQSDIESDSFDEAITVRYGGKLC

SEQ ID NO: 113273 - protein, 112 aa, Glycine max
  Coding DNA Sequence Number=SeqID_21588
MVSEGWVTGNRLPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 113274 - protein, 139 aa, Glycine max
  Coding DNA Sequence Number=SeqID_21589
MVKEECKEASVSSKRTLVSTIKPLELEVIPQVKELLDEGLVRKSLNPRALLVPKIGIIKHQIPKIGVMKNVLSGATLFCKITHTPNIFMIRVHRSSLGSHQGVSTNPKRIKHHSLSWLGTMFPRKKMPRKGDFSDLTLL

SEQ ID NO: 113275 - protein, 114 aa, Glycine max
  Coding DNA Sequence Number=SeqID_21590
  Gene Ontology: Mol. function=1-pyrroline-5-carboxylate dehydrogenase activity; Biological process=glutamate biosynthetic process
  Homolog annotation: Hit_ID=A4W940; Match level="QueryCoverage=84%, HitCoverage=7%, E-value=3e-47, Identity=98%"; Hit description=L -proline dehydrogenase / delta-1-pyrroline-5-carboxylate dehydrogenase
MAMRLMGEQFVTGETIAEALANARKLEDKGFRYSYDMLGEAALTAADAQAYMVSYQQAIHAIGKASNGRGIYEGPGISIKLSALHPRYSRAQYDRVDGGALPAPEVPDPAGAPV

SEQ ID NO: 113276 - protein, 136 aa, Glycine max
  Coding DNA Sequence Number=SeqID_21591
GVTTSPSSSASEEEKGKESSEEIYSQEEGQPLMVKGECKETLVSTATPLGLEVIPQVKKLLDGGLVRKSLNLCALLVPKIEESNKVASKDKHCFKINTRLLQQTKSCFKISLRSSLASKQSVSKTCKALVIDYQTV

SEQ ID NO: 113277 - protein, 82 aa, Glycine max
  Coding DNA Sequence Number=SeqID_21592
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=71%, HitCoverage=11%, E-value=3e-16, Identity=57%"; Hit description=Mini -chromosome maintenance protein MCM3
VCGIESFYFDDKFRYPVNSAPGQLPRTVDALEGKGSVNGVFRTVLIANNVSLLNKEDNAPIYSVEDVKNIKEIAAEMMHLIC

SEQ ID NO: 113278 - protein, 111 aa, Glycine max
  Coding DNA Sequence Number=SeqID_21593
MAPKKLLSKRARKDAVREGFSAAPQVDIAFDGHWFRNAINKLFGHPLVLEEEQPCEFSERRIQASEFDEKAIGQLLCVPRQDFARSVMGRRVRIKRFSMTTLTQIWMTLLP

SEQ ID NO: 113279 - protein, 193 aa, Glycine max
  Coding DNA Sequence Number=SeqID_21594
MGWIDFALTLNGSQELPRLLARAKEKADVYSTPEEAHGLFDYRQHMEVQEQMKADMEAMKDQMTFMMEAMLSMRRMMEDNTTAVATTSVAIEADLTHPSSINQTSRPAPDMVGQGGEVLGSMGGPHANANHSIPVLLKGQQPQLENAPFAQPMGEAREKPRDHALGEFEPHPTYVVEGPTFCGMPQPNAARAP

SEQ ID NO: 113280 - protein, 97 aa, Glycine max
  Coding DNA Sequence Number=SeqID_21595
MRRLQQTLLSWPNLRFSHMLCGRLDVELGPSTALTLILPWCPMHAIEKVMQTFQLPMTKKTRQMRCMSDDTSDLVIKEYLGVLNLKEGLRVSQKWLK

SEQ ID NO: 113281 - protein, 98 aa, Glycine max
  Coding DNA Sequence Number=SeqID_21596
  Gene Ontology: Mol. function=transferase activity
  Homolog annotation: Hit_ID=A5AHF5; Match level="QueryCoverage=71%, HitCoverage=15%, E-value=3e-11, Identity=48%"; Hit description =Putative uncharacterized protein
  Subcellular localization annotation: CTP_CleavageSite=54; ConfidenceScore=5.08e-01
MYLHEGGQITLKCLATQIQTMLDAWAQGSLHLGTSFFFGGVVSWRSAKQSMFVTSTMEVDFEATIQALWLWNFTSRFGIANNIAELLRIYCDNSATIF

SEQ ID NO: 113282 - protein, 135 aa, Glycine max
  Coding DNA Sequence Number=SeqID_21597
MKREKHASYRSHNSCKSLSEELRDYYEGRHRSHLRPHSHRREKERKPQEANIKLSYFHGKDNVEANIDWEIRVEQQLKKMTHYFSCPTTKTMIMRAKTFIVAKMRLLLHLSSSESEKEKGEDLVKKSTPKKKDNH

SEQ ID NO: 113283 - protein, 144 aa, Glycine max
  Coding DNA Sequence Number=SeqID_21598
MAMFDPEIVMEFYANTWPIEEGVTDMRSWVRGQWIPFDEHVINQFLGHPLVLEEGQHCEFSQRRSQGSNFDEEAISQLACVPGQDFAWSVAWRQVRIMRTSMTTIMQIWMMLLLSNIFPSNHISDLALPKDYAYKTPSGPGEVQ

SEQ ID NO: 113284 - protein, 144 aa, Glycine max
  Coding DNA Sequence Number=SeqID_21599
MSISPITSRRVPSKACTTIELGFKCDALKGSFSKVVFGITFKLDPLSISTFATTWSIHLTDTCRALLCPLPSTGISSSTNAIPSFFFGSSCHERIYFLRGGGYVCGLLDHGRLPFRGQIRRVRGSEHPTTAGYATEAGDVGYLS

SEQ ID NO: 113285 - protein, 82 aa, Glycine max
  Coding DNA Sequence Number=SeqID_21600
MQCRPQLNGISFSNIGQQQNQMLALLGKWRWDMLQQSNKLWSKILHSKYGGWRSLVEGGRRNNESDEFYPPRWHYLEGGMRG

SEQ ID NO: 113286 - protein, 116 aa, Glycine max
  Coding DNA Sequence Number=SeqID_21601
DRWMYFADHVLAVGELCLVPGQVGDHPRDAPAADPKEYMQPPIPQVLVAFDPPPHAVDDYDGYEAIAQRLERVLNLRMVTAGIELYDIMQDCLTIARGGASADGSVRARQRRCKEH

SEQ ID NO: 113287 - protein, 37 aa, Glycine max
  Coding DNA Sequence Number=SeqID_21602
MEAKEVAYKVGAINTKPDGLIVRDRGSNNMEQPKVKA

SEQ ID NO: 113288 - protein, 120 aa, Glycine max
  Coding DNA Sequence Number=SeqID_21603
MPISPCRWIAPTRRPMDLKKSNRALGFPALESHPQGHLSGPGEVHRALGFPTLVTGLCSPTGCPFPPARSRHHDIGIAPARHPVDPKKSNRVLELSSSNYGSLSILRSACHLQLGHQPPY

SEQ ID NO: 113289 - protein, 170 aa, Glycine max
  Coding DNA Sequence Number=SeqID_21604
  Homolog annotation: Hit_ID=Q6UUU1; Match level="QueryCoverage=35%, HitCoverage=40%, E-value=1e-18, Identity=78%"; Hit description =Putative uncharacterized protein
LNEVTNRINAVAFSAPLVGKLSGCILLNVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 113290 - protein, 191 aa, Glycine max
  Coding DNA Sequence Number=SeqID_21605
MNNSRWGQELSPYNQYEEERTPNLKSVFEEFMAYHANSKANQNSVQNQEIQFGKSYSMENYRGGQELQPYNQNEEEREVEAQEESLVKEHDSREKDEEEFEEEAQQREKYSTIENQQESILQLKTSPHQLIVKEERHGEHDKALSVILSLITSTSLAMIWKIFPKYMSFIEFLAKRRKCKEDVFYVTFMPP

SEQ ID NO: 113291 - protein, 94 aa, Glycine max
  Coding DNA Sequence Number=SeqID_21606
MSILTLGSKKQGKEISNQRERKKEERKFPIKEWEKAKRKEKIPNQRMGESKKEGKKVPDQRSRRNVQKGLLTRQYLNNTELSPNEQKEGKETMT

SEQ ID NO: 113292 - protein, 146 aa, Glycine max
  Coding DNA Sequence Number=SeqID_21607
TIGFHKFFTLLKEGLLLFDDAAADAQQGIVTALKALNQPAGFLQVAADKLAVGVVARIIAHRRVLLINLQPRNAVGIELDDPAAVNLAHQYIRDHVFRLAGLNGLTRARIQRLDQANRLFQNVFFQASDAHQATEIVVGQGDQDAR

SEQ ID NO: 113293 - protein, 50 aa, Glycine max
  Coding DNA Sequence Number=SeqID_21608
MVGYTFQALRIWSSPTKGSKWVWKEPNNVITQPISTLLITHHLVIHKGHP

SEQ ID NO: 113294 - protein, 90 aa, Glycine max
  Coding DNA Sequence Number=SeqID_21609
MKPTISLLILALGSLTTVASYCVNNNGCRAAHAELYARNQLPLSNEFSKKIEIGKRECCDPSSDGCIKGSKDDLLLWIDCDTDARDKKGF

SEQ ID NO: 113295 - protein, 36 aa, Glycine max
  Coding DNA Sequence Number=SeqID_21610
RILAPRYPPNEELRSLFKGEGMMQSYSARAWDRKTP

SEQ ID NO: 113296 - protein, 38 aa, Glycine max
  Coding DNA Sequence Number=SeqID_21611
MWTTTGDELATQLAQTSKVASSRSNSLLEEESGRPRWA

SEQ ID NO: 113297 - protein, 206 aa, Glycine max
  Coding DNA Sequence Number=SeqID_21612
  Homolog annotation: Hit_ID=Q6WAY6; Match level="QueryCoverage=95%, HitCoverage=31%, E-value=9e-27, Identity=36%"; Hit description =Putative uncharacterized protein
MKQTRNGVVGLPRKYLEGKARDMASQEKWGPFADILVLLIFGVVIFPNVDGLVDLAAIDAFLAYHHSKESPVVAILVDLFDTFDRRCEKNSARIVCCLPALCVWLVSHLFQQDTRHPCPLQSYHLYAKKGRVDWDQHLVGIGGSAINWFPRWKEGKEGVLFSCGDYPNVPLVGTRGCINYNPALAIRQLGYPIRGAPTEESLSPLR

SEQ ID NO: 113298 - protein, 84 aa, Glycine max
  Coding DNA Sequence Number=SeqID_21613
MAASDHAILRDQAYTPTTKSLLELTSQDTLLAWHKLLPKQLETLTEMLSKLPQQLQAVQLAHSSVMHIGGCNICGRAHELAMCM

SEQ ID NO: 113299 - protein, 75 aa, Glycine max
  Coding DNA Sequence Number=SeqID_21614
TIFLITLLNPFLCSCSFSSLTSGCEPSRVYRVTSYGADPMGNSDSTEALLAAIEGWKLLDHPVTEVAGGRGGEPY

SEQ ID NO: 113300 - protein, 83 aa, Glycine max
  Coding DNA Sequence Number=SeqID_21615
MGSKYLEVVKRGSHPNNGWSPGEIRRASIAKCSFSALSTIEESSRASISRMRAKCEISLLSMMVVFSQAQRMTSAKLKSTYSR

SEQ ID NO: 113301 - protein, 102 aa, Glycine max
  Coding DNA Sequence Number=SeqID_21616
MRFMKQAKYSLKAQVEKDEGPSGEGQSPRVEKDEGPSNPCGVYPDLSSLTGSGVYPDLSSLTGSGVYPDLSSFTGSGVIQIFVACIKRSAPTQVHITVYGKF

SEQ ID NO: 113302 - protein, 30 aa, Glycine max
  Coding DNA Sequence Number=SeqID_21617
MEKSLVSLKSMKRSGRREYEEEAMLGDMLM

SEQ ID NO: 113303 - protein, 86 aa, Glycine max
  Coding DNA Sequence Number=SeqID_21618
MDLIENMAASDTAILRDRAHIPTKRSLLELTSQGALLAQNKLLSKQLEALTEILSAGCTICGGAHESGCCIPIEENPTHEVNYMGN

SEQ ID NO: 113304 - protein, 54 aa, Glycine max
  Coding DNA Sequence Number=SeqID_21619
  Subcellular localization annotation: CTP_CleavageSite=34; ConfidenceScore=5.30e-01
MATAIVTKMTAILVARVTFFKNPFFPLNNGALKRCTLTGRRPLQVQDNVAILRT

SEQ ID NO: 113305 - protein, 142 aa, Glycine max
  Coding DNA Sequence Number=SeqID_21620
  Gene Ontology: Mol. function=transferase activity, transferring glycosyl groups; Cellular component=chloroplast; Biological process =histidine biosynthetic process
  Homolog annotation: Hit_ID=A7QCI8; Match level="QueryCoverage=52%, HitCoverage=18%, E-value=2e-25, Identity=78%"; Hit description =Chromosome chr12 scaffold_78, whole genome shotgun sequence
  Pfam annotation: Domain name=HisG; Domain location=13-138; Score= -10.3; E_value=5.6e-06; Accession=PF01634.9; Description=ATP phosphoribosyltransferase
MYKENWTQTWPMGSEIYPEVHENPRVFFSSFSPILLEPLAHGSSDWSLPREDCITSIVCVFVGCEMWLTTGPKMGIADAILDIVSNGTTLRENNLKEIKGGVVLESQVVFIASRKSMIQQKGVLETTQEMLERLEAHLRAIG

SEQ ID NO: 113306 - protein, 101 aa, Glycine max
  Coding DNA Sequence Number=SeqID_21621
MIKVEQDPSVHMQSINSLEVVVATCQFAGERGRGSRVRFPKEERCAKSPPTFICGKRRENRRKPVKMKILSSGVVFTLEEGRQKRGSCSYVPSIKEEIRPT

SEQ ID NO: 113307 - protein, 146 aa, Glycine max
  Coding DNA Sequence Number=SeqID_21622
  Pfam annotation: Domain name=zf-CCHC; Domain location=78-91; Score =10.8; E_value=0.035; Accession=PF00098.14; Description=Zinc knuckle
GMQPKVTAISESKDLSSMSLATLFGKLQEHEMELQRLNQNEETNKRKRSIALKASSSIQEEEEAEEEESNDEEDFSLFCNQPGHIKANCPSNESWPEKNEKKSFKERRSKKAYIAWDDNDSSDRSEKEINLLSKDYESDENISQED

SEQ ID NO: 113308 - protein, 76 aa, Glycine max
  Coding DNA Sequence Number=SeqID_21623
  Subcellular localization annotation: CTP_CleavageSite=55; ConfidenceScore=5.69e-01
MATPPASPLPPPPSPPPLAVASESPSTLKRTRKATSLQSLATRPPGAERPVVHVNPMTGKADGPHKRKSSTYFGYR

SEQ ID NO: 113309 - protein, 69 aa, Glycine max
  Coding DNA Sequence Number=SeqID_21624
  Subcellular localization annotation: CTP_CleavageSite=38; ConfidenceScore=5.61e-01
MANYAKIFNRSSTFIVRSSLFFGLQPVSTPNRAFQFILCTRGGPHLLRVFLFSFHLLSVPPFDVLQSFI

SEQ ID NO: 113310 - protein, 134 aa, Glycine max
  Coding DNA Sequence Number=SeqID_21625
  Subcellular localization annotation: CTP_CleavageSite=76; ConfidenceScore=5.25e-01
LPDRLARGLQLSEGNFGGNQLLDGSISLSPLYPSQTNDCTSVSLRASTRVSSGFAPLRHSSPSFGSRQGDPTNQLPCALRVYSPVDSHTCQTPWSVFQDGPNGEPTGRRQERAGAEARQGRALPSTIAMMTSLN

SEQ ID NO: 113311 - protein, 206 aa, Glycine max
  Coding DNA Sequence Number=SeqID_21626
MSMASSFLLLGGSYLHGTAWPFRYGNRIGLTIEGSSGCIKQESSPMPTAGNYAPPFCRALVDKPPGGRHVLQRLGPARPTRLDGINCSPSMIGERVCFHVGPVLLKRQPSGTYQMLDLVFKGQTAFGGVARGFPMIFPGDIIAIWLAMRDGKRSSYIIGIRVNSGVGLGGKFFIALEPAPKWALPARRVGVGAGAWGPPSGWVWAP

SEQ ID NO: 113312 - protein, 153 aa, Glycine max
  Coding DNA Sequence Number=SeqID_21627
  Homolog annotation: Hit_ID=Q949K7; Match level="QueryCoverage=26%, HitCoverage=45%, E-value=6e-08, Identity=62%"; Hit description =Putative gag polyprotein
MACLPNYTPPNVAYIPNEDVNNSTPILIKSQQPQSDHAHVSRPMEETHGMPHHNLADFEPCLGYATERQAVGEERLRAIEGGKDYAFANLEELFLVPNIITPPKFKVLDFDKYKGTTCPKNHPKMYCRKIRAYAKMRNANTFLPESLTGVVVT

SEQ ID NO: 113313 - protein, 187 aa, Glycine max
  Coding DNA Sequence Number=SeqID_21628
  Homolog annotation: Hit_ID=UPI00016621D1; Match level="QueryCoverage =77%, HitCoverage=39%, E-value=2e-14, Identity=37%"; Hit description =UPI00016621D1 related cluster
  Subcellular localization annotation: CTP_CleavageSite=14; ConfidenceScore=5.40e-01
RTTHPRLQRTARPRLQRTARPRLQRTARPRLLRTTCPHLQRTTRLYVLPFRRLHALTFRGLFVLPFRGLHVLVFRGLHVLHFRGLHVLAFRGLHGLHFRGVHVLPFRGVHVLAFRGLHVLAFRGLHVLAFRGLHVLTFRVLHVFPFRGQHVLTFRGLRALAFRGLNILTFRGLHALIFVGLHALAFI

SEQ ID NO: 113314 - protein, 175 aa, Glycine max
  Coding DNA Sequence Number=SeqID_21629
  Subcellular localization annotation: CTP_CleavageSite=59; ConfidenceScore=5.38e-01
MLGAPSIIAGAPSNLLEGQVCPSLKNFKRLPLFSRIHFVLLLLFLFFPLPGAFSSTASPAAASFAWTPLPFENHRVEDESRRCRKKWGKGADGETSGRPVRGSSGTSGRTFSGNFPEEVFFRKKPNVFRKNPASGNFPEKGFFRKLLGFPEEVSGRSVLPKLFRKNTSSGKFYEK

SEQ ID NO: 113315 - protein, 117 aa, Glycine max
  Coding DNA Sequence Number=SeqID_21630
  Subcellular localization annotation: CTP_CleavageSite=20; ConfidenceScore=5.01e-01
MATVRFAGSPRCIVAPGFCRSQANGVKRPVPPIGFTRWGEFVGTVVHEVTEIFPYFGDMLDAGFGGFVAVDPEAVLLVKAAVFPARGEGEGIAGAEGGAAKLGTLENTTSDVRPFKN

SEQ ID NO: 113316 - protein, 200 aa, Glycine max
  Coding DNA Sequence Number=SeqID_21631
  Homolog annotation: Hit_ID=UPI00006A2D9E; Match level="QueryCoverage =86%, HitCoverage=86%, E-value=1e-08, Identity=20%"; Hit description =UPI00006A2D9E related cluster
RAHDLAFRGLHVLALEGCTPSPSEDYTSSPSEGCTPSPSNDYTLAFRGLHVLAFRGLHVLTFRGLHVLAFRGLHVLAFRGLHVLAFRGQRALAFRGLHILTFRGLHALTFRGLHVLTFRGLPAFTFIGLHALAFRGLHVLPFRGLHVSPSEGYMPSPSEDYMSSPSEGCTLSPSEEYKTSPSEAYTSSSTEGWTPSPLED

SEQ ID NO: 113317 - protein, 71 aa, Glycine max
  Coding DNA Sequence Number=SeqID_21632
MYFKTAQLFAIRDRQTQTVINSGSQYSEVVSDAMNNGQQESNTHIVNEFDRHNHTFIITETQSPLQTPRPP

SEQ ID NO: 113318 - protein, 339 aa, Glycine max
  Coding DNA Sequence Number=SeqID_21633
  Gene Ontology: Mol. function=receptor activity
  Homolog annotation: Hit_ID=A5FFG2; Match level="QueryCoverage=98%, HitCoverage=71%, E-value=5e-60, Identity=39%"; Hit description =RagB/SusD domain protein precursor
MSSCEKLIEVELPSNQIASDQVFVDVQTADAALAGLYSGLRDNSPFAGDQSGRLLGLYTDDLDFYSTTATNGLPEIAQNLQNDSNASIYTDWSTSYKQIYVANAILEGIEKSKSISQADRNRIKGEALMVRSMLLLYLQQVYGDIPYSTTTDYQVNQSISKTDKAQVLIQLSEDLKESISLLQDNYRNTERIFPNRKMAELLLAKVYLLEGRWVEAELLLKGIIQSPLYEFQNDITKVFIKSGSHILWQLKPENSGDGTKESGIYYFNNSAPSMTALSTGLVNAFYPADLRKQYWMAPVTFNGTTWYRAEKYKYRTANTTEYSIIARLEEVYLLLAATL

SEQ ID NO: 113319 - protein, 346 aa, Glycine max
  Coding DNA Sequence Number=SeqID_21634
  Gene Ontology: Mol. function=oxidoreductase activity, acting on NADH or NADPH; Cellular component=plasma membrane; Biological process =mitochondrial electron transport, NADH to ubiquinone
  Homolog annotation: Hit_ID=Q1H3E8; Match level="QueryCoverage=95%, HitCoverage=63%, E-value=1e-157, Identity=82%"; Hit description =Formate dehydrogenase beta subunit
  Pfam annotation: Domain name=Complex1_51K; Domain location=1-250; Score=358.3; E_value=1.3e-104; Accession=PF01512.8; Description =Respiratory-chain NADH dehydrogenase 51 Kd subunit
MSGAEIVKAVTDSGLRGRGGAAFPTGIKWNTVLNVPAEQKYVVCNADEGDSGTYSDRMVMEDDPFVLIEGMTIAGIAVGATQGYIYLRSEYPHALKTLNEAIRKANLAGYLGENILGSGHTFHLEVRRAAGAYVCGEETSLLESLEGKRGLVRFKPPLPAIEGLFGQPTIVNNVISLATVPIILDKGAQYYADYGMGRSRGTLPIQLAGNLKQTGLVELAFGATLRELLYDYGGGSASGRPIRAVQVGGPLGAYLPESQFDTPLDYEEFTKIWAVLGHGGIVAFDDSVDMAKMARYAFEFCAEESCGKCTPCRIGSTRGVEVMDKIVSGKQHPQMCNCCGICLTLC

SEQ ID NO: 113320 - protein, 97 aa, Glycine max
  Coding DNA Sequence Number=SeqID_21635
MVCNDNADMTDKLLAGLAVGVSLNEACALSENHTLSEALSPLNELGESREEFEKHLRVQRVISSLSETFVSSHVKYLCWEILAKLDAKFNETSENEV

SEQ ID NO: 113321 - protein, 74 aa, Glycine max
  Coding DNA Sequence Number=SeqID_21636
MAPRSMKVDSLIDRARPLKIEGRYALNLDRVVQQLPTWHSRSFQGAGLWQVQGDYSLQEPSKDVLSEDGGIRKR

SEQ ID NO: 113322 - protein, 140 aa, Glycine max
  Coding DNA Sequence Number=SeqID_21637
  Gene Ontology: Mol. function=beta-lactamase activity; Biological process=beta-lactam antibiotic catabolic process
  Homolog annotation: Hit_ID=P62593; Match level="QueryCoverage=23%, HitCoverage=11%, E-value=6e-11, Identity=100%"; Hit description=Beta- lactamase TEM precursor
LGPDGKPSRIVVIYTTGSQATMDERNRQIAEIGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFE

SEQ ID NO: 113323 - protein, 100 aa, Glycine max
  Coding DNA Sequence Number=SeqID_21638
MFIRITTRVFPPVSVTQKSAYRLQLTKGAEDDVSLCMLSGFSSYRQQKRMFIWITTRVFLARQRDSKVSMTDLVKGDGKARLLLRVYGIGRNDGRAQDLR

SEQ ID NO: 113324 - protein, 130 aa, Glycine max
  Coding DNA Sequence Number=SeqID_21639
  Subcellular localization annotation: CTP_CleavageSite=44; ConfidenceScore=5.13e-01
MSSQRKGRSRPYTPGLAPKPTPFAYQSNKVVPWKYTAPAFEERVATEVDSLSAKVTNITGLSGITRSGRVFAPPHSAELPPKGKAPLVQEPTDVATPSKEVDPLVVKGAEKKEVTLEELMSSFAHPTKRV

SEQ ID NO: 113325 - protein, 46 aa, Glycine max
  Coding DNA Sequence Number=SeqID_21640
MESKGNKLLRWLAPCFLTQILQDMAPILLSNSLYGNSQARKQRDKQ

SEQ ID NO: 113326 - protein, 147 aa, Glycine max
  Coding DNA Sequence Number=SeqID_21641
  Subcellular localization annotation: CTP_CleavageSite=52; ConfidenceScore=5.41e-01
SLLNNKEKNKMKDCKNTCGEDVSFTSRISQSLTNSSQALNPASTSSSGGLVRARALSALMDRLAHVSDFWLSAPFSLSQHALRGRVRARLMGALSKGGKMRGVATNEGISTSHVDKSGAFAPTHPPLERKSDLRSSFLGVNQAILFT

SEQ ID NO: 113327 - protein, 62 aa, Glycine max
  Coding DNA Sequence Number=SeqID_21642
MDKSLKVGEHEWRKRKRERERERERRGTKFMPQMSYGSAHLIQDQVQDSPLSVPRCHEACKA

SEQ ID NO: 113328 - protein, 143 aa, Glycine max
  Coding DNA Sequence Number=SeqID_21643
MKKSLHQLLSKNPQLRVLAFHGQEAPFTLKKRNKEKLLAYKGVGMSPPPLGISQSLKNLLISLKDENLAPCSALCSLKFTLFMPLSSVKFFFWLPLYSVQIRLKKGFLILTSCLAPFSRLARVSEFELSANLALSLESERRLA

SEQ ID NO: 113329 - protein, 36 aa, Glycine max
  Coding DNA Sequence Number=SeqID_21644
MEETNVHKTTWGTPKGKWALGAKAARPGELELAQAS

SEQ ID NO: 113330 - protein, 148 aa, Glycine max
  Coding DNA Sequence Number=SeqID_21645
MARTRGLGRAIGRFVGRDRAADEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQERPDLKLVSHGRKLTLIGRPVPEIEGL

SEQ ID NO: 113331 - protein, 318 aa, Glycine max
  Coding DNA Sequence Number=SeqID_21646
AACPHSRGLHVLALRGLHALTLGTSYPHRQRTTRPRLERTTRPHHQRAARPHLGGLHVLAFKGSCTFNFRGLHILAVKGSCAFPFVGLHALTFRGLHDYMFPIFKGGHALTFRGLHVLAIIGLHSLAFERRHVLNFRGLHALAFRGLRVLTFRTNSFLLTVPGPTVQAQPEREAITQLLCILGQDFTRAAAKRRGSHPQDTQWTRKSPTGPWGFQLWLRASISPTGCPYPPRQGHVIIGIATARHPVDPKKSNRVLELSSSNYGQAQGETPQQHWDGRQRETDAPPSPLEFTSAHPQKGLSIAYTTWPTHRRPSPKPK

SEQ ID NO: 113332 - protein, 299 aa, Glycine max
  Coding DNA Sequence Number=SeqID_21647
  Homolog annotation: Hit_ID=Q84VI1; Match level="QueryCoverage=100%, HitCoverage=51%, E-value=1e-132, Identity=73%"; Hit description =Envelope-like protein
MATSPKETSASGSPAVRSSPHQEQPEFNIQPIQIIPGQASVPEKLVPRRQQGVKIAENPSLATSPREVDTEMDKKIRGIVSSILKDASVPDAEKDVPTSSTPDVSVPDVNKDVPTSSAPNAEALPSPKRLQGRKGKTPLKRSGRIKTMAQKKSTPITPATSRRSKVAIPSKKRKEISSSDSDEDVELDVSTSKRAKKSGKKVPEKVPDAPLDNISFHSIGNVEKWKYVYQRRLAVERELGRTALDCKEIMDLIKAAGLLKTVTKLGDCYEGLVREFIVNIPSDISNRKSDDYQRVFVRG

SEQ ID NO: 113333 - protein, 289 aa, Glycine max
  Coding DNA Sequence Number=SeqID_21648
GVHEVATNPSASSETKKLEGKLDALVNLVTQLALNQKFVPVARVCGLCSSADHHTDLCPSMQQPGAIEQPEVYAANIYNRPPQPQQQNQPQQSNYDLSSNRYNPGWRNHPNLRWSSPQQQQQQPAPSFQNDAGPSTPYIPPPIQQQQQPQKQPIVEAPPQPSLEELVRQMTMQNMQFQQETRASIQSLTNQMGQLATQLNQQQSGKQCQGPQPVTPSSSANEPAQLHSNPEKGNDKNLPNNFCAGESSTGNSDLQKQHIPPLPFPPRAVSNKKMEEAEKEILETFRKVE

SEQ ID NO: 113334 - protein, 102 aa, Glycine max
  Coding DNA Sequence Number=SeqID_21649
  Subcellular localization annotation: CTP_CleavageSite=15; ConfidenceScore=5.20e-01
MAYSLKQSPVESPTVATYPSAGGRRVTRGMRVPRKEYARSRHQRLFEENVRKTGKDAIYELLSERFGSCIYARGSIILPLFDFQRGYGMTERSEFILTEVNG

SEQ ID NO: 113335 - protein, 69 aa, Glycine max
  Coding DNA Sequence Number=SeqID_21650
MAHQNPPYLAFCTPGQNDTKNKIQGYQRETNKNIHIFLNEHQGMKGMGSINKNQAKAIVQAINGAKHTK

SEQ ID NO: 113336 - protein, 91 aa, Glycine max
  Coding DNA Sequence Number=SeqID_21651
  Homolog annotation: Hit_ID=Q1J7G7; Match level="QueryCoverage=35%, HitCoverage=58%, E-value=6e-07, Identity=68%"; Hit description =Transposase
  Subcellular localization annotation: CTP_CleavageSite=36; ConfidenceScore=5.03e-01
DLPSPGIYSAQSASAVPPVQLLTGWCVTAKAPPDISAGKCSGRVPFAIQAAQLLGRAIGAGLFAITPAGERGMCCKAIKLGNARVFPVTTL

SEQ ID NO: 113337 - protein, 185 aa, Glycine max
  Coding DNA Sequence Number=SeqID_21652
MTGRLLAGSLTFDNHIMHYIIVRILLPRSSNLAQASEEDLILMWAFLTVRQIDWVHLVRYRMHKTLRTNAPLPYPQLITLFLRHFQIPLDDEPFVQVKRSFAIGAGAVTSFGYRKDQNGQWLKKDALPPQDEFLSELRGLRSYIGERFDSLDTRFAGMDIRLTQLEEDMGYIRQSFDLPPPPPPS

SEQ ID NO: 113338 - protein, 137 aa, Glycine max
  Coding DNA Sequence Number=SeqID_21653
  Homolog annotation: Hit_ID=A5B939; Match level="QueryCoverage=25%, HitCoverage=22%, E-value=8e-07, Identity=74%"; Hit description =Putative uncharacterized protein
GDVGGARKEYLFCLTACPPGNGSAGASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 113339 - protein, 240 aa, Glycine max
  Coding DNA Sequence Number=SeqID_21654
  Gene Ontology: Mol. function=mannosyltransferase activity; Cellular component=membrane; Biological process=protein amino acid O-linked glycosylation
  Homolog annotation: Hit_ID=Q1GYX8; Match level="QueryCoverage=60%, HitCoverage=30%, E-value=3e-30, Identity=42%"; Hit description =Glycosyl transferase, family 39
MATPRAKVGERAKTHLLILLCAIWLCVGLIGHSPWKPFESQSASIIQNLIDHPFLSSSSWIHGDWIAPTSAGNPTLETPPLFYWTATGFAHLLSPLLPTHDAARLSWSALHTMMPAIAALSRVSAMAFYALALIMRKPVRAMWLLLYRLISGYHVWWCRTGFNHYIISHLPVNPTRDSSTETRIPCHDRRHVACLTGNGHQDYGNPGGKHNGNSSYQPYHSPYGGSGVSGTPSSILTASS

SEQ ID NO: 113340 - protein, 587 aa, Glycine max
  Coding DNA Sequence Number=SeqID_21655
  Gene Ontology: Mol. function=transcription factor activity; Cellular component=cytoplasm; Biological process=regulation of transcription, DNA-dependent
  Homolog annotation: Hit_ID=A1G2F1; Match level="QueryCoverage=46%, HitCoverage=94%, E-value=1e-118, Identity=82%"; Hit description =Transcriptional regulator, LysR family
  Pfam annotation: Domain name=LysR_substrate; Domain location=389-587; Score=142.5; E_value=1.2e-39; Accession=PF03466.11; Description=LysR substrate binding domain
VARVLAIAAGLVANAPALAEARAQAGVAGLVVDQPVGQLLPRCRLQHFPQHHTLQRTSHRRRCGGVAQVAFGEAVHFRLQPVAAADRITAGAQERGHRRRATDHAEQQVGGGVVAGDDRGPAQVAHGHILAGMTAGDRCVREQVGLAHRYAPVEQRGCALGLAEHGCGQHALEGAAHREALVLAMADAATACGIEQGHAQASCAGLFQRGEITGGVDGGVCGCVGGGLARCTCQQRQGKRRSNSGTTELQESATGEHAGVLLGTVRLLEPTARTTSAKIQHQPLDLLMSIASIPAISGLPCPGVRISHHPGSRLDDAASHPATERAARLRGRRPSPELHPRRAGADRLGIRLFHRLPRGVALTDEGAALYPVLNESFERISASIARYTGGPAREVLTLGVVGTFATGWLLPRLAAFEAAHPDIELRLQTHNNRIDLAGEGLDLAIRFGDGDWQGQACTAILDAPFAPLCAPALARRLKQPRDLGTLPLLRSYRSDEWPRWLQAAGVSGVEARGPVFDSSLTVAMAAVGGAGVALLPLRMFEQELAEGRLLQPFSTTLELGRYWLTRLRSRAEREPAKRFREWLQAQG

SEQ ID NO: 113341 - protein, 73 aa, Glycine max
  Coding DNA Sequence Number=SeqID_21656
MTATATKSISLKPLGRDGTVRRHLVEEIPIVVPRYVVKPLATVAEGAVGNRHVDDKLSVAESGEEGAEAGSGN

SEQ ID NO: 113342 - protein, 186 aa, Glycine max
  Coding DNA Sequence Number=SeqID_21657
ETKFGHSAPLYHPEAAGPMIRGDTLRLSAPFCHPEAVGPMTSRAQIWSFCTLVSSRETKFGHSAPLYHPEAAGPMIRGDTLRLSAPFCHPEAAGPMTSRDQVWSFCTLVSSRGGGPDDTRRYLTGYPHPFCHPEAAGPMTSRDQVWSFCTLVSSRGGGPDDTRRYLTVIRTLLSSRGGGPDDKQRP

SEQ ID NO: 113343 - protein, 48 aa, Glycine max
  Coding DNA Sequence Number=SeqID_21658
KRKEKLATQLACPARPGELGCFLQKVPPSGELPGRPKWVWLLFAPPFY

SEQ ID NO: 113344 - protein, 138 aa, Glycine max
  Coding DNA Sequence Number=SeqID_21659
MTGPLNESISCFLIRVDPWVLVPSPSEDYTSSPSEDYTSSPSEDYTSSPSEDNTSSPSEDNTSSPSEDYTYSPSKGYMPSPSEDYMSSPLKDYTSLPSEDYTSSPSEGYTSSPLEDYTSSPLEGCTSLPSEGCKPSPL

SEQ ID NO: 113345 - protein, 65 aa, Glycine max
  Coding DNA Sequence Number=SeqID_21660
MFAYSPFAKLRPRAKHITVHALSLESQALSAQPLHLKMIHSTKLAKVELSQIQFDLDLAKQKPNR

SEQ ID NO: 113346 - protein, 64 aa, Glycine max
  Coding DNA Sequence Number=SeqID_21661
  Homolog annotation: Hit_ID=A4EB57; Match level="QueryCoverage=85%, HitCoverage=34%, E-value=5e-16, Identity=70%"; Hit description =Putative uncharacterized protein
MAVVSSCLWNPEQTAGDKPEEGEDDVKSSCPLCPGRHTCYNGRDKGSRSREGELTPKTRPQFGL

SEQ ID NO: 113347 - protein, 130 aa, Glycine max
  Coding DNA Sequence Number=SeqID_21662
MPISPADVSVGLCRHDIGIAPIRHPVDPKKSNRALGFPALVTGLYQSYRVHVHPARSCHRDIGITPTKTPSGPGEVQQGPGVSNSRIAPARHPVDPKKSNRVLELPSYNYGPLSVLRSACRPQQGHQAPY

SEQ ID NO: 113348 - protein, 112 aa, Glycine max
  Coding DNA Sequence Number=SeqID_21663
MAKFDPDIVLEFYANAWPTEEDMRSWVRGQWIPFDADTLSLFLGDPLVLEEGQECEFSQIRNRADEFDEEAIAQLLCIPGQDFARTAAGRRVRILWHGAVFTTLGSPAGAQP

SEQ ID NO: 113349 - protein, 277 aa, Glycine max
  Coding DNA Sequence Number=SeqID_21664
  Homolog annotation: Hit_ID=A5BUF0; Match level="QueryCoverage=64%, HitCoverage=48%, E-value=3e-07, Identity=24%"; Hit description =Putative uncharacterized protein
MINVYGTTLNFLLGSSETLKYLDTNFFNDETFDCYQVFQNSGLVDFRSLKLPYYPELVKVFYNNLKIQDDIISSEVHGISMIIDQSLFFSLTKLPSQGAPFEGTIVDDWKIDYSSHDARHMVCNDQAKMTGRLLAGSLTIDCRIIHYIIVRILLPRSSNLAQASEEDLILMWAFLSGCQIDWAHLVRYRMHKALRANAPLPYPQLHNDSSALLTKVLSELRGLRTYVGERFDSLDGRFEGMDTRITQLEEDVNYIRQSFDLPPPPPPPSQFLDYYYC

SEQ ID NO: 113350 - protein, 67 aa, Glycine max
  Coding DNA Sequence Number=SeqID_21665
MDGSSSRTMILVFPTIPVRLMVVADVLSRKSLHVVTMMSLEQRLTEEFRDLNLAIEMRPKSLFVGAL

SEQ ID NO: 113351 - protein, 104 aa, Glycine max
  Coding DNA Sequence Number=SeqID_21666
MTMQKNEDSNASYNIPRWLKAHMQDLDWLPSLRTTKGVEVEAPEEDEEVQALRAELKQAQSVKERFKLAALKIQKENAELRDVNKATTEALERETKRARREEYG

SEQ ID NO: 113352 - protein, 127 aa, Glycine max
  Coding DNA Sequence Number=SeqID_21667
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=P12201; Match level="QueryCoverage=95%, HitCoverage=87%, E-value=6e-55, Identity=71%"; Hit description =NAD(P)H-quinone oxidoreductase chain J, chloroplast (EC 1.6.5.-) (NAD(P)H dehydrogenase, chain J)
  Pfam annotation: Domain name=Complex1_30kDa; Domain location=55-123; Score=127.6; E_value=3.5e-35; Accession=PF00329.10; Description =Respiratory-chain NADH dehydrogenase,
MTIIDHGFDTDRDLQIKPEDWHPCCHFISPGGLLASVYHLTRLEYGIDQPEEVCIKIFVARKNPRIPSIFWVWKSADFQEKESYDMLGISYDNHPRLRRILMPESWIGWPLRKDYIAPNFYEIQDAH

SEQ ID NO: 113353 - protein, 96 aa, Glycine max
  Coding DNA Sequence Number=SeqID_21668
MADVLATLASMFQLPPHGDLPYIEFWCRGRPAHCCQVEEERDGKPDGISKAILEMQRTLTEFYMRVNVGENMTSPGARGPLYLSKKFMLMGTTSHG

SEQ ID NO: 113354 - protein, 58 aa, Glycine max
  Coding DNA Sequence Number=SeqID_21669
DVYDEIVERLERHLSLGVVTPGSSTHEVIEECLRMTRSMTQDHLVYVRSRRRRHMDQA

SEQ ID NO: 113355 - protein, 100 aa, Glycine max
  Coding DNA Sequence Number=SeqID_21670
  Homolog annotation: Hit_ID=UPI000069F178; Match level="QueryCoverage =89%, HitCoverage=43%, E-value=1e-08, Identity=37%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=91; ConfidenceScore=5.70e-01
MWSPLKVRMRSPLKARACSPLKVKACSPLMVRACSPLMARTTRTCSPLKVRACIPLKVRTCSPLMARTCSPLKVRACSPLKARACNPLKVRVLVPKGPLL

SEQ ID NO: 113356 - protein, 40 aa, Glycine max
  Coding DNA Sequence Number=SeqID_21671
MVRTRGFGRAIGRVVGRDKPADEDAADVPERRRPTISALV

SEQ ID NO: 113357 - protein, 215 aa, Glycine max
  Coding DNA Sequence Number=SeqID_21672
  Homolog annotation: Hit_ID=A5BPQ8; Match level="QueryCoverage=61%, HitCoverage=11%, E-value=2e-07, Identity=29%"; Hit description =Putative uncharacterized protein
  Subcellular localization annotation: CTP_CleavageSite=24; ConfidenceScore=5.10e-01
IMGSPPASTPPPPPPPPPPTSDASASTPPGVERPVVHVDPAIGKADGPHKKKLRTYLGIVARDKVDITYENWKEVATAQKDLIWEDIQFKSDLTRKWALAADQDGVEDTVCEKYGISKEKWAQFCQTRRDPSWEAIQKQNTAPHVLSRGGYDYLEQKLLAEKTKKKMQEVAQSGSVDGVIDPPSPVRRHVKWKMARMKKTGEMTTEAAKEIAEKI

SEQ ID NO: 113358 - protein, 110 aa, Glycine max
  Coding DNA Sequence Number=SeqID_21673
  Homolog annotation: Hit_ID=A5ZYV5; Match level="QueryCoverage=59%, HitCoverage=67%, E-value=7e-17, Identity=72%"; Hit description =Putative uncharacterized protein
MRTTCTWTERPYEASLFPGIGFGLFLRSLGGGQRRPPSGGAEPSASQKVTEACKGFLGPDGDWPSSAKAEGSLTARPTRRAGTKVGLSDPTVPSGRAVAQRIKVTLGITG

SEQ ID NO: 113359 - protein, 123 aa, Glycine max
  Coding DNA Sequence Number=SeqID_21674
MKIKKHVSYSSHDSCKSLSEELSDYYRGCHSSHTEHHSQRREKERKPQEANINLPYFHGKDNVEANLDWEIRVEQQLKRKSTSKSYGSHSYPKKDQGQGILGVTPSKPKDDKGKTIEKQPLKA

SEQ ID NO: 113360 - protein, 124 aa, Glycine max
  Coding DNA Sequence Number=SeqID_21675
MESEGRLNNSLLAIILGRTRELVPFGYYEWSNNLKEILLRRYAYIGGLPLIRKDNPKDYGVSLVKYWNDLKMENMEQRGEESSEEVYPHEEGDLLMHKISFQVDLISFPNQNLINFNGSMSKGK

SEQ ID NO: 113361 - protein, 171 aa, Glycine max
  Coding DNA Sequence Number=SeqID_21676
MIVTVRPKRVVRQFGYIQSIPPPPVSARLSHDQIDDRWMEFADHLLPAGQLCLVPGQVSADYIEWFFRISHPFMKPTQAADQQRDAPAADPEDYIQPPSPQVPVAFDPPPHVDDYEGYEAIAQRLERVLNLRIVTAGTELYDIMQDCLTIARGGPSADGTVRARQRRRTDH

SEQ ID NO: 113362 - protein, 105 aa, Glycine max
  Coding DNA Sequence Number=SeqID_21677
  Homolog annotation: Hit_ID=A6FJQ2; Match level="QueryCoverage=36%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLALEVLGVSDQSVREKGREKGVKDREEGATGSAAAAGASGRVGYPGATGRAGDPGATQLG

SEQ ID NO: 113363 - protein, 66 aa, Glycine max
  Coding DNA Sequence Number=SeqID_21678
MATPLGIELLSGVSFGCGTCDNPAQWRDLGSITIAVANQSSLELVDTRYYTQTRLSYGRCWTGSSP

SEQ ID NO: 113364 - protein, 73 aa, Glycine max
  Coding DNA Sequence Number=SeqID_21679
LEEEIGALFEGRFLSLGGVYGESPRYHLSQRALRGRAKERLTGALSKGGKVRGVTTNVLFVENVGKTEGNRSK

SEQ ID NO: 113365 - protein, 103 aa, Glycine max
  Coding DNA Sequence Number=SeqID_21680
  Gene Ontology: Mol. function=oxidoreductase activity, acting on single donors with incorporation of molecular oxygen, incorporation of two atoms of oxygen; Cellular component=membrane; Biological process=electron transport
  Homolog annotation: Hit_ID=A6T921; Match level="QueryCoverage=94%, HitCoverage=29%, E-value=2e-34, Identity=68%"; Hit description =Putative oxidoreductase
  Pfam annotation: Domain name=FAD_binding_6; Domain location=8-102; Score=9.2; E_value=5.8e-05; Accession=PF00970.15; Description =Oxidoreductase FAD-binding domain
MTEARMLSVIVDGLWREGDKSLAVRLVAENGEALPAWQPGAHIDVHLPCGVIRQYSLTGACGDEGYLICVGREAASRGGSRYVHETLRPGQKLLISAPRNLFR

SEQ ID NO: 113366 - protein, 76 aa, Glycine max
  Coding DNA Sequence Number=SeqID_21681
MKSGDMQGYSIVICTFHQPGANEPVDAQRLTSSSAPFVIQGQRVRWQAKIPYGHPHLSSTEANKFDDIRMMLVVRF

SEQ ID NO: 113367 - protein, 44 aa, Glycine max
  Coding DNA Sequence Number=SeqID_21682
MVYNDGINLKILMSHNNSFQNCPMYGVACQCGLRHWKCGRQTLW

SEQ ID NO: 113368 - protein, 88 aa, Glycine max
  Coding DNA Sequence Number=SeqID_21683
CQGPQPVAPSSSANEPAQPHSTPEKDDDKNLKTYPSSIPSKRNFQQKMEEAEKEILETFRKVEVNNTSAGCNKANSKICYNSGRSFVH

SEQ ID NO: 113369 - protein, 78 aa, Glycine max
  Coding DNA Sequence Number=SeqID_21684
  Homolog annotation: Hit_ID=Q946T5; Match level="QueryCoverage=43%, HitCoverage=14%, E-value=4e-07, Identity=70%"; Hit description =Reverse transcriptase
MQQQQQQRQQATEAPSQPSLKELVRQMTIQNMQFQQRQQRHSCQWVSLVQVVPKKTGLTVIKNERDELIPTRVQNSWQ

SEQ ID NO: 113370 - protein, 232 aa, Glycine max
  Coding DNA Sequence Number=SeqID_21685
  Homolog annotation: Hit_ID=A5BEV8; Match level="QueryCoverage=89%, HitCoverage=28%, E-value=4e-14, Identity=29%"; Hit description =Putative uncharacterized protein
MVSRYALNQIAVKFERVHYADKNTSHCGCVMRTTHSLPYAYELSKYVVGTIPLETIHISFSDQGLSEPQVSITKEMETISNDSSVKGSASSFEQPIQRRTMPMLDQFHPCIHDSIVNIVDVKDDGNYGYHAIAGLLGMGEDSWSLLRNHLLKELTKWSDEYMNLAGGLERFEELKRSLLVDGLSMVTMDKWINITDMGYVICHCIKVFLRDRCLLPLVALLWSTHCHHQAKQ

SEQ ID NO: 113371 - protein, 147 aa, Glycine max
  Coding DNA Sequence Number=SeqID_21686
MNILISFKKLHYLLHFSITASYGRTWVEFKLSKVVFKSIELEVNNSRTLLRAPSKITGTPSNFAIFPFCPSMKGYGSTNPYEAYGLANHISPIRSVDISGSLFLNRREDEGLGGEDTRPSRATLVALFSCGGFKVQAIGCHRFIVGV

SEQ ID NO: 113372 - protein, 79 aa, Glycine max
  Coding DNA Sequence Number=SeqID_21687
MRTNLEIEATCRRNRAERHRNFLQDIEAATILEEPQSSESSSSFPESRESDTTLLVANIMADEKPRRVTLEDYSSTSVP

SEQ ID NO: 113373 - protein, 109 aa, Glycine max
  Coding DNA Sequence Number=SeqID_21688
MMITKDDDKGDDKKLKGQSKDEFKMFKKESRTIQDSRGKLNSRIKIQGSSFKIKIQDSRFKNSREDLIKISMKRIFQKLSSTWIFLKTCLPKSFYSLVIDYQIVVIDYQ

SEQ ID NO: 113374 - protein, 55 aa, Glycine max
  Coding DNA Sequence Number=SeqID_21689
MDHFKVERLKGPPSKSDFLITIEEYVGARLSSLVTDVWGANTFPMRKYNSRTFHT

SEQ ID NO: 113375 - protein, 122 aa, Glycine max
  Coding DNA Sequence Number=SeqID_21690
  Homolog annotation: Hit_ID=UPI0000ECBAF8; Match level="QueryCoverage =35%, HitCoverage=50%, E-value=1e-17, Identity=100%"; Hit description= UPI0000ECBAF8 related cluster
GTKAGTGPPLEVDGIDKLDPTGDVPPHINEEEKTETPSFLSKNTTLEKILLIRDRSGRHRGGAPIRPIVSRITIHWPSFYNVVTGKTLALPNLIALQHIPLSPAGVIAKRPAPIALPNSCAA

SEQ ID NO: 113376 - protein, 124 aa, Glycine max
  Coding DNA Sequence Number=SeqID_21691
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=79%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTANTCQR

SEQ ID NO: 113377 - protein, 349 aa, Glycine max
  Coding DNA Sequence Number=SeqID_21692
  Gene Ontology: Mol. function=sugar:hydrogen symporter activity; Cellular component=membrane; Biological process=transport
  Homolog annotation: Hit_ID=A6T9Q2; Match level="QueryCoverage=92%, HitCoverage=63%, E-value=1e-113, Identity=57%"; Hit description =Putative maltoporin
  Pfam annotation: Domain name=LamB; Domain location=62-349; Score= -42.0; E_value=1.2e-07; Accession=PF02264.6; Description=LamB porin
MVMHKAKTARLALAIAGMMVGGSAAAQSLTLEQRLAQLEEKIARDEQQQKEASAGTTNTFRFSGYARSGLLINDKGRGGRAGPAISPASSIGGDAHIGRLGNEKDHYIELGFHNQTRFSNGSWANFKALLADGSSSPDPWVQNNDNNLNIRQVYVEMGDFPSFSGAARHASLWAGKRFDGDNFDLHFTDTDIVFLGGTGGGISNLQWNEQWRSDFSIYGRSFGDLGSSRYDDNNVQNLLLTSNQFYGNWQWMLTGMSANGNDELKGRASTTGSYALRSDDTAKHGVFTMLAWHDKNRFYGLAPGSSTHAIQWGKGLGAETRQIGGDGDLTRNASALRLATFGVMPLSDR

SEQ ID NO: 113378 - protein, 81 aa, Glycine max
  Coding DNA Sequence Number=SeqID_21693
MNSSSSGETKKLEDFVVYAPLDHTALEHYNFEHSDSEHSDFAHSENMAQPPPRERTLREMAAPNFTTKACASILDEMSHMF

SEQ ID NO: 113379 - protein, 232 aa, Glycine max
  Coding DNA Sequence Number=SeqID_21694
  Homolog annotation: Hit_ID=A5C702; Match level="QueryCoverage=50%, HitCoverage=18%, E-value=8e-09, Identity=30%"; Hit description =Putative uncharacterized protein
  Pfam annotation: Domain name=Retrotrans_gag; Domain location=14-103; Score=13.8; E_value=0.0024; Accession=PF03732.8; Description =Retrotransposon gag protein
MKPPDVQEDHIFLKAFPHSLEGVAKEWLYYLAPRSITSWDDLKRVFLEKNFPSSRTTAIRKDISVIRGVHEVATNPSASSETKKLEGKLDALVNLVTQLALNQKSVPVARVCGLCSSADHHTDLCPSMQQPGAIEQPEAYAANIYIDLLNLSSKINHSRHYDSPATDITLDGGITLTSDGPALSNNNSSLLLPSKMLLAQADHTFLHQSNNSNNPRNSQQLRPLHNLPSKNL

SEQ ID NO: 113380 - protein, 145 aa, Glycine max
  Coding DNA Sequence Number=SeqID_21695
  Homolog annotation: Hit_ID=Q2HW90; Match level="QueryCoverage=51%, HitCoverage=14%, E-value=7e-11, Identity=44%"; Hit description =Putative uncharacterized protein
MPSGRKEIVSFSGFYPSLARISKIVKISTQELDRGKQVENGVVGVPRKCLEAKARTLASQDEWAPFMDVLALLIFGVVLFPNVDRLVDLAMIDAFLAFHDRKESPVVAILADLYDTFDRRCEKNSARIVCCTPALYVWLVSHLFR

SEQ ID NO: 113381 - protein, 139 aa, Glycine max
  Coding DNA Sequence Number=SeqID_21696
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIAPVSLAFARPRRARCDTRGGPYSFH

SEQ ID NO: 113382 - protein, 148 aa, Glycine max
  Coding DNA Sequence Number=SeqID_21697
  Pfam annotation: Domain name=zf-CCHC; Domain location=1-18; Score =21.5; E_value=0.00084; Accession=PF00098.14; Description=Zinc knuckle
MKCFKCLGRGHITSQCPTKKTMIIRGQDIYSSQDEATTSPSSNKSEEAKREESSEEIYPQEEGQPLMVKEECKETLVRIATPLRLEFIPQVKELLDEGLVRKSLNPCALLVPKIGVPMNPKRIKVIPEWPAPPSVLRKKTQSFKNLGI

SEQ ID NO: 113383 - protein, 95 aa, Glycine max
  Coding DNA Sequence Number=SeqID_21698
  Subcellular localization annotation: CTP_CleavageSite=31; ConfidenceScore=5.03e-01
MAEPSKKCKGSLSRSQRHSEAQDTPIPSSISSSLLFSSEEQRTRYTNLFSSRSIIDPKFIDMDFFSDESFECIQAFQNLNLIPLLSLKLLVYSEL

SEQ ID NO: 113384 - protein, 129 aa, Glycine max
  Coding DNA Sequence Number=SeqID_21699
VNSKGDGGASIAHYRPSPGCCGVSPCTCLETQYFLMKARLVGGLMPLLEVTGLIEARNQSWKPQGPVGLFRVHWVSCGVVMLVRMIRTRLFAATQVKSCPGMHSSCVIASLSGCARTVGPPPISGGVAQ

SEQ ID NO: 113385 - protein, 88 aa, Glycine max
  Coding DNA Sequence Number=SeqID_21700
  Homolog annotation: Hit_ID=A5C3T2; Match level="QueryCoverage=92%, HitCoverage=8%, E-value=6e-27, Identity=70%"; Hit description =Putative uncharacterized protein
SQTVSFSDIQCDVPEHKGDNYKIWKERILLQLGWMDIDCAIRKDESHAITDKSSPDVVALYEQWERSNQLNVMFIKIEISVGICGSIN

SEQ ID NO: 113386 - protein, 84 aa, Glycine max
  Coding DNA Sequence Number=SeqID_21701
MTPIEGIRHRHKCLEHLNERNREVEILRHRNRFHELQDANENVRQGGTEHHVDHGERDWVGPAIHLAILVVLDDREAEEDPYRH

SEQ ID NO: 113387 - protein, 181 aa, Glycine max
  Coding DNA Sequence Number=SeqID_21702
MDIYHTELDEFKGELERRNFHKHLTNLADSSIDLALVKEFYANLYSLEGPSPKQVRIRGHLIRIDADSLNAFLETPVVLAEGHPGKILKKDLTTLAQVWSVLSYSNLAPTSHTSDLTVDRARLIFGLVTQLDMNVKALISGQITSMAQSNSSRLRFPILITALCRTRGVAFDSLIFACLSP

SEQ ID NO: 113388 - protein, 37 aa, Glycine max
  Coding DNA Sequence Number=SeqID_21703
DRFQGLQPPSSQCICFVLLELPSSTGFKDFTPQTLNE

SEQ ID NO: 113389 - protein, 76 aa, Glycine max
  Coding DNA Sequence Number=SeqID_21704
MKSGDMRGYRMVIRTFHQLGANEPVDAQRLTLSSAPFVIQGQRVRWQAEIPYGHPHLSSTEANEFDGIRMMLVVRF

SEQ ID NO: 113390 - protein, 126 aa, Glycine max
  Coding DNA Sequence Number=SeqID_21705
MDGTIRSEVHGISMIIDQSLFFLLTKLPSQGAPFEGTIVDDWKFDYSSHDARRMVCNDQADMTGRLLAESLTFDCCIMHYIIVRILLLCSSNLAQVSKEDLILMWAFLTGRQNDWAHFLRYRMIRH

SEQ ID NO: 113391 - protein, 125 aa, Glycine max
  Coding DNA Sequence Number=SeqID_21706
  Homolog annotation: Hit_ID=Q2HW90; Match level="QueryCoverage=72%, HitCoverage=18%, E-value=2e-10, Identity=37%"; Hit description =Putative uncharacterized protein
MGTNQTETRFYQVKIKGLDVTSLKELGRLMGPLQMQAFRKAYGKILDLTIAEIFIEAVVSLTQYYDQPLRCFTFGDFQLVPTIEEFEEILGCPLGGRKPYLFSGFLPSLSKIAVVVRDSARELDR

SEQ ID NO: 113392 - protein, 173 aa, Glycine max
  Coding DNA Sequence Number=SeqID_21707
MASMMEAMLGMRQLIEKNMVTAAAVSLAAEADPTLLATVHHPPSNAVGRGWSTLGHNSNPHLGYNRVAYPYGLPPNYTPLVMQDDAGHVSSPILEGEPPRKPDEVHEDHQEYAQGDVDFYPPIPIEGPTPNTLPQPNLTAQPIFLSREGPPPAAEERRKLDLLEERLRVVEGF

SEQ ID NO: 113393 - protein, 288 aa, Glycine max
  Coding DNA Sequence Number=SeqID_21708
  Gene Ontology: Biological process=transposition, DNA-mediated
  Homolog annotation: Hit_ID=Q6UUU1; Match level="QueryCoverage=26%, HitCoverage=51%, E-value=1e-20, Identity=70%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLATPFYEKVRFSCIWDNVPGITVHHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWEDARKILNRE

SEQ ID NO: 113394 - protein, 286 aa, Glycine max
  Coding DNA Sequence Number=SeqID_21709
  Homolog annotation: Hit_ID=UPI00016621D1; Match level="QueryCoverage =62%, HitCoverage=40%, E-value=6e-14, Identity=34%"; Hit description =UPI00016621D1 related cluster
  Subcellular localization annotation: CTP_CleavageSite=31; ConfidenceScore=5.04e-01
VDSRGSPAFRGLHVLTFRGLHVLNFRGLHVLAVKGSCTFTFVGRHVLTFRGLHVLTFVGLHALAIRGLHVLTFRGLHALAIRGLHVLTFRGLHALAIRGLHVPTFRGPHVLTFRGLHALAIRGLHVLTFRGLHALAIRGLHVLTFRGLHALAIRGQHVLTFVGLHALTFRGLHVLANIGLHALTLEDYTTARPRQQRAARPHLEGLHVLANRGLHALTLKRTTLPRHQRAARPHLLEDCTSSPIEGCMPSPFRGLRVLIFSVLYIHTLRELRGGGALKCLTETRAP

SEQ ID NO: 113395 - protein, 132 aa, Glycine max
  Coding DNA Sequence Number=SeqID_21710
  Homolog annotation: Hit_ID=UPI00006A17C9; Match level="QueryCoverage =82%, HitCoverage=24%, E-value=6e-07, Identity=28%"; Hit description =UPI00006A17C9 related cluster
  Subcellular localization annotation: CTP_CleavageSite=12; ConfidenceScore=5.21e-01
MLVRMIRTRLFAAAQVKSCPGMHSSCVIASLSGCARTVGPPPISRGGPGTVWIWSPLKVRTRSPLKARACSPLKFRTCRLSKARDCSPMMARTCNPLKVRTCSPLKVRACSPTKVKAHDPLTARTCSPLKLK

SEQ ID NO: 113396 - protein, 351 aa, Glycine max
  Coding DNA Sequence Number=SeqID_21711
  Homolog annotation: Hit_ID=A5ADW6; Match level="QueryCoverage=77%, HitCoverage=12%, E-value=1e-11, Identity=24%"; Hit description =Putative uncharacterized protein
  Pfam annotation: Domain name=Retrotrans_gag; Domain location=86-166; Score=2.6; E_value=0.03; Accession=PF03732.8; Description =Retrotransposon gag protein
HSITGESVHSVIGDFEHPDLEHYNSEHSDSEHSDFAHSENMAQPPPRERTLREMAAPDFTYESLCIQYPDEDVPYVLKTGLIHLLPKFHGLAEGVAKDWLYYLAPRSITSWDDLKRVFLEKVFPASRTTTIRRISQVLDNSVERAYAASGGALGDMTPAEARNLIEKMASNSQQFSARNDAIVIRGVHEVATNPSASSETKKLEGKLDALVNLLTQLALNQKSVPVARVCGLCSSADHHTDLCPSMQQPGAIEQPEAYAANIYNRPPQPQQQNQPQQSNYDLSSNRYNPGWRNHPNLRWSSPQQQQQQPAPSFQNAAGPSRPYIPPPIQQQQQPQKQPTVEAPPQPSLEEL

SEQ ID NO: 113397 - protein, 72 aa, Glycine max
  Coding DNA Sequence Number=SeqID_21712
MPSLISAQTDQARFSAWTEAGLTACLRLAQQAPFTALGPKLTPISYLTLCYRTIGPIAAAAACRLSLGGLSA

SEQ ID NO: 113398 - protein, 72 aa, Glycine max
  Coding DNA Sequence Number=SeqID_21713
MSRGSGDLGDVRRAPGSQQIKGTKTTKQGGLCGGWPAVNLGGQSITRLKTEDRRLRWSLVIDYQGGVIDYQA

SEQ ID NO: 113399 - protein, 92 aa, Glycine max
  Coding DNA Sequence Number=SeqID_21714
  Subcellular localization annotation: CTP_CleavageSite=28; ConfidenceScore=5.27e-01
MLSHKGGPLGTSTLTFGGLHVLPSRGLRVLAFRGLRVLAFRGLYVLAFIGLHALTFRGLHVLTFRGLHAFAFRGLRVLAFKGLHVLPFRGLH

SEQ ID NO: 113400 - protein, 25 aa, Glycine max
  Coding DNA Sequence Number=SeqID_21715
MTALCKSRRRKSRHFQKDPEGLPKA

SEQ ID NO: 113401 - protein, 109 aa, Glycine max
  Coding DNA Sequence Number=SeqID_21716
MWFGISRHYNYIKCNVEAMRNVENKANAVIIRMWVNSVHENVIGSRALESRCVTVPQLMLTCFGISRPCNKTIYKCALDSRDITITLSVMLKTCELLRTKLMWLTYACG

SEQ ID NO: 113402 - protein, 25 aa, Glycine max
  Coding DNA Sequence Number=SeqID_21717
VARFVNQISLKLLLNCVIQEIEHKQ

SEQ ID NO: 113403 - protein, 78 aa, Glycine max
  Coding DNA Sequence Number=SeqID_21718
IKNLEVQVGQLAKQLADRPSSSFGANTEKNPKEECKAVMTRSKLATMNEAIDPVVEPLSEYEEEIEVEDEQKKETTIN

SEQ ID NO: 113404 - protein, 149 aa, Glycine max
  Coding DNA Sequence Number=SeqID_21719
  Subcellular localization annotation: CTP_CleavageSite=41; ConfidenceScore=5.27e-01
MAESSKKRKGSSSTTVATAHCRHEPSKAPTAPIHPSLSSPRSSNLFSSDDQRLRYLSQFYSRIILDPKYLDIDFFNDETFDCYQVFQNSGLIDFMSLKLSYYPELVKVFYINLKILDGIISSEVHGAPFEGTIVDDWKFDYSSHDARRM

SEQ ID NO: 113405 - protein, 74 aa, Glycine max
  Coding DNA Sequence Number=SeqID_21720
MPRSPSMNDVAKRRNKTLKDMQIQNLYKILLVNLSLKIIWSFVKNKLKILKNLCFMSQYLCGRSIRERRIGIFK

SEQ ID NO: 113406 - protein, 275 aa, Glycine max
  Coding DNA Sequence Number=SeqID_21721
  Gene Ontology: Mol. function=transporter activity; Cellular component= integral to membrane; Biological process=transport
  Homolog annotation: Hit_ID=Q1H4E3; Match level="QueryCoverage=100%, HitCoverage=25%, E-value=1e-131, Identity=85%"; Hit description =Hydrophobe/amphiphile efflux-1 HAE1
MGFLSIKTLPISQFPEIAPPRVIVTLAFPGSSADVLVKSSLISIERAINGVPGMKYIVSDATSAGEATIQVIFDLGVDPNAAMVLVKTRLDQVMSKLPPLVQLEGVIVNTVQPSMLMYVNLYSKDKNADEKFLFNYVNVSVIPEIQRVHGIAQAQNLGSRQFAMRIWLNPERMRAYKVSTKEVMDAISSQSVIGRPGRLGQSSGIYAQSKEYVLVYKGRYNKPEEYGDIIIRADSNGEILHLKDLAKVELGSEFFDIYSNKDGYPSAAIVLKQNY

SEQ ID NO: 113407 - protein, 228 aa, Glycine max
  Coding DNA Sequence Number=SeqID_21722
VVVGLDKPPSKSVGEPNRLTSVATDDPLGELVKKSYVVYTKPMELAWDGAKFGLPNASNGFFITHVDVTEIILGDKCLNISVLQLWMMFMNDWSTSIGFSPVYGFLEPQSIRCTKDTREECQKYIETWVKVSHREIYLGPYFNQAHWQLLVLCPRENIIVWFYSIRRKPDVHIKFAVNNAMKEICSNLQGKDNAPPPPPQWIEAKHLLSAYIACRAMYNKDHMSVDIM

SEQ ID NO: 113408 - protein, 126 aa, Glycine max
  Coding DNA Sequence Number=SeqID_21723
  Homolog annotation: Hit_ID=A0ST23; Match level="QueryCoverage=19%, HitCoverage=51%, E-value=3e-07, Identity=100%"; Hit description =Putative reverse transcriptase
TSFGDCAPPSQLPRFKELVAQRTFEKPPCKAVFSFIKLIDTVDLEGGARYQLLFPLVRVNFELGVIMVIAVSFGKPVVPAALMNRPTRGERRFAYWALAECILAYYVGTDEGVSEVLHVAGEKRLH

SEQ ID NO: 113409 - protein, 201 aa, Glycine max
  Coding DNA Sequence Number=SeqID_21724
  Homolog annotation: Hit_ID=Q6WAY4; Match level="QueryCoverage=83%, HitCoverage=30%, E-value=2e-20, Identity=36%"; Hit description =Putative uncharacterized protein
MGTNQNRKRFYQVMIKSLDVTSLKELGRLMGPLQKQAFHKVYGKILDLTTTEVFTEAIVSLAQYYDQPLRCFTFGDFQIVSTVEEFEEILGCPLGGRKPYLSSDFLPSLSKIVVVVGDSARELDRMKQTRNGVVGIPRKYLEGKARDMANQEEWVPFADILAFLIFGVVLFPNLDGLVDLAAIDAFLAYHHSKESTVVAVL

SEQ ID NO: 113410 - protein, 232 aa, Glycine max
  Coding DNA Sequence Number=SeqID_21725
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 113411 - protein, 90 aa, Glycine max
  Coding DNA Sequence Number=SeqID_21726
IPEHKGRVVPVWFRLCKRSFTKRVENLKWVACGLDVGMGSGRTSGKAASGDGDNGSTTGDGGSAGLIVFWLWLLLLKAWAIELPLSLTKE

SEQ ID NO: 113412 - protein, 188 aa, Glycine max
  Coding DNA Sequence Number=SeqID_21727
GLHVLTFRGLHALAFRGLDVLAFKGLDVLAFRGYTPSPSEGCTPSHLEGYASSLSEGSIATPSENSSSFLLSVPGPPPDIERRPTVRAQPEREAITQLLCILGQDFTRATAKRRCRSPPAEVSVGLCRPDIGVLPTRRPADPEKSNKALGFLALVTGIVPTRHPVDPEEPNKALGFPTLVTGLCQSYR

SEQ ID NO: 113413 - protein, 116 aa, Glycine max
  Coding DNA Sequence Number=SeqID_21728
  Homolog annotation: Hit_ID=A6FJQ2; Match level="QueryCoverage=32%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGTPGFPSHDVVNDGQCQACMPAVDSRGSPILLSNLI

SEQ ID NO: 113414 - protein, 170 aa, Glycine max
  Coding DNA Sequence Number=SeqID_21729
VACAEDDANLHVSTGLLAAIDKGLRDSKRKFARYRRVSLHATGLLGHGNKGGVVDKSKAFAPTRGLEGRATIIAISAEAMLTTSKDWKAVSNDSSAASTYGIEDGQLTKMERLPPSGSTGVPKAAVSRVNIHHLERNLTGMRPYLYREVDLSPHLSVAAVESMDYHGTWL

SEQ ID NO: 113415 - protein, 156 aa, Glycine max
  Coding DNA Sequence Number=SeqID_21730
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=10; ConfidenceScore=5.26e-01
MKHFTDTLISANIVSPVYTPLAPNTQTASPRALADSLMQLARQVSRLESGHPGDPLVLERPPPRWSSNSPYSESYYNSLAVVLQRRDWENPGVTQLNRLAAHPPFASWRNSEEARTDRPSQQLRSLNGEWDAPCSGALSAAGVGGYAQRDRYTCQR

SEQ ID NO: 113416 - protein, 72 aa, Glycine max
  Coding DNA Sequence Number=SeqID_21731
MPGLGRDWSSLVWEIAPHLTSPRSPDPCDISPGLWGTCHMWVLGGDRTMVQVDSPHPQITHKSIIPRCPPFN

SEQ ID NO: 113417 - protein, 79 aa, Glycine max
  Coding DNA Sequence Number=SeqID_21732
NHGTPTSKGKTEVRVSAPAEKALSPYSNKLGCWIRDPRSRLDQHPAERGQPLEATSEKWLDEPFRSPRTGPIHLLIVEA

SEQ ID NO: 113418 - protein, 143 aa, Glycine max
  Coding DNA Sequence Number=SeqID_21733
MVKEKCKEVSVSSKRLAKMESHFEIKTNVKETSPLRQPPHLLLCKKTLVSTVTPLGLKIIPQVKELLDEGLVRKSLIPCALLVSKVGVKGRSLEYEEPRDLRSNPFQGGGDDAILPPRVLDRRLQEDWSRVTKEGPRILMNLR

SEQ ID NO: 113419 - protein, 80 aa, Glycine max
  Coding DNA Sequence Number=SeqID_21734
MKGHFWHSFQIREKASIRVPVEPNFDLSRLIPCGVTLTYLPSLEVASLFVNNPVSNVLPRSCTYIIRQKRGSRVATTSNY

SEQ ID NO: 113420 - protein, 91 aa, Glycine max
  Coding DNA Sequence Number=SeqID_21735
MKLCFYTQQNTHYPKEKLPKIITQKWKFGNLLEAPNTLPMKGLFVIKLESNEALKVVGPFLLDSNSSRDGTNPPSNSLYDNPQTRKQRDKQ

SEQ ID NO: 113421 - protein, 159 aa, Glycine max
  Coding DNA Sequence Number=SeqID_21736
MTSRDKIWSFCTLVSSRGGGPDDTRRYLTVIRTLVSSRGGGPDDTRKYLTVIRTLLSSRGGGPDDTRRYLTVIRTLVSSRGGGPDDTRRYLTVIRTPWCHPEAAGPMTRRDTFAAPRPTWALQNIPPEGCCFWRKQPGSPGRAELAWASWAATTSPILL

SEQ ID NO: 113422 - protein, 38 aa, Glycine max
  Coding DNA Sequence Number=SeqID_21737
MSFPAFRVSSPGRAPPARNGLKREGGCNFSPKELLPFT

SEQ ID NO: 113423 - protein, 105 aa, Glycine max
  Coding DNA Sequence Number=SeqID_21738
MIRGDTLRLSAPFCHPEAAGPMTSRDQIWSFCTLVSSRGGGPDDSRKYPSGYPYKHSFAISPRPTWALQNIPPEGCCFWRKQPGSPGRAELAWASWAATTSPILL

SEQ ID NO: 113424 - protein, 39 aa, Glycine max
  Coding DNA Sequence Number=SeqID_21739
MWKFSSFFVVLHCLHPFFVRSSFFNGFLFFPFDVLKPFI

SEQ ID NO: 113425 - protein, 54 aa, Glycine max
  Coding DNA Sequence Number=SeqID_21740
MAESPQEQVQRMTQVSDLWRYPPLEPCVGGITGAEEGTGAMEEEGVGVSVVLKW

SEQ ID NO: 113426 - protein, 55 aa, Glycine max
  Coding DNA Sequence Number=SeqID_21741
ETSLSTAIPLKLEVIPQVKELLDEGLVLDIRETIPKIVPKDSNINASMSWERSHF

SEQ ID NO: 113427 - protein, 163 aa, Glycine max
  Coding DNA Sequence Number=SeqID_21742
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=49%, HitCoverage=73%, E-value=2e-38, Identity=97%"; Hit description =Chromosome undetermined scaffold_79, whole genome shotgun sequence
  Pfam annotation: Domain name=ATP-synt_ab_N; Domain location=84-150; Score=59.3; E_value=1.3e-14; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-152; Score=36.7; E_value=8.1e-08; Accession=PF09378.1; Description=HAS barrel domain
  Pfam module annotation: Pfam domain module=ATP-synt_ab_N::Complex1 _49kDa::HAS-barrel; Domain location=84-150::1-87::84-152
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASGVKGIALNLENENVGIVVFGSDTAIKKEILSNELDLLWMFLRERLC

SEQ ID NO: 113428 - protein, 63 aa, Glycine max
  Coding DNA Sequence Number=SeqID_21743
MDPRKGLDVLIPIPDSMSPDWVIARLLPSLDVVAVSQAPSPESNPNSPSPVTTMVGHYPTIES

SEQ ID NO: 113429 - protein, 175 aa, Glycine max
  Coding DNA Sequence Number=SeqID_21744
MASRKRKSIGARPTAQYDTRRFHSLDAWNRYTDNVLGRSSLPERKVEIYHTVFDDFKTELERRNLHKRLTNLADGTIDVALVKEFYANLYNSEDPSPKQARVRGHLVKINVDSLNIFLETPVVLEEGETLPTYSRYCRPSREDSQEGSDYLGPGVECSFLLQPSPYISYIRPYCR

SEQ ID NO: 113430 - protein, 95 aa, Glycine max
  Coding DNA Sequence Number=SeqID_21745
MEYTPETGTGAMGPTTGGAGICTEGATTRIASAKLRRKTMVSSWNWNRSQREAEFDVEIKDSSGVENMVVNHLSKIEGPVDPLPIRDNFLDEHLM

SEQ ID NO: 113431 - protein, 113 aa, Glycine max
  Coding DNA Sequence Number=SeqID_21746
  Subcellular localization annotation: CTP_CleavageSite=35; ConfidenceScore=5.37e-01
MSPPPLEPHNHSQTHLKLSGWLPLQARFFVGGFVRACALSATLDRLTLISGFRLSACFSRLVDGLKQCASLDDPSLSEHAQLILLPDSYSRSAEGVVRSADALLSQQIGLARD

SEQ ID NO: 113432 - protein, 87 aa, Glycine max
  Coding DNA Sequence Number=SeqID_21747
MNVLSGATIFGKITHAPNIFTICVHRDSLGSDQGLPMDLKRIKVIPEWPTPPSVEERIHEFHEPLDLRSNPFQGGWNDAILPPKGIR

SEQ ID NO: 113433 - protein, 96 aa, Glycine max
  Coding DNA Sequence Number=SeqID_21748
  Subcellular localization annotation: CTP_CleavageSite=66; ConfidenceScore=5.51e-01
MLVRMIRTRLFAAARVKSCPGMHSSCVIASLSGCARTVGRPPISGGGPGTMSSTLKMRTRSPLKVRACSPLKVRRCSPLEVRACSPLLARTCSPFK

SEQ ID NO: 113434 - protein, 183 aa, Glycine max
  Coding DNA Sequence Number=SeqID_21749
  Gene Ontology: Biological process=transposition, DNA-mediated
  Homolog annotation: Hit_ID=Q1J7G7; Match level="QueryCoverage=20%, HitCoverage=67%, E-value=3e-10, Identity=70%"; Hit description =Transposase
GMMVVFEGGSRWLLFLSAVPPVQLLTGWCVTAKAPPDISAGKCSGRVPFAIQAAQLLGRAIGAGLFAITPAGERGMCCKAIKLGANTEIYFLGLWKKSSLVIGPEECRSHHQAYRYRRPRGGARYQLLFPLVRVNFELGVIMSGKPVVPAALMNRPTRGERRFAYLAASGVYSGLSMLALEEG

SEQ ID NO: 113435 - protein, 261 aa, Glycine max
  Coding DNA Sequence Number=SeqID_21750
  Homolog annotation: Hit_ID=A8G9I0; Match level="QueryCoverage=83%, HitCoverage=51%, E-value=4e-47, Identity=46%"; Hit description=HipA domain protein
  Pfam annotation: Domain name=HipA_C; Domain location=104-183; Score =32.6; E_value=2.1e-07; Accession=PF07804.3; Description=HipA-like C -terminal domain
  Pfam annotation: Domain name=HipA_N; Domain location=29-98; Score =55.2; E_value=2.2e-13; Accession=PF07805.3; Description=HipA-like N -terminal domain
  Pfam module annotation: Pfam domain module=HipA_C::HipA_N; Domain location=104-183::29-98
MPEPTPVERETVYPELARAAGAGEVPGSSAGGEQPKFCTYTERGHVLVKFTAADDNPVSERWRDLLMAEHLALKVLGVETDVFDIKGQRFLEIPRFDRVGKMGRIGVFSLRALDAEFVGNASASWPVLVNQLVAEKCVQPEAASSTARLWAFGMLIGNTDMHAGNLSFISRHGRPYHLAPAYDILPMGFAPRAGGAIVNTLRPASLPEVVSSDIWREALVLAEEFLSLANSCDGFSDRFAPCLAALQQHLDEARARIARLG

SEQ ID NO: 113436 - protein, 77 aa, Glycine max
  Coding DNA Sequence Number=SeqID_21751
MNPQDFTKEKSQGPIHDKKLLKERLQNRDQQLKSKWSGPFVIKKVRSYGAIELYDPQSQNPDRPIGSKWSEVPTVSW

SEQ ID NO: 113437 - protein, 185 aa, Glycine max
  Coding DNA Sequence Number=SeqID_21752
  Homolog annotation: Hit_ID=A6H5B3; Match level="QueryCoverage=36%, HitCoverage=84%, E-value=1e-27, Identity=88%"; Hit description =Putative ribosomal protein S3
ARFKRRKAYGGYLGTQRREGRSKRRNASGVENKRRSGDSRYRGKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 113438 - protein, 118 aa, Glycine max
  Coding DNA Sequence Number=SeqID_21753
  Homolog annotation: Hit_ID=A6FJQ2; Match level="QueryCoverage=32%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLAFEELQKLTDCVTILPFDFDHVTEFHGSRNNLLISGTCRDFTYCATKGAKYLEAVNQRLHAIKQYFPDEIRV

SEQ ID NO: 113439 - protein, 178 aa, Glycine max
  Coding DNA Sequence Number=SeqID_21754
MAPRKLASKRSRKDKAAEGTSSAPEYDSHRFRSAVHQQRFEAIKGWSFFRERRVQLRDDEYTDFQEEIGRRRWTSLVTPMAKFDPEIVLEFYANAWPTEEGVRDMRSWVRGQWIPFDADAIGQLLGYPLVLKEDQECEYGQRRNRSDGEASANHAHQYDHPDPDMDDVAPQQHHAQRS

SEQ ID NO: 113440 - protein, 127 aa, Glycine max
  Coding DNA Sequence Number=SeqID_21755
VPLICFHVVEWYQPDRVLRQFRMQQPIPESPSQPQNIHGLTLKGKQVDEQERITEPVAHGPASERRFLSQQFHMLQSSVKTRCFDRRREIVQAEDFSQQMEQRGHGMYYTLPTFSQYPSQMYQYPFE

SEQ ID NO: 113441 - protein, 165 aa, Glycine max
  Coding DNA Sequence Number=SeqID_21756
MHTRARFQPASARRRVWIMRTNIWMMLLPSNLLQSDHNSDLPLPKWIAPTGHSVGPEKSNRVLGFSALITSLHQFYGVPVAPSRFIRPLLIGLSSRSIAPPSRHRARHHSRGQQTHRHHLQSSPQLTHKKAGALPTTHGQPVGTQPPEQVRAGTGPVINKSPSCV

SEQ ID NO: 113442 - protein, 73 aa, Glycine max
  Coding DNA Sequence Number=SeqID_21757
MREGSFGWRETPPPLVFMFPGAGVFAQASNPPPPPLGILGCLPTALLACPELGMGRRSIDHGPSLYSHPSLST

SEQ ID NO: 113443 - protein, 62 aa, Glycine max
  Coding DNA Sequence Number=SeqID_21758
MASYGEAKESIDDEDPRPTSSNGAYISNFSALSAIEESGRASISRSRAKHEISVLSTTIIFS

SEQ ID NO: 113444 - protein, 172 aa, Glycine max
  Coding DNA Sequence Number=SeqID_21759
MADEHQQRVTLEDYSSNSVMQFFTSIARLEGKLFQGLPNEDPYAHSVTFIEICNTVKIVGMPDEAISHFIFIFLSSRSHEFLDESLSEALERFRGLLRKTPTHGLQVVPSVVRLMKHVNVFPSKKTLKKFTIWEINRDKDILEEDSQASSRALITNKDSGDHTLAINSTRTR

SEQ ID NO: 113445 - protein, 71 aa, Glycine max
  Coding DNA Sequence Number=SeqID_21760
MWVQAIGLFAQATCAPEFGLPRPFNQRLLVLRIGGAAVKQQINDAHRDNPSLVFKNPLQQETHGLLIPFQK

SEQ ID NO: 113446 - protein, 228 aa, Glycine max
  Coding DNA Sequence Number=SeqID_21761
  Gene Ontology: Mol. function=motor activity; Cellular component=cell projection
  Homolog annotation: Hit_ID=UPI00016621D1; Match level="QueryCoverage =92%, HitCoverage=40%, E-value=5e-21, Identity=36%"; Hit description =UPI00016621D1 related cluster
YPHLVGLHALAIRGLHVLTFKGLHALAIRGLHVLTFVGLHALTFRGPHVLTFRGPHVLTFRGLHALAIRGLHVLTFVGLHALTIGGLHVLTFRGLHALAIRGLHVLTFIGLHALTFRGPHVLTFRGPHVLTFRGLHALAIRGLHVLTFVGLHALTIRGLHVLTFRGLHALAIRGLHVLTFVGLHALTFRGPHVLTLRGLHALAIRGLHVLTFRGLHALTIKDCMSSPS

SEQ ID NO: 113447 - protein, 270 aa, Glycine max
  Coding DNA Sequence Number=SeqID_21762
  Homolog annotation: Hit_ID=Q6WAY6; Match level="QueryCoverage=76%, HitCoverage=41%, E-value=4e-25, Identity=33%"; Hit description =Putative uncharacterized protein
HRKQVENGVVGIPRKYLEAKARISAGKGEWALFIDILALLIFGGVLFPNVDGLVDLAAIDAFLAYHNHKESPVVAMLADLYDTFDRRCEACLPARKPPLMHRERRGNWDQLLASKEGASVNWFPRWKEGRTGVLSCGGFLNVPLMGTRGCISYNPVLAIRQLGYPMRGAPLEYELVPVCKAWEVLQKKDKELRGSNNGTIGGYRKWLKAHVQGLDWLPSLRTTKREEVEAPEEDKEVQALRVEVEQAQTVKERFKSAALKIRKENTELRD

SEQ ID NO: 113448 - protein, 120 aa, Glycine max
  Coding DNA Sequence Number=SeqID_21763
SFDEDDSDDGISDIDDEVTNIVEPVSIVHPTEGVPEIQNPLWNDAMHYNNINWSHPDEEDICGLDMPTTFNVGQELYVGVNFDSKEAVKNALKQYVMKVKWWLDRNIEMAITEATGLQMR

SEQ ID NO: 113449 - protein, 103 aa, Glycine max
  Coding DNA Sequence Number=SeqID_21764
MEADMSIEQDQDANIVDQVNSWVNNKLRKSLWMIDWTSNNRHQSTAGGTVVHVLNVLASDVMLERKLVQNSRFGAKKVIKEFARIYWYSITANIVLQRSYMGR

SEQ ID NO: 113450 - protein, 385 aa, Glycine max
  Coding DNA Sequence Number=SeqID_21765
  Gene Ontology: Mol. function=nucleic acid binding; Cellular component= cytoplasm; Biological process=regulation of transcription
  Homolog annotation: Hit_ID=A7NSL8; Match level="QueryCoverage=100%, HitCoverage=100%, E-value=1e-134, Identity=64%"; Hit description =Chromosome chr18 scaffold_1, whole genome shotgun sequence
  Pfam annotation: Domain name=SBDS; Domain location=15-105; Score =170.5; E_value=4.4e-48; Accession=PF01172.9; Description=Shwachman -Bodian-Diamond syndrome (SBDS) pro
  Pfam annotation: Domain name=SBDS_C; Domain location=108-257; Score =130.6; E_value=4.5e-36; Accession=PF09377.1; Description=SBDS protein C-terminal domain
  Pfam module annotation: Pfam domain module=SBDS::SBDS_C; Domain location=15-105::108-257
MSRTLVQPIGQKRLTNVAVVRLKKHGMRFEIACYPNTVLSWRSGVEKDPDEVLQSHTVYTNVSKGVLAKSKDLISAFGTDDHSKICLDILKKGELQVAGKERESLLSSQFRDIATIVMHKTYNPETQRPYTISMIERLMREIHFAVDPHSTSKKQALELIQELQKHFPIKRCPLRIRATAPDDQVPELLGKLNEWNATVISKEGSSAVSCHTMSKVKQRMTMVGSFKEVLSMSSVGVWIFELEPGLYKDCHDFVMNKMHGRFEVLAHSLYVEGDTQVEQYNDYEDIPEALPKETYDSVLKLNEKLQKQTISSTSRPTEGQQKQNKCSTCNVSFDDTKLYREHHKSEWHKHNIKRKTRQLPPLTEEECMADMELGDSKSDLKDYSF

SEQ ID NO: 113451 - protein, 479 aa, Glycine max
  Coding DNA Sequence Number=SeqID_21766
  Homolog annotation: Hit_ID=A5AZB6; Match level="QueryCoverage=87%, HitCoverage=42%, E-value=1e-118, Identity=54%"; Hit description =Putative uncharacterized protein
  Pfam annotation: Domain name=DUF966; Domain location=45-414; Score =544.7; E_value=1e-160; Accession=PF06136.4; Description=Domain of unknown function (DUF966)
MSVSSSSRGRITTELQVPKKWTDRETSPERTKVWAEPKTKTAKKVSVVYYLSRNGQLEHPHFMEVPLSSPHGLYLKDVINRLNALRGKAMATLYSWSAKRGYKNGFVWHDLSENDFIHPTQGQDYILKGSEIVEHGVAAVAARVNKSEEESNSPVAITRRRNQSWSSIDMNEYRVYKSESFGGSAERIGADAATQTEEKLRRRRAAREEEVVEIQEKNDRRIEAGMEGERVPHVTCDDNDSNNHTTELSRDEISPPPSDSSPETLETLMNADGRLGLRSSESQKDNLTVESCPSGRMRASSVLLQLLSCGAVSFKECGANAVKDRGFSLVGHYKSRMPRGAGNHSGKETGTSMEIPDLSRVRLEDKEYFSGSLIETKKVETPALKRSSSYNADSGSRLQIVEHEEDVVRAKCIPRKSKTLPTKKEEGASMHILMPDSGGEEDKKLRDVRLEREVWKNGQYSDLELCNLQVTAWWAYTSR

SEQ ID NO: 113452 - protein, 317 aa, Glycine max
  Coding DNA Sequence Number=SeqID_21767
  Gene Ontology: Mol. function=UDP-glucuronate decarboxylase activity; Cellular component=Golgi apparatus; Biological process=cellular metabolic process
  Homolog annotation: Hit_ID=Q9AV98; Match level="QueryCoverage=90%, HitCoverage=83%, E-value=1e-156, Identity=94%"; Hit description=UDP -D-glucuronate carboxy-lyase
  Pfam annotation: Domain name=Epimerase; Domain location=19-242; Score= 128.9; E_value=1.4e-35; Accession=PF01370.12; Description=NAD dependent epimerasedehydratase family
  Pfam annotation: Domain name=NAD_binding_4; Domain location=19-227; Score=-81.3; E_value=0.0016; Accession=PF07993.3; Description=Male sterility protein
  Pfam annotation: Domain name=Polysacc_synt_2; Domain location=21-288; Score=-178.3; E_value=0.0084; Accession=PF02719.6; Description =Polysaccharide biosynthesis protein
  Pfam annotation: Domain name=RmlD_sub_bind; Domain location=54-311; Score=-187.0; E_value=0.074; Accession=PF04321.8; Description=RmlD substrate binding domain
  Pfam module annotation: Pfam domain module=Epimerase::NAD_binding _4::Polysacc_synt_2::RmlD_sub_bind; Domain location=19-242::19 -227::21-288::54-311
MTNRPELYPGREGSDNRKKAILLCLQNITSNQVIVADNYFTGSKDNLKKWIGHPRFELIRHDVTEPLTIEVDQIYHLACPASPIFYKYNPVKTIKTNVIGTLNMLGLAKRVGARILLTSTSEVYGDPLVHPQPEGYWGNVNPIGVRSCYDEGKRVAETLMFDYHRQHGIEIRVARIFNTYGPRMNIDDGRVVSNFIAQAIRGEPLTVQSPGTQTRSFCYVSDLVDGLIRLMEGSDTGPINLGNPGEFTMLELAETVKELINPDVEIKVVENTPDDPRQRKPIITKAMELLGWEPKVKLRDGLPLMEEDFRLRLDKNN

SEQ ID NO: 113453 - protein, 192 aa, Glycine max
  Coding DNA Sequence Number=SeqID_21768
  Homolog annotation: Hit_ID=A7NZ41; Match level="QueryCoverage=64%, HitCoverage=25%, E-value=2e-38, Identity=61%"; Hit description =Chromosome chr6 scaffold_3, whole genome shotgun sequence
MPSVYMGDRMDNSNSSLSSNSKESSVVVNGKETYKKLLVASRPKGFAQRNYEHLVSLTHGDFGSSAVGRVTFFLLKLAALETVRRFSRSKCPCVWRGLQGLQILVYPPFKWIQRWAPFRGLVKSMQVLSRPLLVLSIATVFTDQPQCSDGTSDCVASHDSEASAELSPAEANLNTRIKNLTEPACSIYHMEN

SEQ ID NO: 113454 - protein, 589 aa, Glycine max
  Coding DNA Sequence Number=SeqID_21769
  Gene Ontology: Mol. function=RNA-directed DNA polymerase activity; Cellular component=exocyst; Biological process=exocytosis
  Homolog annotation: Hit_ID=A7NZ80; Match level="QueryCoverage=98%, HitCoverage=96%, E-value=0.0, Identity=58%"; Hit description =Chromosome chr6 scaffold_3, whole genome shotgun sequence
  Pfam annotation: Domain name=Exo70; Domain location=25-585; Score =665.0; E_value=6.2e-197; Accession=PF03081.6; Description=Exo70 exocyst complex subunit
MPRKGMRSIFFTSTPTASLPPPSRQRTFSDSLMDENIETAEKLITKWDDSKVTTTTQLFSGTRQEAKQYLNAVKGLQSAMQYLVAQDSTSSTLVRAQFLMQLAMKTLQKEFYQILSSNREHLDPETVSTRSSVDHRSSVSDYDDEISITEDEFRVSETERVSMLAMEDLKAIAECMISSGYGKECVKVYIVMRKSIVDEALYHLGVEKLNLSQVQKLDWEVLELKIKSWLKAVKVAVGTLFNGERILCDHVFAADSGKRIAESCFAEITKDGAVSLLGFPEMVAKCKKSPEKMFRILDLYEAISDYWPQIEFIFSFESTVNIRTQTVTSMVKLGDAVRTMLTDFETAIQKESSKKPVPGGGVHPLTRYVMNYLTFLADYSGVLVDIIADLPQSPLPESYYRSPMREENPPASELSERIAWIILVVLCKLDGKAELYKDVAHSYLFLANNMQYVVVKVRKSNLGFLLGEEWLAKHELKVREYTSKYESVGWSAVFSSLPENPAAELTAEQARACFVRFDAAFHEACKKQASWVVSDPKFRDEIKDSIASKLMQKYSVFFEKNRVGSKSVRDFLPDDIGKYLSNILCDGDS

SEQ ID NO: 113455 - protein, 151 aa, Glycine max
  Coding DNA Sequence Number=SeqID_21770
MKAKLNYIIYSIKDAQANKLCPVDNSRCSQDIVQEQGIMIETRILQILTSREFSLFKRNEAVIYGQPNTTKIFLNGPNEKSHNLPLALAVDVGFSLDDETSSRRCHVVYDVREKTQREHSYLFMVVQKMKTETGLLDEQPPSNTQLEDIGR

SEQ ID NO: 113456 - protein, 64 aa, Glycine max
  Coding DNA Sequence Number=SeqID_21771
  Subcellular localization annotation: CTP_CleavageSite=32; ConfidenceScore=5.32e-01
KRKSAQYANRLSPRVGRFINAAGTTGFPTGKRAVSATQLIVSSDPRTTLPLALALCIKLKECLA

SEQ ID NO: 113457 - protein, 261 aa, Glycine max
  Coding DNA Sequence Number=SeqID_21772
  Gene Ontology: Mol. function=sequence-specific DNA binding; Cellular component=nucleus; Biological process=regulation of transcription, DNA-dependent
  Homolog annotation: Hit_ID=A7NZ34; Match level="QueryCoverage=68%, HitCoverage=75%, E-value=3e-55, Identity=61%"; Hit description =Chromosome chr6 scaffold_3, whole genome shotgun sequence
  Pfam annotation: Domain name=Homeobox; Domain location=28-89; Score =58.8; E_value=1.9e-14; Accession=PF00046.20; Description=Homeobox domain
MESGNNTNHELEMEMESGGSNGNEGVAASSRWNPTKEQISMLENLYKQGIKTPSAEEIQQITARLRAYGHIEGKNVFYWFQNHKARQRQKQKQETFAYFNRFLHTPQPFFSPPICPNAMCAPYYIPQGQGEIGFYPPHQKVFVPVGFRRSPSEKVVPTGMISSNGPLVYEGMHQMQQRISDCSNSHFSHQETLDLFPLHPTGILEGKTTTTTDQVSSLASVVSADSSTDTTSADDINEDDHASPLNQPFFNFFTTSGQGSY

SEQ ID NO: 113458 - protein, 27 aa, Glycine max
  Coding DNA Sequence Number=SeqID_21773
MTSLEDLGKSATGAVGSSGGVEDIKVD

SEQ ID NO: 113459 - protein, 138 aa, Glycine max
  Coding DNA Sequence Number=SeqID_21774
GVFYSNFVGIDIHPPKAQWIKQVSWHLPRVGIVKCNMDESAKGSLGHAAAGVVIIALEVAKCRGWNNLWIECESSLIIQAFGNPLLVPWRLHDKLAKLDTSTHDSTLGGTLSLAFLGQKFLRNIIYLPSYRRIWVFGV

SEQ ID NO: 113460 - protein, 450 aa, Glycine max
  Coding DNA Sequence Number=SeqID_21775
  Gene Ontology: Mol. function=phospholipid binding; Cellular component= intracellular; Biological process=steroid metabolic process
  Homolog annotation: Hit_ID=Q93Y40; Match level="QueryCoverage=100%, HitCoverage=100%, E-value=0.0, Identity=81%"; Hit description =Oxysterol-binding protein
  Pfam annotation: Domain name=Oxysterol_BP; Domain location=29-422; Score=152.2; E_value=1.4e-42; Accession=PF01237.9; Description =Oxysterol-binding protein
  Subcellular localization annotation: CTP_CleavageSite=17; ConfidenceScore=5.12e-01
MGSPSKKNESKGFFAAVSSMFTSAVNRSVNGLSVEVINPEGGKEDSEEEAQRGRWKQEERDGYWKMMQKYIGSDVTSMVTLPVIIFEPMTMIQKIAELMEYSYLLDQADESEDPYMQLVYATSWAISVYFAYQRTWKPFNPILGETYEMVNHGGITFLAEQVSHHPPMSAAHAENEHFTYDVTSKLKTKFLGNSVDVYPVGRTRVTLKRDGVVLDLVPPPTKVNNLIFGRTWIDSPGEMIMTNLTTGDKAVLYFQPCGWFGAGRYEVDGYIYNSSEEPKILMTGKWNESMSYQPCDSEGEPLPNTELKEVWHVADVPQNDKFQYTHFAHKINSFDTAPKKLLASDSRLRPDRYALEMGDLSKSGAEKSSLEERQRAEKRSREEKGHSFTPRWFDLTEEVTPTPWGDLEIYQYNGKYTEHRAAADNSGSIDDVDVKSIEFNPWQYGNLVTE

SEQ ID NO: 113461 - protein, 631 aa, Glycine max
  Coding DNA Sequence Number=SeqID_21776
  Gene Ontology: Mol. function=protein binding; Cellular component =nucleus; Biological process=regulation of transcription
  Homolog annotation: Hit_ID=A3E2G3; Match level="QueryCoverage=99%, HitCoverage=89%, E-value=1e-177, Identity=50%"; Hit description =SCARECROW-like protein 1
  Pfam annotation: Domain name=GRAS; Domain location=229-538; Score =431.0; E_value=1.7e-126; Accession=PF03514.5; Description=GRAS family transcription factor
MEDNDFSETAKFISQILMEENVELEQSPFYDSLTLQVTEKSFYDALAGNLLLSPQASNTNFSVENSRELNLPSPDSLSVSALQFNPHALSQPPPLVNVSEGVSDLDSSIARLLAHNIFNDVDSVSHFRRGFEEASRFLPPGPNLVTALHSNAQEPINSFRENSYGLLKGRKNLERQEINTREEERGGRSNKQSAFSFVDESDLSDAIDRVFLSVENVCSEHSSLQSGPLRAEEQDRGKGLSKKQERRKQETVDLRNLLLMCSQSVYANDNRTANELLKQIRQHSSPVGDASQRLAHYFANGLEARLVGDGTSSQGMYTFLSSKNITAAEFLKTHQDFMSASPFKKFTYFFANKMIMKAAAKVETVHIIDFGILYGFQWPILIKFLSNREGGPPKLRITGIEFPQPGFRPTEKIDETGRRLANYCKRYSVPFEYNAIASKNWETIRIEALKIESNELVAVNCHQRFENLLDDSIEVNSPRNAVLHLIRKINPNIFTQSITNGSYNAPFFAPRFREALFHYSAIYDLIDTIIHRENERRLMIERELLGREIMNVIACEGSERIERPETYKQWQVRNMKAGFKQLPLDEELMAKFRTELRKWYHRDFVSDEDSNWMLLGWKGRILFASTCWVPA

SEQ ID NO: 113462 - protein, 128 aa, Glycine max
  Coding DNA Sequence Number=SeqID_21777
MELIETIAASDHAILHGRAYTPTKKSLIELISQDAMLAQNKLLAIRDPHINSEAHKFGMCMAQDDKSKEVNYMKLAETSTGSVLTNTKKNPKKECKVIFTRRESAENRKRIEEGGQTQDSMVAGAKIK

SEQ ID NO: 113463 - protein, 78 aa, Glycine max
  Coding DNA Sequence Number=SeqID_21778
  Gene Ontology: Cellular component=signalosome; Biological process=red or far red light signaling pathway
  Homolog annotation: Hit_ID=A2WNH0; Match level="QueryCoverage=65%, HitCoverage=9%, E-value=4e-12, Identity=62%"; Hit description =Putative uncharacterized protein
MEDYGFEYSLEEQEEQYFDIENQHYNSRGARLWFKTNVKVCKIFFDIGEYGRMSKELLNSCQRKDGTDEQELGGQHLL

SEQ ID NO: 113464 - protein, 173 aa, Glycine max
  Coding DNA Sequence Number=SeqID_21779
  Gene Ontology: Mol. function=nucleic acid binding; Cellular component= intracellular; Biological process=regulation of transcription
  Homolog annotation: Hit_ID=Q93XJ4; Match level="QueryCoverage=32%, HitCoverage=30%, E-value=2e-12, Identity=59%"; Hit description =Lateral shoot inducing factor
  Pfam annotation: Domain name=zf-C2H2; Domain location=34-56; Score =21.9; E_value=0.0024; Accession=PF00096.17; Description=Zinc finger, C2H2 type
MESDLHHDHQAAASENHPSDGEEQGASHVTSRSFECNFCRRGFSNAQALGGHMNIHRKDKAKLKQQQSSNQIQQDQAKSYGEDSNKQKWNWNVSLQEHAIHKRQQLPLFAESPTSSETQKPQQGQTQTTTEQASLSTQDSSSELDLELRLGPEPQDSSAAETDVHEPRAPFYW

SEQ ID NO: 113465 - protein, 499 aa, Glycine max
  Coding DNA Sequence Number=SeqID_21780
  Gene Ontology: Mol. function=tRNA (5-methylaminomethyl-2 -thiouridylate)-methyltransferase activity; Cellular component =cytoplasm; Biological process=tRNA processing
  Homolog annotation: Hit_ID=A7NZR6; Match level="QueryCoverage=96%, HitCoverage=91%, E-value=0.0, Identity=69%"; Hit description =Chromosome chr6 scaffold_3, whole genome shotgun sequence
  Pfam annotation: Domain name=tRNA_Me_trans; Domain location=62-434; Score=577.4; E_value=1.4e-170; Accession=PF03054.7; Description=tRNA methyl transferase
  Subcellular localization annotation: CTP_CleavageSite=33; ConfidenceScore=5.65e-01
MASLPLTPFTCQNLHTLNPRPRCRTFKLFCRPSSSAVAHTSPPLSGDLDRYLRCSMPQNSPLRVAVLVSGGVDSSVALRLLHAAGHSCTAFYLKIWFQEDFENFWSECPWEDDLKYAKDVCNQVDVPLEVVHLTDEYWNNVVSYLIEEYSSGRTPNPDVLCNTRIKFGAFLDAIGGMGFDYVASGHYANVIHPCSDRRDEPSVLELSQDMVKDQTYFLSHLSQSQLKQLLFPLGCIPKSIMMSIARIQADEVRKLATKFDLPNKDRKDSQGICFLGKIRFSEFVARHIGEREGVILEAETGDFLGKHRGFWFYTIGQRQGLRLPGGPWYVVEKDVKNNVVFVSRNYFSFDKRRRVFRVGSFKWLSGLPPGQTTQLQCKVRHGPGFYDCSLQMEVEADGQCHSAVVRISEDDQGLAAGQFAAFYEGRTCIGSGVILEFWDDQSFPVCTKALEIARMEDKSKIGNPVKIKVKPDNPQEVCDSAELASKTSQGNKKLKSCWH

SEQ ID NO: 113466 - protein, 436 aa, Glycine max
  Coding DNA Sequence Number=SeqID_21781
  Gene Ontology: Mol. function=nucleic acid binding; Cellular component= cytosol; Biological process=regulation of mRNA stability
  Homolog annotation: Hit_ID=A7NZS1; Match level="QueryCoverage=94%, HitCoverage=85%, E-value=1e-118, Identity=56%"; Hit description =Chromosome chr6 scaffold_3, whole genome shotgun sequence
  Pfam annotation: Domain name=RRM_1; Domain location=118-190; Score =75.8; E_value=1.4e-19; Accession=PF00076.13; Description=RNA recognition motif. (a.k.a. RRM, RB
  Pfam annotation: Domain name=RRM_1; Domain location=235-300; Score =69.5; E_value=1.1e-17; Accession=PF00076.13; Description=RNA recognition motif. (a.k.a. RRM, RB
  Pfam annotation: Domain name=RRM_1; Domain location=31-102; Score =62.5; E_value=1.4e-15; Accession=PF00076.13; Description=RNA recognition motif. (a.k.a. RRM, RB
  Pfam module annotation: Pfam domain module=RRM_1::RRM_1::RRM_1; Domain location=118-190::235-300::31-102
DKESAGSKKGNIESNNPTEMVATAIEEVRTLWIGDLQYWVDESYLSQCFAHNGEVVSIKIIRNKLTGQPEGYGFVEFVSHASAEAFLRTYNGAQMPGTEQTFRLNWASFGDSGPDHSIFVGDLAPDVTDFLLQETFRAHYPSVKGAKVVTDPATGRSKGYGFVKFADEAQRNRAMTEMNGVYCSTRPMRISAATPKKNASFQHQYAPPKAMYQFPAYSAPVSAVAPENDVNNTTVCIGNLDLNVTEEELKQTFMQFGDIVLVKIYAGKGYGYVQFGTRVSAEDAIQRMQGKVIGQQVIQISWGSSMTARQGKAAYNIPPPYLRIAKSLWAMGLVHLMGLENVGKKELGSGPVGGHEVVMICGDQMDPSQWSAYYGYGQGYEAYAYGATQDPSIYTYGAYAGYAQYPQQVEGAQDMSVVSMPMEELYDPLAMPDVDK

SEQ ID NO: 113467 - protein, 19 aa, Glycine max
  Coding DNA Sequence Number=SeqID_21782
MEEVAYAGGGQRDGGSGDF

SEQ ID NO: 113468 - protein, 119 aa, Glycine max
  Coding DNA Sequence Number=SeqID_21783
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A9PFR8; Match level="QueryCoverage=85%, HitCoverage=31%, E-value=1e-10, Identity=39%"; Hit description =Putative uncharacterized protein
  Subcellular localization annotation: CTP_CleavageSite=53; ConfidenceScore=5.06e-01
MQKYALGNLVIVLSTGGYASGGSPPNRRSKCFANCTAGDSTSEPVTHHLILAHAAAVKVYREKFQKISYEVEDKNRELSLGLLCLGTTYASFLEERLECFQILKYDIEAERLPKPAERQ

SEQ ID NO: 113469 - protein, 664 aa, Glycine max
  Coding DNA Sequence Number=SeqID_21784
  Gene Ontology: Mol. function=catalytic activity; Biological process =polysaccharide catabolic process
  Homolog annotation: Hit_ID=A7NZU1; Match level="QueryCoverage=100%, HitCoverage=77%, E-value=0.0, Identity=70%"; Hit description =Chromosome chr6 scaffold_3, whole genome shotgun sequence
  Pfam annotation: Domain name=DUF1680; Domain location=1-440; Score =448.0; E_value=1.3e-131; Accession=PF07944.3; Description=Putative glycosyl hydrolase of unknown
MSSLVAGLSACQEKIGTGYLSAFPSEFFDRFETVQPVWAPYYTIHKILAGLLDQHTFAGNPQALKMVTWMVDYFYNRVQNVITKYTVNRHYESLNEETGGMNDVLYRLYSITGDSKHLVLAHLFDKPCFLGLLAMQANDIANFHANTHIPVVVGSQMRYEITGDPLYKQIGTFFMDLVNSSHSYATGGTSVSEFWSDPKRIADNLRTTENEESCTTYNMLKVSRHLFRWTKEVSYADYYERALTNGVLSIQRGTDPGVMIYMLPLGFAVSKARTGHSWGTQFDSFWCCYGTGIESFSKLGDSIYFEEEGKDPTLYIIQYIPSSFNWKSGKILLNQTVVPVASSDPYLRVTFTFSPVENTLSTLNFRLPSWTLLDGAKGILNGQTLSLPNPGKYLSVTRQWSGSDKLTLQLPLTVRTEAIKDDRPEYASVQAILYGPYLLAGHTTGGDWDLKAGANNADWITPIPASYNSQLVSFFRDFEGSTFVLTNSNKSVSMQKLPEYGTDLTLQATFRIVLKDSSSKFSTLADANDRSVMLEPFDFPGMNVIHQGAGKPLLIADSSHGGPSSVFLLVPGLDGRNETVSLESQSNKGCYVYSGMSPSSGVKLSCKSDSDATFNKATSFVALQGLSQYNPISFVAKGTNRNFLLQPLLSFRDEHYTVYFNIQD

SEQ ID NO: 113470 - protein, 2088 aa, Glycine max
  Coding DNA Sequence Number=SeqID_21785
  Gene Ontology: Mol. function=transferase activity, transferring glycosyl groups; Cellular component=endoplasmic reticulum; Biological process=response to oxidative stress
  Homolog annotation: Hit_ID=Q9LXU2; Match level="QueryCoverage=36%, HitCoverage=98%, E-value=0.0, Identity=79%"; Hit description =Anthranilate phosphoribosyltransferase-like protein
  Pfam annotation: Domain name=AMP-binding; Domain location=1130-1526; Score=161.0; E_value=3.3e-45; Accession=PF00501.19; Description=AMP -binding enzyme
  Pfam annotation: Domain name=C2; Domain location=205-287; Score=80.5; E_value=5.4e-21; Accession=PF00168.21; Description=C2 domain
  Pfam annotation: Domain name=C2; Domain location=366-459; Score=83.2; E_value=8.4e-22; Accession=PF00168.21; Description=C2 domain
  Pfam annotation: Domain name=C2; Domain location=44-124; Score=98.4; E_value=2.2e-26; Accession=PF00168.21; Description=C2 domain
  Pfam annotation: Domain name=PP-binding; Domain location=1629-1695; Score=42.7; E_value=1.3e-09; Accession=PF00550.16; Description =Phosphopantetheine attachment site
  Pfam annotation: Domain name=PRT_C; Domain location=622-777; Score =422.2; E_value=7.7e-124; Accession=PF08372.1; Description=Plant phosphoribosyltransferase C-ter
  Pfam module annotation: Pfam domain module=AMP-binding::C2::C2::C2::PP -binding::PRT_C; Domain location=1130-1526::205-287::366-459::44 -124::1629-1695::622-777
MQKAPLAHSNEFALKETSPKIGAGAVTRDKLSCTYDLVEQMQYLYVRVVKAKDLPSKDVTGSLDPYVEVKLGNYKGLTKHFEKKSNPEWNQVFAFSKDRIQASVLEVIVKDKDVISDDFVGRMWFDLNEIPKRVPPDSPLAPQWYRLEDRKGEKVKGEIMLAVWMGTQADEAFPDSWHSDAAMVGSEAVSNIRSKVYLSPKLWYVRVNVIEAQDLIPGDKTRFPEVYVKINLGNQFLRTRVSQSKTMNPMWNEDLMLVAAEPFEEPLILSVEDRLGPNKDEVLGRCVIPLQIVQRRLDHKPVNTRWFNLEKHVVVEGEKKEIKFASRIHLRMCLDGGFHVLDESTHYSSDLRPTAKQLWKPNIGILEVGIISAQGLMPMKTRDGRGTTDAYCVAKYGQKWIRTRTLVDSFTPKWNEQYTWEVFDPCTVITIGVFDNGHIQGGGEKGGGGSKDSRIGKVRIRLSTLEADRVYTHSYPLLALHTSGVKKTGELQLAVRFTNSSFINMLYLYSQPLLPKMHYIHPLSVIQLDSLRHQAMQIVSMRLSRAEPPLSKEVVEYMLDVDSHMWSMRRSKANFFRIMKVLSGLVAFGRWFDQICNWKNPITTILIHVLFIILVLYPELILPTIFLYLFLIGIWNFRWRPRHPPHMDTRLSHADAAHPDELDEEFDTFPTSRSSDIVRMRYDRLRSIAGRVQSVVGDLGTQGERFQSLLSWRDPRATTLFVTFCFVAAIVLYVTPFQVVSLLIGFFMLRHPRFRHKLPSVPLNFFRRLPARSDSMLLGYKNITVLEKHHTVSGMCESVEIEGKVYDLDGQVLAATSTPIIFRLARETGSALEELDSHKLAVIDPSSGEYQDTKVADDYVSIVSLTLEIQEKVKNCDRIGVHAVSDIASDLTPEYLEHHGLKSVPKSVAYDGYTSLWQKIAELLPLKLHCSTEVLANRRNSDGVTVNIKSLNQFETLEFDKIIISECETEVMDASDLEKDLFSKVETNDYYTTVLKIKGLEHLPVGFYYFSEYMKDPSTIGHPVAMQRFYADTNIFLLWSYGNSVDIKGPTVMELAIKTIEAIGGENLFPLQAECQKKNPRELGELPEVQFPDLPTLNSYFKHWGTHLITQNRNLYTWINEEGTPVCQRTYGELYFNSSCIAHNLLTSQKPVIKPADKVLMVYAPGLDFIDAFIGCLRAKVIPVPILPPDPMQRNGQALIQIENIAKSCNIVAILSTVAYHSAVRAGSTSDAKGVMIAHGGLIHNVKFMRTRYKSTSRTILVSWLPQYHDMGLIGGLFTSLVSGGSAVLFSPMTFIKKPLLWLETISKYQATHSARPNFAFELLIRRLESDKDKLRNLDLSSLTFLMVAAEPVRQKTLKRFIELTSPFGLSEKVMAPGYGLAEDCVFVSCAFGERKPIIVDWQRRICCGYVNHEDADVEIRIVDPETCEELQEDGKEGEIWISNPSAGIGYWGREELSQKTFRNELHNHPRRSYARTRDLGRIIDQKLFITGKIKDLIIVAGRNIYSADVEKIVETSSEFLRPGCCAIIGVPEEILSAKGISIPDGSDQPRTISKTTSGKIKGFECVKQFTDETLNLVPQGSKTILTKKSLLRSFTTRTWGEEKTPGPQQVRGSILAPRKRINKNEIVELLKGLISEQTGIPVNDISITDNLTSYGIDSIGVVKATQKLSDFLGTPVAAIDVFTASCILELANFSKDLLSKSQPSLSSNPSNAQGISSTVLAVHLRGTVFLNYWFEILGARIGSSVLLDTVDITDPSLVSIGDEVVIAEGVLVQIHEVKNGILSFHPIRIGKCSSIGPYVVIQKGSVIEEGAENENYLLSAKLNVISSTTLWESILLAFSAPLLQSLPTYYIFGSPSNLHHPSTSPLFAYMVPSIGYRLQSLHMLPCFLKSRQIPSPLPFHLPAPTCFMLLSGTEAFCIYLCLLGAKIGEHCSIRAINPVSNPELMSIGAGVHLGDFSRVITGFHSSSGYVGGKIEVQDNLVSGSQSLILPGSLVQKNVILGALSVAPMNSTFREGGVYIGSQSQVVIRNSVKNSYDEGKEETDMVSKIRVGNLAAALHKNESHKVTLTRTWYQTFFTQPLLQTVQDF

SEQ ID NO: 113471 - protein, 94 aa, Glycine max
  Coding DNA Sequence Number=SeqID_21786
MASGEVVGSIFLVEDELFRVEELMVGAAMDFVDDCGFEIDEDGTMDDKCYEYVNRSRSVRKKLLSARKLHWKTVVMGKCAKHANSRLSMDPLAI

SEQ ID NO: 113472 - protein, 399 aa, Glycine max
  Coding DNA Sequence Number=SeqID_21787
  Homolog annotation: Hit_ID=A7NZU7; Match level="QueryCoverage=94%, HitCoverage=77%, E-value=1e-121, Identity=57%"; Hit description =Chromosome chr6 scaffold_3, whole genome shotgun sequence
  Pfam annotation: Domain name=WD40; Domain location=176-213; Score =5.8; E_value=6.1; Accession=PF00400.23; Description=WD domain, G -beta repeat
  Pfam annotation: Domain name=WD40; Domain location=219-257; Score =9.4; E_value=2.2; Accession=PF00400.23; Description=WD domain, G -beta repeat
  Pfam annotation: Domain name=WD40; Domain location=63-101; Score=5.2; E_value=7.2; Accession=PF00400.23; Description=WD domain, G-beta repeat
  Pfam module annotation: Pfam domain module=WD40::WD40::WD40; Domain location=176-213::219-257::63-101
MEKYLVSHKPPIEKVQPHRRSWRCQWKRGSVELNGRFERNYRHEMLDLLIRSYSETNRLIGEANGDGHLPFRKQGISAVDFDNKGIYLVSVTKSGCLTVHDFEALYCQIPELTCLKEDESKHLMHLSLNQQLDAVRWNPLNQDEVVCASVKSNKLLIFDVGYVSSDPVEVLRTRQTTTVNGSSIHKGLSDVAFTKNDTRILASDTHGAINVWDRRVNTLPCLELASASCGTLNSIQLNADNQIIFGAGKHGLVYVWDIRGGRASATFQSLKEICHPPVTSVKLATLLEKIGSLKFGVLVRVVFTSGFSPDYTVCNKMSGFHHLAQANIVPKEIHSIDIDPSCPYQLAFHLVDGWSGVLDTNNFQVTHIHCPPPAWLNDSYIPADLSYLRKPSWLSTGSA

SEQ ID NO: 113473 - protein, 145 aa, Glycine max
  Coding DNA Sequence Number=SeqID_21788
  Homolog annotation: Hit_ID=A7NZ77; Match level="QueryCoverage=58%, HitCoverage=16%, E-value=3e-27, Identity=53%"; Hit description =Chromosome chr6 scaffold_3, whole genome shotgun sequence
MEGLCSVEKYEEAKKLMFDMAYHGSKAQPVNFGVLMNDLGKRGKEGKAMEAYKVLLEMQIGGCVPNAATYRMVVDGLCQIGDFEGNKLISRISYLQKMQRKEGNKRIWAPNSSSSNTLKSCNLPGNLAFSPFSYYWSLLLPAPLP

SEQ ID NO: 113474 - protein, 187 aa, Glycine max
  Coding DNA Sequence Number=SeqID_21789
  Gene Ontology: Mol. function=oxidoreductase activity; Cellular component=integral to membrane; Biological process=electron transport
  Homolog annotation: Hit_ID=Q2MIZ2; Match level="QueryCoverage=79%, HitCoverage=30%, E-value=2e-54, Identity=70%"; Hit description =Cytochrome P450 monooxygenase CYP93B12
MVTYHNATFAFAPYDTYWKFMKKLSTTELLGNKTLAQFLPIRTREVHDFIQILFHKSKTQERVNLTEALLSLSTNVISQMMLSIKSSETDSQAEQARALVREVTQIFGEYNISDFLGFCKNLDLQGFKKRALDIHKRYDALLEKIISDKRMRGRVNSEPRQIIDLGCPGMPLTMRELPTIIGALTVL

SEQ ID NO: 113475 - protein, 343 aa, Glycine max
  Coding DNA Sequence Number=SeqID_21790
  Homolog annotation: Hit_ID=A7PMV5; Match level="QueryCoverage=39%, HitCoverage=18%, E-value=4e-08, Identity=33%"; Hit description =Chromosome chr14 scaffold_21, whole genome shotgun sequence
  Subcellular localization annotation: CTP_CleavageSite=83; ConfidenceScore=5.28e-01
MPPKGSSSFGRGGRSRTKGKDVLLALPEPITKKGTASSSGSPTQTGSSTQKGKLEGSLTHITTIKPESSTQESPKPTTTKQTVADYAWSIQTLLALEDIGLTRVPKLAKKTWAEMASESDDDSETDLQKQIQKAKQTKTICNQKPSQPLTPQESTPQPSNSYISKKKILQCLTNGARILGQESFQGNRQNTNSVSIKHFKDPKDPNLNTHSTIQILKVMQPRHYGSNLNQPKKISAPFDPAGYNYWDYIDAWTNRHAFVKWWSQFDTSKAAPEKVKNWFQRNPEFLKPADPETSLFLNQKSQLEEKEEPPKKEAESSENNDDQEDDPFYQNEDDCFGISLDDD

SEQ ID NO: 113476 - protein, 103 aa, Glycine max
  Coding DNA Sequence Number=SeqID_21791
ERKDIELVDEEEPRIGADCSSVTSNKSEIYKEEAGNAAQKHKPKRVESVNTDAEAFGDHWKVQIADSTVLKIGDSAKVVIKQDMKGGEHKYGFNNNKREKPEK

SEQ ID NO: 113477 - protein, 64 aa, Glycine max
  Coding DNA Sequence Number=SeqID_21792
  Homolog annotation: Hit_ID=A0ST23; Match level="QueryCoverage=50%, HitCoverage=65%, E-value=2e-11, Identity=100%"; Hit description =Putative reverse transcriptase
  Subcellular localization annotation: CTP_CleavageSite=48; ConfidenceScore=5.07e-01
MSRSSKAISDEAMFGYVSPHLSTGYRARIRNHVGKPVVPAALMNRPTRGERRFAYWALFRFLAH

SEQ ID NO: 113478 - protein, 50 aa, Glycine max
  Coding DNA Sequence Number=SeqID_21793
MWDQHRLKRALKPDVFTPKAYTPKSPLGPLPPDLDTAHELYNTHDLTLVF

SEQ ID NO: 113479 - protein, 83 aa, Glycine max
  Coding DNA Sequence Number=SeqID_21794
  Gene Ontology: Mol. function=methyltransferase activity
  Homolog annotation: Hit_ID=A6FJQ2; Match level="QueryCoverage=45%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARALFWQQQNYYGVDLTPLHGTAFQGYFSQGRIPP

SEQ ID NO: 113480 - protein, 81 aa, Glycine max
  Coding DNA Sequence Number=SeqID_21795
MVNMFLAPLPGTFFFLLGCHTYSISRNATEDLALLNPEIEATCRRNNAAEEEESKKYKGAINPHLHPLTSYYQWKRSMHDE

SEQ ID NO: 113481 - protein, 83 aa, Glycine max
  Coding DNA Sequence Number=SeqID_21796
  Subcellular localization annotation: CTP_CleavageSite=36; ConfidenceScore=5.12e-01
MRVHCNQASRRPSIITDSPLLLIFPRTRSPVESPTVATYPSAGERCVTRGCIFQERNTRGVATNVYLRKTSEKPEKTWSTNFK

SEQ ID NO: 113482 - protein, 207 aa, Glycine max
  Coding DNA Sequence Number=SeqID_21797
  Gene Ontology: Mol. function=helicase activity; Biological process =viral genome replication
  Homolog annotation: Hit_ID=Q9LTU4; Match level="QueryCoverage=97%, HitCoverage=16%, E-value=5e-33, Identity=34%"; Hit description =Helicase-like protein
MPNVPKIDALIVGDFHPGSKRDIIVETQNGELQIIHELHPGYLPLQYPLLFPYGEDGYRADILHRSTSSSKKRKRNCLTMREWFAYRLQSRSNEAHTLLHSRKLFQQFIVEGYTMVESERLSYIRNNQKKLRVDKYCSLQNSLDIGTAKGLTKGKRVILPSTFVGGPRYIDQLYFDDKPDIVSRIFKLKYEQMLSDLTKGHYSESSA

SEQ ID NO: 113483 - protein, 138 aa, Glycine max
  Coding DNA Sequence Number=SeqID_21798
  Subcellular localization annotation: CTP_CleavageSite=62; ConfidenceScore=5.85e-01
MGSPPASTTFPPPPPPPSPPRPPPTLDASASTSAVKRTRKASRLRSLSTRPPGVERPVVHVDLATGKADSPHKKKLRTYLGIVAHDKVDITYENWKEVPTAQKDLIWEDIQAEFDNPEASDSRTKRKYYRPWGEMEAV

SEQ ID NO: 113484 - protein, 184 aa, Glycine max
  Coding DNA Sequence Number=SeqID_21799
MEAIKEQMATMMKAMMSMKKIMEANAVIVAAVSAVAKVNPMLPSSLKQMNHPTSNMAHISQTMGETHEIPHHNLADFEPWLGYATEGQAVGGIPFENTLEGPQFRPQPQPLHFAVGRAPPAMAEKGKADHLEERLRAIEGGEDCSFANLEELFLVPNIITPPKFKVLDFDKYKGTTCPKNHPPH

SEQ ID NO: 113485 - protein, 94 aa, Glycine max
  Coding DNA Sequence Number=SeqID_21800
MEGTHEIPHHNLANFKPCLEYATDGQVVGGVPLPETLEGTQFRPQPQPLHFMMGRASPTMAEMGKLDQIEEILRVVEGGEDYTLADMEDLWPST

SEQ ID NO: 113486 - protein, 81 aa, Glycine max
  Coding DNA Sequence Number=SeqID_21801
MEHSSKLENGGHMNDNAIHSRGSGKGREWRIALRTRMEDCLEVPLLGNHGTQLQLKSGGHMTSLSNNIHVASEKDENGGLP

SEQ ID NO: 113487 - protein, 111 aa, Glycine max
  Coding DNA Sequence Number=SeqID_21802
MERSMIDASSGGALADMTPVEARNLIEKMASNSQQFSARNDVIVLRGVHEVATDSSSSAENKKLEGKLDALQSRVNEQPEAYAANIYNRPPQQQNQQQQNNYDLSSNRYNP

SEQ ID NO: 113488 - protein, 123 aa, Glycine max
  Coding DNA Sequence Number=SeqID_21803
  Homolog annotation: Hit_ID=A6FJQ2; Match level="QueryCoverage=30%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPHQPSISHCSTFEVKVGLDKVIWADDL

SEQ ID NO: 113489 - protein, 122 aa, Glycine max
  Coding DNA Sequence Number=SeqID_21804
MIMRGQDIYSSQDEATTSPSFSESEEGKGEESSEEIYPQEEGQPLMVKEECKEISVSSKRLAKKESHFDIKTNTLASIATPLGLEVIPQVKKLLDEGLVHKSLNPYALLVPKIRIIRHQIPK

SEQ ID NO: 113490 - protein, 109 aa, Glycine max
  Coding DNA Sequence Number=SeqID_21805
MTTLISTPSFFLHNTKQNTNNNKNNEYNIHIHIYTCLAKEPIRKITEKHISQSPEAPRLITEDTGTAQGNEFMGLRIKSGEWRIGEQRYAITSRGSRLEGGGHMNSARQ

SEQ ID NO: 113491 - protein, 117 aa, Glycine max
  Coding DNA Sequence Number=SeqID_21806
  Subcellular localization annotation: CTP_CleavageSite=30; ConfidenceScore=5.28e-01
MILHEIRRPNSLKIVPSGVANCRNLPFRRRAMRDSRVRLPRKENVRSRHQRLFEKNVGKNRKGGGLRNLSERFGSCIYARGRPKNDEERMKNDEERWKTFAKSPTETSRKRYGSASA

SEQ ID NO: 113492 - protein, 143 aa, Glycine max
  Coding DNA Sequence Number=SeqID_21807
MEKNEETTMEEKVKQKINGASMRSFNGDFSPWRCSGRQRRRGEGRHHPLGNKLWKKELHHQECALDKKLEEDALMKEKKERRGENGIEGIKEGEKWNFEVCLIRLSLIEVTAKIYPGVHDNPKAFFSNSSPNLLESSIQYPWG

SEQ ID NO: 113493 - protein, 106 aa, Glycine max
  Coding DNA Sequence Number=SeqID_21808
  Homolog annotation: Hit_ID=A6FJQ2; Match level="QueryCoverage=35%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPNCEDTTPVVACG

SEQ ID NO: 113494 - protein, 77 aa, Glycine max
  Coding DNA Sequence Number=SeqID_21809
  Gene Ontology: Mol. function=peptidase activity
  Homolog annotation: Hit_ID=A5C753; Match level="QueryCoverage=87%, HitCoverage=19%, E-value=3e-11, Identity=41%"; Hit description =Putative uncharacterized protein
MASSNFLFPEGNSINRPRIFNGVGYHYWKTGMQIFIEAIDLNIWETIEIGPYIPTMVAGNTTMEKPRKQWDEEERKM

SEQ ID NO: 113495 - protein, 278 aa, Glycine max
  Coding DNA Sequence Number=SeqID_21810
  Homolog annotation: Hit_ID=UPI00006A2D9E; Match level="QueryCoverage =85%, HitCoverage=100%, E-value=2e-08, Identity=15%"; Hit description= UPI00006A2D9E related cluster
MIDPLDESITCFLIRVDPWVLVLITLRGLHVLALRGLHVLAIRGIQVLALRGLHVLAFRGLHVLDFRGLHVLTLRGLHALAIRGLHALTFRGLHAHRLQRAAHPCLQRATCPHLQRATRPRLQRTPRPRLQRTARPRLQRGIHVLAFRGLNILTFRGLHILAFRGLHVLAFIGLHALAVRRLHVLTFKGIHVLAFRGLHVLTFRGLHALAFRELHAFTFRGLHVLAFRGLHKATCPRLHRAIRPRLQRTTRPRIQRAAHPRLQMAPRPRLHRATCLCL

SEQ ID NO: 113496 - protein, 106 aa, Glycine max
  Coding DNA Sequence Number=SeqID_21811
IASDSSESENSESTQVSDATAHALKLIFKILIIILYCDIKQFQDILILVINSSNVDIVMHKCGMMKEYQKIKIFRIQGSAYAVEMAKLNYRHYYKITSTSAMTSVS

SEQ ID NO: 113497 - protein, 341 aa, Glycine max
  Coding DNA Sequence Number=SeqID_21812
  Gene Ontology: Mol. function=ligase activity; Biological process =regulation of transcription, DNA-dependent
  Homolog annotation: Hit_ID=A6T5P3; Match level="QueryCoverage=63%, HitCoverage=85%, E-value=1e-113, Identity=92%"; Hit description =Putative ligase
  Pfam annotation: Domain name=GumN; Domain location=1-217; Score= -30.1; E_value=0.00072; Accession=PF07446.2; Description=GumN protein
  Pfam annotation: Domain name=YbaK; Domain location=230-341; Score =155.1; E_value=1.9e-43; Accession=PF04073.6; Description=YbaK prolyl-tRNA synthetases associated domain
  Pfam module annotation: Pfam domain module=GumN::YbaK; Domain location=1-217::230-341
MAPPPAKLLKKIRQADALIVEADITGNETPFSNLPSYPPLAERLSETQLAELRSRAGELGLSVDLFDSQPLWQVAMVLQATQAQKLGLRPDYGIDYQLLMAARESNIRVMELEGADSQIALLRNLPDGGKALLEDTLTHWRTNARLLQLMIGWWLEQPPSRGAETLPTTFSQSLYDVLMHQRNIAWRDTLLALPPGRYVVAVGALHLYGEGNLPDMLTITMTPAVKLLEKNKITFQIHSYEHDPQETNFGDEVVRKLGLNADQVYKTLLVAVNGDMKHLAVAVTPVAGQLDLKKVAKALGAKKVDMADPMVAQRITGYLVGGISPLGQKKRLPTVIDAPAQ

SEQ ID NO: 113498 - protein, 274 aa, Glycine max
  Coding DNA Sequence Number=SeqID_21813
  Homolog annotation: Hit_ID=Q2HW90; Match level="QueryCoverage=29%, HitCoverage=16%, E-value=7e-09, Identity=37%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKSEYQGSVWRKGQRPWQIKANGLSFIDILVLLIFGVVLFPNMEGLVDLAAIDAFLAFHHGKESPVVAILAMYDTFQLGDVKRAAQELFVVHQLLASMEGTKASRLSLHGVSVTTMRGYSKEFARHGMRREERTESLGEAVQALKAELERARVVEEKFKSIAIKLKPWNEEVKGIITGQRHDLEGRANGLP

SEQ ID NO: 113499 - protein, 103 aa, Glycine max
  Coding DNA Sequence Number=SeqID_21814
MSQRKDKELKGSSNGPIGGYHRWLKAYAQDLDWLPSLRTTKGMEVETPEEDEEVQEEFVLAVMRDRNKHVSHHRQVPRRIKSSHDPRAQSGGRIRPSVRGKGD

SEQ ID NO: 113500 - protein, 97 aa, Glycine max
  Coding DNA Sequence Number=SeqID_21815
  Homolog annotation: Hit_ID=A5BFN6; Match level="QueryCoverage=80%, HitCoverage=13%, E-value=6e-08, Identity=38%"; Hit description =Putative uncharacterized protein
MTLSLKYLPCELMIKFYKEKTKKFHDSLIAKKDFVVGPKVLLYNSRLGLMSVEIKSESTDKSFKVNGHWLKPFLTNPSLVDVVVEETSLLHPTSLPP

SEQ ID NO: 113501 - protein, 384 aa, Glycine max
  Coding DNA Sequence Number=SeqID_21816
  Gene Ontology: Mol. function=serine-type endopeptidase activity; Cellular component=periplasmic space; Biological process=proteolysis
  Homolog annotation: Hit_ID=Q84DH8; Match level="QueryCoverage=100%, HitCoverage=84%, E-value=0.0, Identity=87%"; Hit description=Serine protease
  Pfam annotation: Domain name=PDZ; Domain location=213-302; Score =76.9; E_value=6.4e-20; Accession=PF00595.15; Description=PDZ domain (Also known as DHR or GLGF)
  Pfam annotation: Domain name=PDZ; Domain location=321-383; Score=0.6; E_value=0.42; Accession=PF00595.15; Description=PDZ domain (Also known as DHR or GLGF)
  Pfam annotation: Domain name=Trypsin; Domain location=30-211; Score =79.3; E_value=1.3e-20; Accession=PF00089.17; Description=Trypsin
  Pfam module annotation: Pfam domain module=PDZ::PDZ::Trypsin; Domain location=213-302::321-383::30-211
MLEKVLPAVVSVQVEGTAVQSQRVPEELKKYFGDEAPDQQAQPFEGLGSGVIIDAAKGYILTNNHVISQADKISVLLNDGREFDAKLIGGDDQSDIALLQVQNPSNLTQIAIADSDKLRVGDFAVAVGNPFGLGQTATSGIVSALGRSGLNLEGLENFIQTDASINRGNSGGALLNLNGELIGINTAILAPGGGSIGIGFAIPSNMAKTLADQLIQYGEIKRGLLGIKGMEMSADIAKAMNINAQRGAFVSEVLANSGSAKAGIKSGDVIVSMNGKPLSSFAELRSRIATTAPGTKVKLGLLRDGKPLDVEVTLDKSTSSTASAELIIPALQGAALSDGQLKDGTKGVSIDNVDKGSAAAQVGLHKDDLIIGLNRQRVRSIAEL

SEQ ID NO: 113502 - protein, 74 aa, Glycine max
  Coding DNA Sequence Number=SeqID_21817
AYLARPKWRRKKAQMEKDEGRSGKGRSPKWRRMKAQVERDEGPSGEGRKTQVEKDEGPKAKALLSILIVAEAQD

SEQ ID NO: 113503 - protein, 130 aa, Glycine max
  Coding DNA Sequence Number=SeqID_21818
  Subcellular localization annotation: CTP_CleavageSite=37; ConfidenceScore=5.09e-01
MSSIVCRDRAHKSPSGPKEVQQDPGVSSSSYGPLSVLQGARSPSEVMPSQHRNCTHKDTQWTRRSPTGPWGFQLWLRASIVLQGARSPRQGHVNIGCPFPPARSRHHRDRACKTPSGPEEVQEGLGVVKL

SEQ ID NO: 113504 - protein, 244 aa, Glycine max
  Coding DNA Sequence Number=SeqID_21819
  Homolog annotation: Hit_ID=Q84VH5; Match level="QueryCoverage=85%, HitCoverage=39%, E-value=2e-67, Identity=86%"; Hit description =Envelope-like protein
MDLIKAAGLLKTVTKLGDCYESLVREFIVNIPSDITNRKSDDYQKVFVRGKCVRFSPAVINKYLGRPTEGVVDIDVSEHQIAKEITAKQVQHWPKKGKLSAGKLSVKYAILHRIGAANWVPTNHTSTVATERIGSVLHYKLFEGTHVPDIVSTSGKAAASGAVSKDALIAELKDTCKMLEATIKATTEKKMELERLIKRLSDSGIDDGEAAEAEEEAAEEEEEAAEEDAAEDTESDDDDSEATP

SEQ ID NO: 113505 - protein, 99 aa, Glycine max
  Coding DNA Sequence Number=SeqID_21820
MTKPRLQCTSCSSFMLLGLFSPNRPVADLEFYALVIYRSCHKGGKSCYPNSAQDRLQIGSEITTLRLAPPLRLARVREFGLSASLELSLAEGTCCAYVN

SEQ ID NO: 113506 - protein, 99 aa, Glycine max
  Coding DNA Sequence Number=SeqID_21821
MGTNQTGKRFYQVKVKSLDTTSIKELGRLMEPLQMQAFHKTYGKILELTIAEVSIEAIASLTQYYDQPLRCFTERFGPHETDSKRHSGPTTEVPRRQGK

SEQ ID NO: 113507 - protein, 208 aa, Glycine max
  Coding DNA Sequence Number=SeqID_21822
  Gene Ontology: Mol. function=transferase activity, transferring glycosyl groups; Cellular component=extracellular region; Biological process=enterobacterial common antigen biosynthetic process
  Homolog annotation: Hit_ID=A8G842; Match level="QueryCoverage=100%, HitCoverage=84%, E-value=1e-110, Identity=94%"; Hit description =Probable UDP-N-acetyl-D-mannosaminuronic acid transferase
  Pfam annotation: Domain name=Glyco_tran_WecB; Domain location=60-208; Score=205.4; E_value=1.4e-58; Accession=PF03808.4; Description =Glycosyl transferase WecBTagACpsF family
MEAKISVPQYELRGFSLWGFRDMAHCMDFLFDGGRVKQGTLVAMNAEKILKAEEDQALHALLDEAEYKYADGISMVRSIRRKYPAADVSRVAGADLWEALMQRAGREGTPVFLVGGKPEVLAETEQKLRSQWNVNLVGSQDGYFKPDQREALFERIRASGAAIVTVAMGSPKQEILMRDCRKVHPQALYMGVGGTYDVFTGHVKRAPK

SEQ ID NO: 113508 - protein, 70 aa, Glycine max
  Coding DNA Sequence Number=SeqID_21823
MVHNSNTAANSPVVEVTTDYDDHGDNTVVEKILFYDGCLPRTVVEGSYHYNGVLLRTTVVRDSVNTTTVT

SEQ ID NO: 113509 - protein, 36 aa, Glycine max
  Coding DNA Sequence Number=SeqID_21824
MKLPMDFESVPTSSGNSSSEQKIQTPRSTNSRNRES

SEQ ID NO: 113510 - protein, 129 aa, Glycine max
  Coding DNA Sequence Number=SeqID_21825
MTFVPSAIANPNPPLICSSLVLRPIDNFLQHQPLAGSKGSNRRWKMWWIAVTITIWKSSNELIFHNKPFDISKLADSTLFLLWTWLRGWERDFMSGCCKPAEECQFSYVNPTTWTKPTNVTNQSNPIDS

SEQ ID NO: 113511 - protein, 112 aa, Glycine max
  Coding DNA Sequence Number=SeqID_21826
  Gene Ontology: Mol. function=beta-lactamase activity; Biological process=beta-lactam antibiotic catabolic process
  Homolog annotation: Hit_ID=A6B9Y3; Match level="QueryCoverage=85%, HitCoverage=100%, E-value=2e-39, Identity=85%"; Hit description=Beta- lactamase TEM
MAPDAVFSPYASVRKSMSIQHFRVALIPFFAAFCLPVFAHPETLVKVKDAEDQLGARVGYIELDLNSGKILESFRPEERFPMMSTFKVLLCGAVYPVLTPAEHSVAHTLFSE

SEQ ID NO: 113512 - protein, 35 aa, Glycine max
  Coding DNA Sequence Number=SeqID_21827
VDSRGSPADTDTERRKLGERMGLDTPVVLAVNDGY

SEQ ID NO: 113513 - protein, 56 aa, Glycine max
  Coding DNA Sequence Number=SeqID_21828
MEDAPVSLVSPSCRRMVVIIKKGENVNLAGLDDVKKNLLENDCHHQKGRECESGRF

SEQ ID NO: 113514 - protein, 142 aa, Glycine max
  Coding DNA Sequence Number=SeqID_21829
  Homolog annotation: Hit_ID=O69419; Match level="QueryCoverage=42%, HitCoverage=96%, E-value=4e-12, Identity=67%"; Hit description =Putative uncharacterized protein
MLVRGGGAYGKRQHALFTVPGLCWPLLTCSFLRYPLILWITVLPPLSELIPLAAAERPSAARNSYDHDYEFELGTRLLCPSAPHLLHFVRCSDGSTQSISFLILVDFGRPFARIVVGSGISVHASSEGGIAASFPRGHHCAE

SEQ ID NO: 113515 - protein, 147 aa, Glycine max
  Coding DNA Sequence Number=SeqID_21830
LRVLAFRGLHVLAFRGLHVLSIRGLRALTFRGLHVLAIGGLHALTFRGLRVLTFRGLHALAFRGLHALVFKGLHALAFKGRQVLYFRGLHALAFRGLCVLTFRITTTRYPVDPGKSNRALGFPALVRASVSPTGCPSPPARSCHRDI

SEQ ID NO: 113516 - protein, 24 aa, Glycine max
  Coding DNA Sequence Number=SeqID_21831
MAGEGSEEAYVGLPWRIFDPMRSL

SEQ ID NO: 113517 - protein, 203 aa, Glycine max
  Coding DNA Sequence Number=SeqID_21832
  Homolog annotation: Hit_ID=A5ZQM3; Match level="QueryCoverage=32%, HitCoverage=92%, E-value=4e-19, Identity=53%"; Hit description =Putative uncharacterized protein
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGLGGGQRRPLLGGPEPSVRYHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 113518 - protein, 70 aa, Glycine max
  Coding DNA Sequence Number=SeqID_21833
MANQEEWVPFADVLALLIFGVVLFPNVDGLVDLAAIDAFLAYHHSKESPMLFLPDIRHPCPLQSHRSCVR

SEQ ID NO: 113519 - protein, 129 aa, Glycine max
  Coding DNA Sequence Number=SeqID_21834
DPIDVAIVKEFYANLYDPKDKSPKQVRVRGHLIKFDEDALNTFLKTPVIIEEEESLSAYSRRGFELNSDGLPLKILRKNLTTLAQTWSVLSLSNLAPTSHTSDITLDKARFIYGIIQNMDMNLGYLILS

SEQ ID NO: 113520 - protein, 120 aa, Glycine max
  Coding DNA Sequence Number=SeqID_21835
  Homolog annotation: Hit_ID=A8G857; Match level="QueryCoverage=85%, HitCoverage=64%, E-value=2e-53, Identity=94%"; Hit description =Putative uncharacterized protein
MEPGTYIRPHRHPQTWELLTPLRGRFVVLQFNDDGVVMQRTLLGEETKVLEMPAFTWHAVLSVDAGGVVFEVKQGPYQALTEEDCIPWAPQEGGEGTEAVMRWGCPLQRAPLFYTVSKRA

SEQ ID NO: 113521 - protein, 178 aa, Glycine max
  Coding DNA Sequence Number=SeqID_21836
MAPRKLASKRSRKDKAAEGISSAPEYDSHRFRSTVHQQRFEAIKGWSFLRERRVQLRDDEYTDFQEEIGRRRWASLVTPMAKFDPEVVLEFYANAWPTEEGVRDMRSWVRGQWIPFDADAIGQLLGYPLVLEEGQECEYGQRRNRSDGEASANYAHQYDHPDSDMDDFAAQQHPAHRS

SEQ ID NO: 113522 - protein, 135 aa, Glycine max
  Coding DNA Sequence Number=SeqID_21837
MELGLKWEALNGNFSNVLLGITFRLEPLLMSTLAITCSMHLTNTCKALLCPLPSARISSSAKVRGTRWPPRVIPLSCCNPLSPRQIPSLNLLVRCGDHLDILCFGYFCFPFSVCGLRWQARGCEHATVAGYAAQP

SEQ ID NO: 113523 - protein, 122 aa, Glycine max
  Coding DNA Sequence Number=SeqID_21838
MTVRSLGFDGPYDIYPLHGKRPRGGHDIQRMWRNIDIVRERLTFMAFPYMGAAIAFHGEPVITCSKDFPGHSMPIGVRPKRLMDFLDHVVRLFGIHASQEGHVMVSFVQDDVTHKETSSQSP

SEQ ID NO: 113524 - protein, 109 aa, Glycine max
  Coding DNA Sequence Number=SeqID_21839
TYQGNPCGVYPDLSSFIGSGVYPDLSSLTGSGVYPDLSAFTGSGVYHDLSSFTGSGVIQTFVACIKRSAPLIKVILVASTQTYLPSLEVASTQTYLPSLEVASTQTYLP

SEQ ID NO: 113525 - protein, 105 aa, Glycine max
  Coding DNA Sequence Number=SeqID_21840
MAKVSTEAIASLAQYYDQPLRCYTFGNFQLRPTNFQNSQNLNTGIGPRKASRKWGAWNTNEMFGRKGENLGKSRQMGPVHGHPGTLDLQGGPLSKCGWVGGPSSD

SEQ ID NO: 113526 - protein, 88 aa, Glycine max
  Coding DNA Sequence Number=SeqID_21841
  Pfam annotation: Domain name=G-patch; Domain location=1-42; Score =11.6; E_value=0.0075; Accession=PF01585.14; Description=G-patch domain
MVARVMLGHRYEPEMGLGRNENGVESLVKFKENRGRFGLGYKPTHTNVRRSAQERRGGSMGYQQGPQVKGTPLCHINESFVCSGWMCE

SEQ ID NO: 113527 - protein, 216 aa, Glycine max
  Coding DNA Sequence Number=SeqID_21842
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
ADRYPVSGRVGTGERTRELPGGNAGIFIVLSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTHEDNLSSGLQIQNSQLSTVQVKQGSDPGMQAWHWPSFYNVVTGKTLALPNLIALQHIPLSPAGVIAKRPAPIALPNSCAA

SEQ ID NO: 113528 - protein, 203 aa, Glycine max
  Coding DNA Sequence Number=SeqID_21843
  Homolog annotation: Hit_ID=Q84VH5; Match level="QueryCoverage=86%, HitCoverage=39%, E-value=5e-59, Identity=82%"; Hit description =Envelope-like protein
MDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAGKLSVKYAILHRIGTAKLDIVSTSGKAAASGAVSKDDLIAELKDTCKVLEATIKANTEKKMELERLIKRLSDNGVDDGEAAEEEEDAAEDTESDDDDSDATP

SEQ ID NO: 113529 - protein, 160 aa, Glycine max
  Coding DNA Sequence Number=SeqID_21844
  Homolog annotation: Hit_ID=Q5QJQ3; Match level="QueryCoverage=67%, HitCoverage=85%, E-value=5e-59, Identity=100%"; Hit description =Putative uncharacterized protein
STLEDPFSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 113530 - protein, 116 aa, Glycine max
  Coding DNA Sequence Number=SeqID_21845
MAPKKLPAKRSRKDAIGEGCSLAPQANVDFDRHRFRSEEHQRRFEAIKEGGVRDKHSWVRGQRILFDKDAINQFLGHPLVLEEGQCCKFSQRRSQRLWLHEEAISQLLCIPGQDFA

SEQ ID NO: 113531 - protein, 139 aa, Glycine max
  Coding DNA Sequence Number=SeqID_21846
MHQSQNTKKNWVKKFYLKDPKQEMLKRSFVEPFQGLKLAQKQDSGKQNIHGLRSRNIGQYSCLVFKEEDKLEAVMVAMDGEALDWFQWWESWNPNHFWDGFKIVVTQRFQASNLGNSFQALLALEQEETVQGFIDKFEK

SEQ ID NO: 113532 - protein, 47 aa, Glycine max
  Coding DNA Sequence Number=SeqID_21847
MASYGDLKKQRNPLMKKIQGLEAPHGATSEMHQEALCLAYFEQKAEK

SEQ ID NO: 113533 - protein, 80 aa, Glycine max
  Coding DNA Sequence Number=SeqID_21848
MPSRDTAPQRPRHPSTVSSIRRIPFPYKNSCAVPWRYAPPGGREEEATDIGSLSAKVTNITGLSGITRSGRVFEPPSLQM

SEQ ID NO: 113534 - protein, 105 aa, Glycine max
  Coding DNA Sequence Number=SeqID_21849
MVSSGPIDFIPKEPYKDLFYQKKKGKILRVFFPNYTYWSTKKESWYNLFAIGMYGYIRYGEYGPRENHLEQFILATNHFYLLFMGYVFVRRSAYARRKFELDPNG

SEQ ID NO: 113535 - protein, 47 aa, Glycine max
  Coding DNA Sequence Number=SeqID_21850
MGLEELAEGKKNSLWRTRRKLESNTCNPFEYENIPKDTFNGLSREFV

SEQ ID NO: 113536 - protein, 225 aa, Glycine max
  Coding DNA Sequence Number=SeqID_21851
  Homolog annotation: Hit_ID=Q3BZ70; Match level="QueryCoverage=87%, HitCoverage=45%, E-value=3e-10, Identity=24%"; Hit description =Putative uncharacterized protein
MAGSATARAKQLKSGWASSYGEGVGTSRVESLEHYVLRQAWTVGVTMANMMSIVGPAIDGGRRGQVMGSGKYCGPSRDFSHRISTLKMLTAQNDLQCGTFWVLEDVLATYGGGRDTTRRRWCPVCYRDWDDDLSYEPLSWIVDIQAECDLHKCKLETTCSRCGADQPSSTDYQRRRRCHKCKQSLSGDGSAAAITGDEAWGQQQLASIIELCATPSQPQIPFENY

SEQ ID NO: 113537 - protein, 72 aa, Glycine max
  Coding DNA Sequence Number=SeqID_21852
MAISTNNHTTKAYMTFRGIIPFEKHIAAVGTTSNNMLSKRKTLDEGSLLSSKSETQHDHRFTSTPYVPMDRV

SEQ ID NO: 113538 - protein, 47 aa, Glycine max
  Coding DNA Sequence Number=SeqID_21853
MKSLRGKEIALVKVQWGNDEGDSTWELEDRMRELYPKVGIVGARYAG

SEQ ID NO: 113539 - protein, 155 aa, Glycine max
  Coding DNA Sequence Number=SeqID_21854
HTEVDEFEAELERHNFHKRLTNLVDGSIDLAVVKEFYANLYSSEDRPPKQYRVRGHLVKIDADSLNTFLETPVTWVPTLITALCRARGVVSDSLTFECLSPIINLAYIKKNCWNPKDLTVSIRGIWRARARPAELPSTSAAPTLASTSAAPSVPA

SEQ ID NO: 113540 - protein, 95 aa, Glycine max
  Coding DNA Sequence Number=SeqID_21855
MAFLGETSSQTIVNSRLAFIYPNGSIIHNDTGVYFQTSTLVPIRVPNRCDFASLKTRIHNTLQLSDKQFLDKIHYRKPFTDTVSYYAPLEEHQME

SEQ ID NO: 113541 - protein, 103 aa, Glycine max
  Coding DNA Sequence Number=SeqID_21856
  Homolog annotation: Hit_ID=A5AK77; Match level="QueryCoverage=83%, HitCoverage=10%, E-value=6e-10, Identity=38%"; Hit description =Putative uncharacterized protein
MAQPPPRERTLREMAAPDFTYESMCIQYPDEDVPYVLKTKLIHLLPKFHGLAGEDPHKHLKEFHIVCFTMKPPDVQEDHIFLKAFPHSLEGSDKGLALLPCSM

SEQ ID NO: 113542 - protein, 64 aa, Glycine max
  Coding DNA Sequence Number=SeqID_21857
MKAAGTTGFPTGKRAIMARTRGLGRAIGRVVGRDRAADKDAGDVPERRRPTASARRLRVHQMTT

SEQ ID NO: 113543 - protein, 101 aa, Glycine max
  Coding DNA Sequence Number=SeqID_21858
  Homolog annotation: Hit_ID=A5AK77; Match level="QueryCoverage=87%, HitCoverage=11%, E-value=3e-09, Identity=37%"; Hit description =Putative uncharacterized protein
MTQPPPRERTLREMAAPDFTYESLCIQYPDEDVPYVLKIGLIHLLTKFHGLVGEDSHKHLKEFHIVCSTMKPPDVQEDHIFLKAFPYSLKGVAKDWLQGPS

SEQ ID NO: 113544 - protein, 152 aa, Glycine max
  Coding DNA Sequence Number=SeqID_21859
  Homolog annotation: Hit_ID=A7QEC9; Match level="QueryCoverage=21%, HitCoverage=13%, E-value=2e-08, Identity=87%"; Hit description =Chromosome chr1 scaffold_84, whole genome shotgun sequence
MGNYLPGSQKGPYEASRFVGWLWAFLQQLRWRFAKKQPPWGGQSISEIPLEELEFYLVPGPTGRGTVSGRQFLGRKSQKVTEGKRSSGQTEIPRAVLKAEAEGSLSNANVGENPMPRKPKGSSARPKGVVDGQQVNIPVLPFVGPEGRRRLG

SEQ ID NO: 113545 - protein, 94 aa, Glycine max
  Coding DNA Sequence Number=SeqID_21860
  Homolog annotation: Hit_ID=A2I5F8; Match level="QueryCoverage=58%, HitCoverage=3%, E-value=3e-08, Identity=52%"; Hit description =Integrase
MWDTLAITYEGSSEVKCNKLSLLTCKYELFSMEEGEDIQTMFGRFQAIMNELHSLVSQPTLWREGDARLTGASSKEGKRAESPPVFIRGKRQKN

SEQ ID NO: 113546 - protein, 46 aa, Glycine max
  Coding DNA Sequence Number=SeqID_21861
MTSMGTRRKEGERVVHLDSSNGQASSTAREGVRSEGSLRPCLRKTL

SEQ ID NO: 113547 - protein, 82 aa, Glycine max
  Coding DNA Sequence Number=SeqID_21862
  Subcellular localization annotation: CTP_CleavageSite=40; ConfidenceScore=5.02e-01
MVGAGQRSLLILLLGSCHGVSLHKACQSKEEGVSSQPLWRASTRKSSFVSAFGKDAMTFTSPRARSHVATRAMDGPAGEGKE

SEQ ID NO: 113548 - protein, 15 aa, Glycine max
  Coding DNA Sequence Number=SeqID_21863
MEGKLKEDFDPVQLN

SEQ ID NO: 113549 - protein, 143 aa, Glycine max
  Coding DNA Sequence Number=SeqID_21864
MTVKTSDHMQLRRRHSLSVSGCREQTARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPEKF

SEQ ID NO: 113550 - protein, 73 aa, Glycine max
  Coding DNA Sequence Number=SeqID_21865
MSHAKDDCGSSNGDAGGFASSRNYIDKFRSASSIPFPLTIEACMVEVDGQIFGKGFGLTWEEAKIQVSDYLLI

SEQ ID NO: 113551 - protein, 109 aa, Glycine max
  Coding DNA Sequence Number=SeqID_21866
MVAITLSKVHQPPFLQEYDSNAMCACHGEAPGHSIEHCRGPKLTMLKEMDKVDIFVPHPHANASLLIQLSPECGCKPLVCLLKRPVLLSLDFQDRSIRDYSSCTLVGVP

SEQ ID NO: 113552 - protein, 39 aa, Glycine max
  Coding DNA Sequence Number=SeqID_21867
VGHESSLDPRRQQGERKTRDLHSMPFSFLVVTPCKWRLG

SEQ ID NO: 113553 - protein, 31 aa, Glycine max
  Coding DNA Sequence Number=SeqID_21868
MVSALSSSDAYVESTSKDEKESSSDATRNPR

SEQ ID NO: 113554 - protein, 97 aa, Glycine max
  Coding DNA Sequence Number=SeqID_21869
MEKFDKMNFKEKKEKKGYITWEDNVINYSSDSEKKIISLGIMMKDYENGEEQNNKTKATFSPKKSEYAIYGDNKQRPLDQQPQQVISNDTNRSLVFD

SEQ ID NO: 113555 - protein, 271 aa, Glycine max
  Coding DNA Sequence Number=SeqID_21870
NRKVSPHAIRPSSHDNRSETFSRSRPEDANISRKDANDHIGADNHKVCPCATGPLGHDSRIETFSRSRPEDADISGKGVDNHKVCPRATGPLGHDSEIETFSRSRPEDADIFGKGADDHIGANNHKVCPRAIGSLGQDSKIETFLQSRPEDADISGKDANDHIDPWVTIAKLRLFRGLGRKTLTSPGRVTKGANNHKVCPRAIGPLGHYSEIETFTWSWPKGADISGKGADDHIGLCVSIGLGGADNRKVSSCAIGLSGHRIAKSVCEWPS

SEQ ID NO: 113556 - protein, 158 aa, Glycine max
  Coding DNA Sequence Number=SeqID_21871
  Pfam annotation: Domain name=G-patch; Domain location=1-42; Score =12.3; E_value=0.0062; Accession=PF01585.14; Description=G-patch domain
MVARVMLRNGFEPGMGLGKDCLENADVVDIKGNPYKYGLGYEPGMPGRRNVPSRFWADRVWPGRISQCFTSTGMVSEEEVAAIEEEFPQDPPSFVQPGHPDSQVGNWRVISQSEVYTADSIYEGRFFEDPNNEGLTIDFDRDISQTINEEEEEDVGIL

SEQ ID NO: 113557 - protein, 160 aa, Glycine max
  Coding DNA Sequence Number=SeqID_21872
MPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSAPSPESNPNSPSPVTTMVGHYPTIESDRAEFE

SEQ ID NO: 113558 - protein, 149 aa, Glycine max
  Coding DNA Sequence Number=SeqID_21873
  Homolog annotation: Hit_ID=A5AWL4; Match level="QueryCoverage=83%, HitCoverage=20%, E-value=2e-07, Identity=29%"; Hit description =Putative uncharacterized protein
  Pfam annotation: Domain name=zf-CCHC; Domain location=77-94; Score =21.2; E_value=0.00095; Accession=PF00098.14; Description=Zinc knuckle
MELQRLNQNEETDKKKRSIALKASSSIQEGNEEEDSDDEEDFSFFVKKFLKFAKRRRIERRQNFNNGRRLQEDSQVLICYKYNQLGHIKANCPSNEEWPEKSDKKRYDERRTKKAYIAWDNNDSSDGSEKEINLLTKDYKSDENISQEV

SEQ ID NO: 113559 - protein, 246 aa, Glycine max
  Coding DNA Sequence Number=SeqID_21874
MAKFDPNIVLEFTLMLGPRRRAYRTCDALNQFLGDPLVLEEGQECEFSQRRNRADGFDEEAIAQLLCIPGQDFAWTAVGRRVQIMRTGMTTLTQMWMMLLLSNVLPSDLNSDLPLPKCQLVYAILTQMSVHVAQLIADAIYLFAGMPPTWHPLDPDKSNRALGFPALITGLCPSFGVPVTPSKVIRPPITRAFIEKYCTPRQAQGDAPQVADALPPPHQADPAGSFGMERYLQHLVRQQAANHMGQ

SEQ ID NO: 113560 - protein, 222 aa, Glycine max
  Coding DNA Sequence Number=SeqID_21875
  Homolog annotation: Hit_ID=A7UQU7; Match level="QueryCoverage=67%, HitCoverage=26%, E-value=8e-17, Identity=36%"; Hit description=IMP dehydrogenase/GMP reductase, putative
  Pfam annotation: Domain name=DUF1723; Domain location=123-172; Score =46.9; E_value=7e-11; Accession=PF08330.1; Description=Protein of unknown function (DUF1723)
MAEDVPQMIEDVPHMTDDVPQMSEDVPQMTADVDATVAEDLGHDGAEGSHADEGFPGGPCDPSVLTSFAEHVAHAIWTGHERPELKLVSNRRKVTLIGRPVPEIEGLVAATGLSQLIGCSVVTSDPRLIFAFMERWHRETDTFHLLVGELTITLDNVSSLLHLPISGAFHSFEALSVDEAVFLLMELLEVSSEEARAETVRACGAYVHLSWVREIYEMRCQA

SEQ ID NO: 113561 - protein, 59 aa, Glycine max
  Coding DNA Sequence Number=SeqID_21876
MEYLLVGDEQKRKTESKNAKKDDPRAANSSIPWVWLLKGGKEVFERVARPGEHSSPRRA

SEQ ID NO: 113562 - protein, 48 aa, Glycine max
  Coding DNA Sequence Number=SeqID_21877
TYLLLEVASPLSLPSPFRCHLSSKKQMNPLMKKILGLQAPMELTSMRL

SEQ ID NO: 113563 - protein, 165 aa, Glycine max
  Coding DNA Sequence Number=SeqID_21878
  Gene Ontology: Mol. function=protein serine/threonine kinase activity; Cellular component=plasma membrane; Biological process =protein amino acid phosphorylation
  Homolog annotation: Hit_ID=A7Q0P3; Match level="QueryCoverage=50%, HitCoverage=13%, E-value=1e-34, Identity=86%"; Hit description =Chromosome chr7 scaffold_42, whole genome shotgun sequence
MRKEKIPHQAPFAIQAAQLLGRAIGAGLFAITPAGERGMCCKAIKLEKPRIESAVSAVGSLPHPTSTRFIAYEELKEATNNFEPASVLGEGGFGRVYKGVLNDGTAVAIKRLTSGGQQGDKEFLVEVEMLRGTELEFVIMVIAVSCVKLLSAHNSTQHTSRKHKV

SEQ ID NO: 113564 - protein, 174 aa, Glycine max
  Coding DNA Sequence Number=SeqID_21879
  Homolog annotation: Hit_ID=A8Q5G4; Match level="QueryCoverage=72%, HitCoverage=92%, E-value=1e-50, Identity=77%"; Hit description =Senescence-associated protein, putative
VDSRGSHQYPVAYLSRLQRILPAARWELRFKASRRANPPHEGHQRHGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPT

SEQ ID NO: 113565 - protein, 156 aa, Glycine max
  Coding DNA Sequence Number=SeqID_21880
  Gene Ontology: Mol. function=hydrolase activity, acting on glycosyl bonds; Cellular component=cytoplasm; Biological process=base -excision repair
  Homolog annotation: Hit_ID=A8G7T4; Match level="QueryCoverage=100%, HitCoverage=83%, E-value=3e-75, Identity=85%"; Hit description=DNA-3- methyladenine glycosylase I
  Pfam annotation: Domain name=Adenine_glyco; Domain location=8-156; Score=282.1; E_value=1.1e-81; Accession=PF03352.4; Description =Methyladenine glycosylase
MFDERCGWVTADPLYLGYYDQEWGAPTTDARELFEMLCLEGQQAGLSWITVLKKRENYRRAFHGFDPQRVAAMTEQDVENLLQDSGIIRHRGKIEAIITNAKAYLAMEAAGENFVTFIWDFVGGRPQLNRWQALNQVPAKTEQSDAMSKALKKRGF

SEQ ID NO: 113566 - protein, 109 aa, Glycine max
  Coding DNA Sequence Number=SeqID_21881
  Homolog annotation: Hit_ID=B0HC01; Match level="QueryCoverage=28%, HitCoverage=65%, E-value=1e-09, Identity=100%"; Hit description =Putative uncharacterized protein
MPRQGSGAYGKTPATRPFTVPGLLLAFCSHVFLRYPLILWITVLPPLSELIPLAAAERPSAARNSYDHDYEFELGTRIGTHKPIHSSMGVGEHYVSLALFNDNSISPSF

SEQ ID NO: 113567 - protein, 85 aa, Glycine max
  Coding DNA Sequence Number=SeqID_21882
STLEDPPAPSGLVAKDRSRVALYVRFKVDGDYDATVGGGGRGEPGGVAIVEAMTSKIILMMPKNPELSKFQRIRSQKASRIKIQE

SEQ ID NO: 113568 - protein, 300 aa, Glycine max
  Coding DNA Sequence Number=SeqID_21883
  Homolog annotation: Hit_ID=UPI0000660385; Match level="QueryCoverage =45%, HitCoverage=94%, E-value=2e-09, Identity=26%"; Hit description =Homolog of Homo sapiens "PREDICTED "similar to MGC52970 protein
LKELESRMEESELQANKERETSKELREELIMYKKEAMEHHEKGFNKAASGEEEDAEEQGDGRHDKNAVFDGVGSKTLLKWRQDFGNVGGKAMTKDLFALGFDKPVELHQGLPRIDLGFCEPVRLIKTYQGRTLGFVSCWRIEIHQGWTLGLTSLVYVEPMSYSCIHVTSWSDMVACSYIHVTCGMTCTGDMVACSCIRVTCGVAHTGDIVVACSCIRVTCEMTHTEDMVACSCICVTYGMARTGDVVVCFCIRVTCGMTSTGDVVECFCIRVTCGMTHTGDMVSCSCICGTCEATRTGDM

SEQ ID NO: 113569 - protein, 219 aa, Glycine max
  Coding DNA Sequence Number=SeqID_21884
MKADMEALKDQMTSMMEAMLSMKQMMESNAAAIAATSATIEADPTHPSAINQANQPIPDIVAQGGEECVHLWLTPPNYTPPTMHMPNENANHAVPVTFEGQQPQPIGGTHEEPQDHAQVDFEPYPAFATERPTCSVEGREKLDLIKEKLRVVERFGDYPFADMAELCLVPDIVVPLKFKRREALDAFLSRKLGRSGGHLVYKSRSFLNSLMEGLDTYLH

SEQ ID NO: 113570 - protein, 215 aa, Glycine max
  Coding DNA Sequence Number=SeqID_21885
MGVTRVNIPSEVNYQGLGFAQALVSRLHAHLLLSLPCTINLKHALVYHSLKQLLYRRACFHVMHCPRVYQTRISLMPIKGNHARFVQGPQYKPPRGYHILHLLRPLRSTLLHRINRRSPMIGKGICLYVWIVLLECQPPRVNQTLDLMFEGHTLFYRMPWDTPMISAGCVGVVPSKERRLVNFIGGHHRHLVGDQGWQQVRVRHQNRGEFCKFLH

SEQ ID NO: 113571 - protein, 38 aa, Glycine max
  Coding DNA Sequence Number=SeqID_21886
MEDLCLVPDMVIPPKFKVNGKGMEKEEREETPLHGDTT

SEQ ID NO: 113572 - protein, 353 aa, Glycine max
  Coding DNA Sequence Number=SeqID_21887
MAESHIRGLDWLAKLKVVSEESFEAPEEDEEVQALKSELGKAKLAKERFKLAATHIRKECAGLREENETTTRALEQETKRARKEEYGRNKFCGALWGSNSELKLRREEMDQSRAHSMVLKEELVACSMSKRSLSQRLCETETNMLAIIAKYQEELGLATAHERRVADEYAQVYAEKEARGRVINSLHQEATMWMDRFALTLNGSQELPRLLANAKAMADTYSAPEEIHGLLAYWKNIITKRATRHPYRTRSKSRTMGDQEETQEQMKADMSALKEQMASMMEAMLGMRQLMEKNVATAAAVSSVAEADPTLLATAHHPPSNIVGRGKDTLGHDGSPHLGYNRAAYPYGLPPNY

SEQ ID NO: 113573 - protein, 113 aa, Glycine max
  Coding DNA Sequence Number=SeqID_21888
MTVWVEDRLTKSAHFIPEVDAQVPRSPYQILKKWACSLSYRLTSEFTSRICILWFHVSQLNGQPRSITYTCSGRGTGEDNLTYKAQPQKITDRRMKSLRGKEIALVKVQWGNG

SEQ ID NO: 113574 - protein, 60 aa, Glycine max
  Coding DNA Sequence Number=SeqID_21889
MTSYRGLEQLGASYGQSGRRWRNNYVPWVRSLLEEQLTYFQEGYDPEVLSLAEEIEKIFR

SEQ ID NO: 113575 - protein, 93 aa, Glycine max
  Coding DNA Sequence Number=SeqID_21890
MIDLILALKDRDMWIEDLVPILELFPFLLNHRCLYPKKWERKLQYGRQMNLGVQNPLQLMKLGQLFLRMVYGHFDQVFKSFVLVIPKGTYMNT

SEQ ID NO: 113576 - protein, 76 aa, Glycine max
  Coding DNA Sequence Number=SeqID_21891
MATARWALKHPFYGIVILRLGIYTNRPKNMNLGIPGHVAPHATGLLGHGNKKWGGRQKQGFCSYVSSTCDEELGPT

SEQ ID NO: 113577 - protein, 335 aa, Glycine max
  Coding DNA Sequence Number=SeqID_21892
MLAIIAKYQEELGLAAAHEHRIADEYAQVYAEKEARGRVIDSLHQEATMWMDRFALTLNGSQELPRLLAKAKAMADTYSAPEEIHGLLGYWKNTITKRAAKDPYRTRSKSRTMGDQEETQEQMKADMSTLKEQMASMMVAMLSMKQLIEKNAATAAAASSAAEADPTLLALRHHPPLKHSRTGKGTHWGTMAALTWDYNRAAYPYGLPPNYSPPILQEDAGHIASPVHEKEPPQQPDEVHKDPQDYARRDFEFYPPIPEGPAPGTLPQPNIAASPIVLSMEGPPPATEERRKLDLLEERLRVVEGFGDYPFADMTDLCLVPDVVIPPKFKVPDFD

SEQ ID NO: 113578 - protein, 240 aa, Glycine max
  Coding DNA Sequence Number=SeqID_21893
  Gene Ontology: Biological process=transposition, DNA-mediated
  Homolog annotation: Hit_ID=Q1J7G7; Match level="QueryCoverage=12%, HitCoverage=42%, E-value=6e-10, Identity=100%"; Hit description =Transposase
LPGINRDTRIYFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIVREKRDTKDFRRKKKKKFKEIQKSIGKRGARYQLLFPLVRVNFELGVIMVIAVSFGKPVVPAALMNRPTRGERRFAYWALAECILAYYVGTDEGVSEVLHVAGEKRLH

SEQ ID NO: 113579 - protein, 196 aa, Glycine max
  Coding DNA Sequence Number=SeqID_21894
MAKFDPDIVLEFYANAWPTEEGVRDMRSWVRGQWIPFDADALSQFLGDLLVLEEGQECEFSQRRNRADGFDEKAIAQLLCIPGQDFARTATGRRVRIMRTCMTTLTQMWMTLLLSNVLPNDDNSDLPLLKCQLVYAILIRMSVHVAQLIADAISLFAGMPPTRHPLDPDKSNRALGFPGLITGLYQSFGVPLTPSK

SEQ ID NO: 113580 - protein, 64 aa, Glycine max
  Coding DNA Sequence Number=SeqID_21895
MKKQQWKRSGRQRRRGERRRHPLGNKPWKKELHHQDEPWRGCFNGGKEREKGEHEIEGRKRERS

SEQ ID NO: 113581 - protein, 83 aa, Glycine max
  Coding DNA Sequence Number=SeqID_21896
MAMISPEKIYQPFFPKWYDPNATCAYHGKTPGHSTKKCLALKYKDRPNVKTNPLANHGGGAVNAIESGRPRRSKPLKDVTTPR

SEQ ID NO: 113582 - protein, 68 aa, Glycine max
  Coding DNA Sequence Number=SeqID_21897
MSILSISFNIVTVVYGINLEILMSHNNSFQNCPIPCTYASEPYNAQWNAPGLLRDNTRAFESYLEKWR

SEQ ID NO: 113583 - protein, 185 aa, Glycine max
  Coding DNA Sequence Number=SeqID_21898
  Pfam annotation: Domain name=zf-CCHC; Domain location=66-83; Score =12.7; E_value=0.019; Accession=PF00098.14; Description=Zinc knuckle
MKESLKRITLTSPYFNRKENVEAYLRLGNKGLGILRAAPSKPKDDKGKTIEKQPPKASMQEKTSSIKCFKCLGTRHITSQCLTKKTMIMRSQDIYSSQYKATTSPSSSESEEAKGEESSEEIYPQEEGQPLMFKEKCKETLVSIATPLGLEFIPQVKELLDAGLVRKSLNPCALLVPKIVIKGFP

SEQ ID NO: 113584 - protein, 374 aa, Glycine max
  Coding DNA Sequence Number=SeqID_21899
  Homolog annotation: Hit_ID=Q2HW90; Match level="QueryCoverage=78%, HitCoverage=57%, E-value=3e-35, Identity=33%"; Hit description =Putative uncharacterized protein
MGSVLIPAVNQPTEGPCRLRIYVRWGISLPVDVVSKKGTNSPDPRIRKLHLCHMHFFRHSSIPPMRYRSFDLHQLLSHFTFRKTYGKILELTIAEVSIEAIASLTQYYDQPLRCFTFGDFQLVPTIEEFEEILGCPLGGRKPYLSSGCLPSLSRIATMVKDSARGLDRIKQTRNGIAGLPTEVPRRQSEGYGQSRRMVPFMDVLALLIFRVVLFPNVDGLVGLAAIDAFLAYHHSKESPVVAVLADLFDTFDRRCEKSSARIICCLPALCVWLVSHLFQQDTRHPCPLLSHRSCTEKRRMDWDQLLAGIGSRTISWFPRWKEGKEGVLFSCGRYPNIPLVGTRGCINYNPTLAIRQLGYPMRGASTEESMSPFL

SEQ ID NO: 113585 - protein, 189 aa, Glycine max
  Coding DNA Sequence Number=SeqID_21900
MHNSSFFEILPHAQQRSVALSRRLASQQIGLARRGNAQNQKRLSDNEGSRHEGMLNGMYLNLNGCSLDQLQVHWGDEETAMMGHKMQCRGGGRGQFLVEPIIRLIKVILVASTLTSFTGSGVIQTFVACIKRSAPTQTYQGNPCGVYPDLSSFTGSGVYPDLSSFTGSGVIQFPVACIKRSAPSQVHIN

SEQ ID NO: 113586 - protein, 125 aa, Glycine max
  Coding DNA Sequence Number=SeqID_21901
  Subcellular localization annotation: CTP_CleavageSite=51; ConfidenceScore=5.13e-01
MTGTKSRDSRRGTLPFLFEKPYQPTISHFSGLLISQKSSREVGAVKSTSSTSMEEQQVGCCSVKDSGSINRMGCSLLSPNPLLYSEKIDHLFRASKGHEEQNCFQVRVCAASLSICNGSKYARNI

SEQ ID NO: 113587 - protein, 237 aa, Glycine max
  Coding DNA Sequence Number=SeqID_21902
MRGAPTEESMSPFLVRDFGAQNSKTIQRIHKAWETPLKKDQELRGIRNGIIGGTGRGRRVQALKSELGKAKLAKEKFKLAATHVRKECAGLREENAITARALERETKRARKEEYGRNKFRGALWGSNSELKLRREERDQSRAHGMVLKEELMTCSRSKRSLSQRLCETETNMLAIIAKYEEELGLATTHEHRIADEYAQVYAEKEARGRVIDSLHREATMWVGRFALTLNGSQELPR

SEQ ID NO: 113588 - protein, 114 aa, Glycine max
  Coding DNA Sequence Number=SeqID_21903
  Subcellular localization annotation: CTP_CleavageSite=74; ConfidenceScore=5.37e-01
MRTAFICAALQPPSLLTSSPGHHVATGSFPFANMFAAGLVDKPSGGRHVLQRLGPGRPTRLDDINRSPSMIGKRAIHYSVEWPRVFPWCAQLCQGYTTLGKEAGRSFPGDITAI

SEQ ID NO: 113589 - protein, 161 aa, Glycine max
  Coding DNA Sequence Number=SeqID_21904
  Homolog annotation: Hit_ID=Q84VH5; Match level="QueryCoverage=95%, HitCoverage=22%, E-value=6e-46, Identity=64%"; Hit description =Envelope-like protein
  Subcellular localization annotation: CTP_CleavageSite=21; ConfidenceScore=5.27e-01
MATAPKETSAPGSSSVPSSPSSTKAPSHQERPEFNIQPIQMIPGSAPVPEKLVPKRQQGVKISENPSPATSPREVDPEMDKKIRSIVSSILKNASVPEADEDVPTSSTPNVSVPDVDKDVPTSSAPNAEALPSPSEEESTEEEDHATEKTPAPPRTRTCSR

SEQ ID NO: 113590 - protein, 33 aa, Glycine max
  Coding DNA Sequence Number=SeqID_21905
MIMSEEAKREESSEEIYPQEEGQPLMIKEECKE

SEQ ID NO: 113591 - protein, 187 aa, Glycine max
  Coding DNA Sequence Number=SeqID_21906
  Gene Ontology: Mol. function=sequence-specific DNA binding; Cellular component=intracellular; Biological process=regulation of transcription, DNA-dependent
  Homolog annotation: Hit_ID=A4WEF0; Match level="QueryCoverage=99%, HitCoverage=62%, E-value=2e-86, Identity=87%"; Hit description =Transcriptional regulator, AraC family
  Pfam annotation: Domain name=AraC_N; Domain location=1-68; Score= -36.8; E_value=1.2e-05; Accession=PF06719.4; Description=AraC-type transcriptional regulator N-te
  Pfam annotation: Domain name=HTH_AraC; Domain location=135-179; Score= 33.2; E_value=9.3e-07; Accession=PF00165.14; Description=Bacterial regulatory helix-turn-helix proteins, araC family
  Pfam annotation: Domain name=HTH_AraC; Domain location=83-129; Score =43.0; E_value=1.1e-09; Accession=PF00165.14; Description=Bacterial regulatory helix-turn-helix proteins, araC family
  Pfam module annotation: Pfam domain module=AraC_N::HTH_AraC::HTH _AraC; Domain location=1-68::135-179::83-129
MEIGEDELFQPSMASSGINSATLSEEILCAIERLLDVMERPLDARILGKQIIREILYHVLLGPGGGALLALVSRQTHFSLISRVLKRIESQYTENLSVDQLAAEANMSVSAFHHNFKSVTSTSPLQYLKTYRLHKARMLMIHDGMKASAAAMRVGYESASQFSREFKRYFGVTPGEDASRIRTMQGA

SEQ ID NO: 113592 - protein, 47 aa, Glycine max
  Coding DNA Sequence Number=SeqID_21907
MDFMVTTKEPEFLRDVDGTEHSSNSIEQDGVSASNSKNFNSVAAELI

SEQ ID NO: 113593 - protein, 76 aa, Glycine max
  Coding DNA Sequence Number=SeqID_21908
IVRHQIPMIGGMMNMLSGATLFCKIIHASNIFMIHIHRDSLGVEGRSLEYQEPLDLRSNPFQGGGDDAIQPPKGIG

SEQ ID NO: 113594 - protein, 209 aa, Glycine max
  Coding DNA Sequence Number=SeqID_21909
  Gene Ontology: Mol. function=binding; Cellular component =intracellular; Biological process=biosynthetic process
  Homolog annotation: Hit_ID=B0IS11; Match level="QueryCoverage=100%, HitCoverage=31%, E-value=8e-92, Identity=74%"; Hit description =Putative conserved hypothetical TPR repeat protein
MKLMQRVLELHDRDKFEIVLFDHSRPYALLNNKTDRSKWGTIVDIHGVSDQEVLRLVREHNIDIMVDLKGHTADSRANSFNIPLAPVHVAWLGFPGSTLGIDLDYVIGDHLVLPDVAKPFYHEKFCRMPESYQPNDPSNRPQPKPVTREQYGLADDAFVFASFNGNRKITPEAIASWTRILKRAPNSVLWLMSNSPRNEENLRKAFRAS

SEQ ID NO: 113595 - protein, 95 aa, Glycine max
  Coding DNA Sequence Number=SeqID_21910
NLQDSGTLKRVAWGLDVGTRVLLSEFDIVYVTQKAVKGSALADYLAQQPLPDIGRCTPSFQMKISWPYVEEKQTHEDIDKWIVCFDGHPMLWATK

SEQ ID NO: 113596 - protein, 43 aa, Glycine max
  Coding DNA Sequence Number=SeqID_21911
MQGSCMSEHDMQTMKIECMQLSYPNFVRGPLLDDMRPFFGPCE

SEQ ID NO: 113597 - protein, 148 aa, Glycine max
  Coding DNA Sequence Number=SeqID_21912
MGTNPNRKRFYQVKVKGLDVTSLKELGRLMGPLQRQAFRKVYGKILDLAAAAVIGDSAKELDRMKQTHNGIVGLPQKYLEGKARDMASQEKWGPLADILALLIFGVVLFPNVDGLVDLAAIDAFLAYHHSKESPVVAILADLFDTFDR

SEQ ID NO: 113598 - protein, 196 aa, Glycine max
  Coding DNA Sequence Number=SeqID_21913
  Homolog annotation: Hit_ID=A0ST23; Match level="QueryCoverage=13%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLCEAVSGWLWQKGQSSVSISTCLLDKLTLVGSLSQSNLQANVKALGGILIIKLIDTVDLEGGPVGKPVVPAALMNRPTRGERRFAYWALAECILAYYVGTDEGVSEVLHVAGEKRLH

SEQ ID NO: 113599 - protein, 86 aa, Glycine max
  Coding DNA Sequence Number=SeqID_21914
MGAKYLEVVKRGSHPNNGWSPDEIRTQNDHNLSLRFIGNDRAWATRYKMTIICLCMPPDTIASGWRKGARNDHNLSPPTSRLTVFE

SEQ ID NO: 113600 - protein, 103 aa, Glycine max
  Coding DNA Sequence Number=SeqID_21915
MTLPNIITAIQSSITDNGVTPIINALWYRYPVYQFNGEVQYRAIQIIDEEGVLFMFHTFLNMTSVICMKLKVDVHNSLSPTQVNDLSWADMEQKLENTLKLDE

SEQ ID NO: 113601 - protein, 114 aa, Glycine max
  Coding DNA Sequence Number=SeqID_21916
MTVTRVRKECDVLRDVKMTMVKALERATKRARKEEWSRNKFRGALWGSSNELKLRRAERDESRLESMEKVNLATSHRQRLEDERTCEGIDSANGKGSKREGDRIIAQGSYEMDG

SEQ ID NO: 113602 - protein, 98 aa, Glycine max
  Coding DNA Sequence Number=SeqID_21917
MEKCLVKRKTKFREDPTVNEGWAAFLPMQLHIYISGCYTASGGGLGDMTPVEARNLIEKMASNSQQFSARNDAIVLRGVHDVATDSSSSVENKKLEGK

SEQ ID NO: 113603 - protein, 127 aa, Glycine max
  Coding DNA Sequence Number=SeqID_21918
MSISPCGSISWSMSFRHRDRIHKTPSGPGEVQQGLGVSSSGYGPLLVLQGARSPQQGIAPARHPVDSEKSNRVLGFLALITDLFLFYGVPVAPSKVIRPPTNRAFIKKYCAPRQAQGKTPQQHWDGR

SEQ ID NO: 113604 - protein, 26 aa, Glycine max
  Coding DNA Sequence Number=SeqID_21919
MWLKGVKTPMMNALSRPSRAKRVYPY

SEQ ID NO: 113605 - protein, 93 aa, Glycine max
  Coding DNA Sequence Number=SeqID_21920
MTGFLQFSRCFPQINGCGDSAHFPPLEDALVSLALLTRKRVGCDTMKSGFYSRCLETFKPNDAQDSSLLGGGAIKFDGMGKCRGCSTLSLSRH

SEQ ID NO: 113606 - protein, 129 aa, Glycine max
  Coding DNA Sequence Number=SeqID_21921
MLSAVIRSALGYPAFTVGTITGTPEVRPSRSSRTRERSWHKVRILALPEWYLTDGSGPPQKEAFFALHLSCAGKAQSQSQETVKLHRVFLSRCSRPGLVTATPFVRRHPFSRSYGAILPSSLERVVSRL

SEQ ID NO: 113607 - protein, 113 aa, Glycine max
  Coding DNA Sequence Number=SeqID_21922
MSASDHAILRDRTHQPMKKSLIELSLHDALLAENKLLSKQLEILTETLGCTICGEAHETGQCTPTKENTQEIYYMRNKQQQGYTQGGFLGFQQGPYNQQGQWRTHPGNQFNKD

SEQ ID NO: 113608 - protein, 80 aa, Glycine max
  Coding DNA Sequence Number=SeqID_21923
MAVQARQVFYVEDPSDPTWSVVIQGRKFDMIDYSHYPPFDVTDMPPVNDQIPVIEATEEDDVEHAMRHDHHEGLWENNDT

SEQ ID NO: 113609 - protein, 150 aa, Glycine max
  Coding DNA Sequence Number=SeqID_21924
  Gene Ontology: Mol. function=structural constituent of ribosome; Cellular component=ribonucleoprotein complex; Biological process =translation
  Homolog annotation: Hit_ID=A4GYN8; Match level="QueryCoverage=59%, HitCoverage=65%, E-value=3e-43, Identity=98%"; Hit description =Chloroplast 30S ribosomal protein S12 B
  Pfam annotation: Domain name=Ribosomal_S12; Domain location=15-146; Score=157.0; E_value=5e-44; Accession=PF00164.16; Description =Ribosomal protein S12
MGQILQDQTLWELRNDGRKEIKKKWDKRIDREKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGRSSACRFLSKTCII

SEQ ID NO: 113610 - protein, 128 aa, Glycine max
  Coding DNA Sequence Number=SeqID_21925
  Subcellular localization annotation: CTP_CleavageSite=32; ConfidenceScore=5.17e-01
MASRKRKAPTSVSQARYDNQNLYPKMPGTATQTMSLAGGSFQKGMREIERRNWHKELTNFSEGSINVALVKEFYANLYDLEDKSPKQTPVVIEEEESLPSYSRFCKLRPDSQELAAHLIEVVPESNKH

SEQ ID NO: 113611 - protein, 66 aa, Glycine max
  Coding DNA Sequence Number=SeqID_21926
  Homolog annotation: Hit_ID=A3M8C2; Match level="QueryCoverage=87%, HitCoverage=14%, E-value=9e-22, Identity=82%"; Hit description =Putative uncharacterized protein
YGAQFSDDGTDYAKAYAAGNEKVQQAWLNVIYTPVKPIDLGVEYVNGKRDTFDVKHHKKIVVVQDA

SEQ ID NO: 113612 - protein, 213 aa, Glycine max
  Coding DNA Sequence Number=SeqID_21927
  Homolog annotation: Hit_ID=Q2HW90; Match level="QueryCoverage=94%, HitCoverage=57%, E-value=3e-24, Identity=30%"; Hit description =Putative uncharacterized protein
QAFRKVYGKILDLTTAEVFTKAAVSLAQYYDQLLRCFTFGDFQIVPTVEEFGEILGCPLGGRKPYLFSGFLPSLSKIAAVARDMASQEEWVPFADIQALLIFGVVLFPNVDGLVDLAAIDAFLAYHHSMDCLLFTHYLCVVGFAPIPTRHKAPEGKEGVLFSCGDYPNVPLIGTRGCINYNPALAIRQLGYPMRGAPMEESLSPFLVRDFGAK

SEQ ID NO: 113613 - protein, 67 aa, Glycine max
  Coding DNA Sequence Number=SeqID_21928
FFKGKVAEEPQLFAVSGAVVVVAAGLVEERMIWVEPGFNQGSEFLQAHANIFTSDEDELRGLLQCTP

SEQ ID NO: 113614 - protein, 130 aa, Glycine max
  Coding DNA Sequence Number=SeqID_21929
GCKSLSEELRDYYEGRHRSDLRTHSHGREKERKPQEANINLSYFHGKDNVEANLDWEIRVEQQLKRKSTSKFYGSHSYPKKDQGQGILGEHITSHAHQENHDYEGPRTFYSSQDEATTSPSSSESKEAKG

SEQ ID NO: 113615 - protein, 213 aa, Glycine max
  Coding DNA Sequence Number=SeqID_21930
  Subcellular localization annotation: CTP_CleavageSite=29; ConfidenceScore=5.22e-01
ADESTRAIAQLLCTLGQDAARTAAGRQVRIMRTSMTTLTQTWMTLLLSNVLPSDHNSNLPLLKCMPPTKHPLDLDKSNRSLGFPALITGLYQSFGVPVTPNAPPPPHQADPVGSLGMERYIQHLVRQQAANHRGQVQIHKCLYRFSLSQQGQGFAPFACSTPEQFGAEVAWPGDWLEAQAGEEPAGSPGAAEEARMDEEMTDLLGFLGGSGAT

SEQ ID NO: 113616 - protein, 124 aa, Glycine max
  Coding DNA Sequence Number=SeqID_21931
MGVVMGDTEDPPMCFAGVYHQLLALQWHIRGKTPSRLDCGGEFHVSPPWVERHRKTQGSCMSKHENKRQESPKNYLFLLAHSGMQCPMCVVKKVIWTFRLPVTKDETNIQHMRDDMMQMRKGIL

SEQ ID NO: 113617 - protein, 143 aa, Glycine max
  Coding DNA Sequence Number=SeqID_21932
  Gene Ontology: Mol. function=binding; Cellular component=Golgi stack; Biological process=protein amino acid phosphorylation
  Homolog annotation: Hit_ID=A5AWF6; Match level="QueryCoverage=99%, HitCoverage=70%, E-value=3e-40, Identity=31%"; Hit description =Putative uncharacterized protein
  Pfam annotation: Domain name=PPR; Domain location=24-58; Score=16.3; E_value=0.09; Accession=PF01535.11; Description=PPR repeat
  Pfam annotation: Domain name=PPR; Domain location=59-93; Score=32.4; E_value=1.7e-06; Accession=PF01535.11; Description=PPR repeat
  Pfam annotation: Domain name=PPR; Domain location=94-128; Score=26.5; E_value=9.8e-05; Accession=PF01535.11; Description=PPR repeat
  Pfam module annotation: Pfam domain module=PPR::PPR::PPR; Domain location=24-58::59-93::94-128
MKHYSTAVSLSHRLELKGIQPDFFTLNILMNCFCHMGQINFGFSVSAKILKRGSPPHTITFTTLIKGLCLKGQVNKALHFHDKLLAQGIKFDQVSYGTLINGVCKIGDTRGAIKLVRKIDGRLTKPNVEMYNTIIDALCKYQL

SEQ ID NO: 113618 - protein, 292 aa, Glycine max
  Coding DNA Sequence Number=SeqID_21933
  Homolog annotation: Hit_ID=Q84VH5; Match level="QueryCoverage=84%, HitCoverage=40%, E-value=1e-113, Identity=78%"; Hit description =Envelope-like protein
ESTEEEDQATEETPAPRAPEPAPGDLIDLEEVESDEEPIANKLAPGIAERLQSRKGKTPIKRSGRIKTMAQKKSTPITPTTSRWSKVAIPSKKRKEISSSDSDDDVELDVLDIKRAKKSGKKVPGNVPDAPLDNISFHSIGNVERWKFVYQRRLALERELGRDALDCKEIMDLIKAAGLLKLSPMFVRGKCIRFSPAVINKYLGRPTEGVVDIAVSEHQIAKEITAKQVQHWPKKGKLSAGKLSVKYAILHRIGTANWVPTNHTSTVATGKAAASGAVSKDDLIAELKDTCK

SEQ ID NO: 113619 - protein, 103 aa, Glycine max
  Coding DNA Sequence Number=SeqID_21934
MYPPLFSLNNLVDVPSTRTDPQEMYPLLFLVNNPSRFTLYLYNKGCTLQCVKTKFSGEGDEDPLPDVDSLEDVMSASEADSTKESGPGGTATSGDSSSWQTAP

SEQ ID NO: 113620 - protein, 137 aa, Glycine max
  Coding DNA Sequence Number=SeqID_21935
MATAEALERETKKARKEEHDQRKVLRGFIGPAIVSSSSEELSETEGNMWAIIDECKEKLNLAATHEQRLEDEYAKISTEREARERVIDSLHQEATMRMDRFALTLNRSQELPRLLAKAKAMADTYSAPKEIHRLLSY

SEQ ID NO: 113621 - protein, 143 aa, Glycine max
  Coding DNA Sequence Number=SeqID_21936
  Homolog annotation: Hit_ID=Q6UUU1; Match level="QueryCoverage=41%, HitCoverage=40%, E-value=1e-18, Identity=78%"; Hit description =Putative uncharacterized protein
MTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRYQAFPPGGSLVRSLFLPFGY

SEQ ID NO: 113622 - protein, 51 aa, Glycine max
  Coding DNA Sequence Number=SeqID_21937
MSGLDARMVEHKLPLKPKCPPIKMEEEDREKTACITSWGTFDAILLRKGIG

SEQ ID NO: 113623 - protein, 66 aa, Glycine max
  Coding DNA Sequence Number=SeqID_21938
MTSTDQVWSFCTHDTRRYLMVIRTHSFAIFFCTFCSSGNNKVIYMRKFHGRPRLSSTERSEISVIH

SEQ ID NO: 113624 - protein, 157 aa, Glycine max
  Coding DNA Sequence Number=SeqID_21939
MCPPLEKVKSKGAPKNPLIKQQKSTKRDLSYWEYIDVLHFVQNSNSSVKRNASSFEQPIQRQNIRMLDQFHMCIQDSIENIIDVKADGNCGYRGIAAVATYPSIGGRQQTHGCVFQERKMREVATNIYSRKTSEKLEKVWSTNFKCERFGSCIYARG

SEQ ID NO: 113625 - protein, 99 aa, Glycine max
  Coding DNA Sequence Number=SeqID_21940
MVIDYQRVKTLCYNNQSRCTLYSYHKGCTLQCVKTKFSGGKGRIKRILRLCHFEFFEKGEERHKRIQENKVWKPENSESFWQRKKKKKFKKMFKEIQRL

SEQ ID NO: 113626 - protein, 128 aa, Glycine max
  Coding DNA Sequence Number=SeqID_21941
  Homolog annotation: Hit_ID=Q5QJQ3; Match level="QueryCoverage=59%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLEVMRRLRLN

SEQ ID NO: 113627 - protein, 216 aa, Glycine max
  Coding DNA Sequence Number=SeqID_21942
  Gene Ontology: Mol. function=oxidoreductase activity; Biological process=electron transport
  Homolog annotation: Hit_ID=Q5WKG0; Match level="QueryCoverage=98%, HitCoverage=54%, E-value=8e-77, Identity=62%"; Hit description =Oxidoreductase
  Pfam annotation: Domain name=GFO_IDH_MocA_C; Domain location=38-149; Score=62.7; E_value=1.3e-15; Accession=PF02894.8; Description =Oxidoreductase family, C-terminal alphabeta domain
MAASLEECDAMIAAQKASGKMLSIIAQNRFTDAFWRLKAALDSELAGKVCHAQVDSFWWRGHCYYDLWWRGTWEKEGGGCTLNHAVHHIDAIQWMLGFPSEVVAMMTNVAHDNAEVEDLSAAIFKYPSGALTQLTASVVHHGEDQKIIIQGEKARISAPWQAFASVSADNGFPQETHDQQREAQLDAVFKQTPKLEWTLHAGQINDLLSAIEHGTA

SEQ ID NO: 113628 - protein, 141 aa, Glycine max
  Coding DNA Sequence Number=SeqID_21943
GVCHPDTDERHVAQVIADAIYLFAGMPATRHPLDPDKSNRALGFPALITGLFQSFGIPVTPSKVIRPPITRAFIEKYCTPRQAQDDAHQAADAPPPPRQADPAGSLGMEREEPAGSPGEAEEARMDEEMTDLLGFLGGSGA

SEQ ID NO: 113629 - protein, 47 aa, Glycine max
  Coding DNA Sequence Number=SeqID_21944
  Subcellular localization annotation: CTP_CleavageSite=9; ConfidenceScore=5.07e-01
MSPPPLKTSQSLKKTLSKLFKMPPLVLYGNPVSGLSLSVNLALSAHL

SEQ ID NO: 113630 - protein, 90 aa, Glycine max
  Coding DNA Sequence Number=SeqID_21945
MLNGTPRGFSMTSTRCVRVVGLGEMEVDEPWLGLLQRALRGRAKARLTGALSKGGKMRGVATNVYLWKTSEKPKETGQNENSKFRSCIYA

SEQ ID NO: 113631 - protein, 250 aa, Glycine max
  Coding DNA Sequence Number=SeqID_21946
  Gene Ontology: Mol. function=nucleoside-triphosphatase activity; Cellular component=exodeoxyribonuclease V complex; Biological process=transposition, DNA-mediated
  Homolog annotation: Hit_ID=Q6D8H8; Match level="QueryCoverage=35%, HitCoverage=14%, E-value=2e-12, Identity=47%"; Hit description =Exodeoxyribonuclease V alpha chain
DLPSQWLLFLSAVPPVQLLTGWCVTAKAPPDISAGKCSGRVPFAIQAAQLLGRAIGAGLFAITPAGERGMCCKAIKLGNARVFPEFDAICLLRKSYRFAAHSGIGQLAAAVNAGEAQAVEAAFQAGFSDIVRQPLNDAEAYQAMLTQIAEGYRPFLQLINQRAAPAEVIAAFGRSSLSIPSTSRGGPVPAFVPFSEVGKPVVPAALMNRPTRGERRFAYWALAECILAYYVGTDEGVSEVLHVAGEKRLH

SEQ ID NO: 113632 - protein, 80 aa, Glycine max
  Coding DNA Sequence Number=SeqID_21947
MTSSPQIVGKNNFIFPEWKAGRRRWTTSPAPHWRPALAKLTHRLERRLALRSVVDEGASELKRVFTISERMASKTARAME

SEQ ID NO: 113633 - protein, 204 aa, Glycine max
  Coding DNA Sequence Number=SeqID_21948
VEKFLKKYFPESKTAEGKAAISSFHQFPDESLSEALERIRGCTICGEAHELGHCIPIEEHTQEVHYMGNQQGQGYNQGGFQVSSKRTTKLEETLAQFTQVTMSNRKSIESTLKNLEIQVGQLAKQLAEKSSSSFGANTENNPKEECEAVMTRSRKLVAAEDKDVVALKEQFALKDTTDKKKNEVDGQRVGLPTGRLMLLKMFST

SEQ ID NO: 113634 - protein, 70 aa, Glycine max
  Coding DNA Sequence Number=SeqID_21949
  Homolog annotation: Hit_ID=A5BPN8; Match level="QueryCoverage=50%, HitCoverage=3%, E-value=2e-08, Identity=77%"; Hit description =Putative uncharacterized protein
MKKKCPKYAAWRVKKDKFLTLVCSEVNLAFVPKDTWVAYGADCQVMMKGSSLWVMARRLQWKLLKLLDYS

SEQ ID NO: 113635 - protein, 223 aa, Glycine max
  Coding DNA Sequence Number=SeqID_21950
  Pfam annotation: Domain name=Transposase_23; Domain location=2-51; Score=-15.0; E_value=0.053; Accession=PF03017.5; Description =TNP1ENSPM transposase
MGRVYEGSTVVHNTPLLPGQVKVSVEEVRDADAPVPVPTDEVSLVGQALHTFFAWPTHMVKSLSQVVVSPAKLPLKPDPEVDDLLYLMTLTIAELFLRPYQVRWDATVFGVVKSRFPPVHKAQRPLRNRTQWSMSQHISVTVVDSSSQHDVYLGAYLNGFHCSGHWQMVVILPKEHLVVWFCSLHNRPDNYLKGIINSAIKGLDDAPQPKSKASARWIVVKVV

SEQ ID NO: 113636 - protein, 176 aa, Glycine max
  Coding DNA Sequence Number=SeqID_21951
  Gene Ontology: Mol. function=oxidoreductase activity; Cellular component=integral to membrane; Biological process=electron transport
  Homolog annotation: Hit_ID=A8GKZ1; Match level="QueryCoverage=100%, HitCoverage=42%, E-value=9e-82, Identity=82%"; Hit description =HI0933 family protein
  Pfam annotation: Domain name=HI0933_like; Domain location=1-176; Score=58.5; E_value=1e-20; Accession=PF03486.5; Description=HI0933 -like protein
MFCAAQAGQLGRRVLLLDNGKKAGRKILMSGGGRCNFTNLYTEPAAYLSHNPHFCKSALARYTQWDFIDLVNRHGIAWHEKTLGQLFCDDSAQQIVDLLLKECEAGQVTLRLRSEVLSVARDDDGYTLQLNGSAVRADKLVIASGGLSMPGLGATPFGYKVAEQFGLRVHATRAAL

SEQ ID NO: 113637 - protein, 87 aa, Glycine max
  Coding DNA Sequence Number=SeqID_21952
MRRQNLVIPHPFAIQTQSCPMARRDKIWSFCTLLSSRGGGPDDMRRQNLIILHPFAIQTQSCPMRQNLVILHPLSSRGGGPMTCAEV

SEQ ID NO: 113638 - protein, 137 aa, Glycine max
  Coding DNA Sequence Number=SeqID_21953
  Pfam annotation: Domain name=zf-CCHC; Domain location=1-18; Score =21.5; E_value=0.00084; Accession=PF00098.14; Description=Zinc knuckle
MKCFKCLGRGHITSQCPTKKTMIMRGQDIYSSQDEATTSPSSSKSEEAKGEESSEEIYPQEEGQPLMVKEECKEVSVSSKSDQRVPMNPKRIKVIPEWLTPPSVEGRSPEYEEPRDLRSNPFQGGGNDAILPRKGIG

SEQ ID NO: 113639 - protein, 98 aa, Glycine max
  Coding DNA Sequence Number=SeqID_21954
  Subcellular localization annotation: CTP_CleavageSite=32; ConfidenceScore=5.07e-01
MFQKKICKIFKRKAKWSLLGHFSAPGPTRKLRDEVTSSPGRVRLLLEEASSSPGRAAVHEGAKEKGPTPEIKRFSVKLVRKRRKKKKNQGRGASVTFP

SEQ ID NO: 113640 - protein, 180 aa, Glycine max
  Coding DNA Sequence Number=SeqID_21955
MTTLTQIWMTLLLSNIQPSDHNSDLPLPKCQLVYAILTRMSIHVAQLIADAIYLFAGMAPTRHLLDPDKSNRALGFPALITGLFQSFGVPVAPSKAANHRAHVQTHDCLYQLSLSLQSQGFTSFPCPTPDQFRAEVAWPGDWPEARAGEAPAEAPDEADEAHEDEEMTDLLDFLGGSGAT

SEQ ID NO: 113641 - protein, 87 aa, Glycine max
  Coding DNA Sequence Number=SeqID_21956
  Subcellular localization annotation: CTP_CleavageSite=50; ConfidenceScore=5.47e-01
MATPCVFLPWKTHPDHCLMACNLCLTASRYLTPIVRFFTVLHRSSSFFVRSSSFFCLQPINGSGMEKEEREETPLQGEDESRRSSPP

SEQ ID NO: 113642 - protein, 78 aa, Glycine max
  Coding DNA Sequence Number=SeqID_21957
  Homolog annotation: Hit_ID=A0ST23; Match level="QueryCoverage=34%, HitCoverage=55%, E-value=2e-08, Identity=100%"; Hit description =Putative reverse transcriptase
PPESSPVLLLHIKLIDTVDLEGGPVGKPVVPAALMNRPTRGERRFAYWALAECILAYYVGTDEGVSEVLHVAGEKAAP

SEQ ID NO: 113643 - protein, 103 aa, Glycine max
  Coding DNA Sequence Number=SeqID_21958
MARNVFAPCPYLKGPIWEGTKRAFSDNSQGGHISLDAESPTVATYPSAGGRHVTRGMRVPQKEYARSRHQHLFEENVGKTGKDAIYELLSERLGSCIYARGRY

SEQ ID NO: 113644 - protein, 112 aa, Glycine max
  Coding DNA Sequence Number=SeqID_21959
MGEVKEVQEQMKANMEAMKEQMATMMEAMISMKKIMEANAVTIATTSTVAKVNPTPHLRKDLGSTGGPHDVQIQNEHAFPPYGLPLNYTPPNVAYTPNENVNKATPILVESQ

SEQ ID NO: 113645 - protein, 97 aa, Glycine max
  Coding DNA Sequence Number=SeqID_21960
MFHLLSIFFNTHTPLSKPLELVHKLSFIVGGNVPLPEGTLKIIPILYSRIPMNPSFPNKGSPPIESIPLKAKGSQWNFSPFANMMAGKELFNLYFPI

SEQ ID NO: 113646 - protein, 112 aa, Glycine max
  Coding DNA Sequence Number=SeqID_21961
MPANFADLIFAGERIESGLRKDKFEYASNVAPNNNRRAPSGGHTEKGRRYPRGQHRPNMDESAPKCPKLIPAQPSELFDPSQKFPPNSSGRVSRNRKNVCPTHSSSPSPASR

SEQ ID NO: 113647 - protein, 134 aa, Glycine max
  Coding DNA Sequence Number=SeqID_21962
  Homolog annotation: Hit_ID=Q2HW90; Match level="QueryCoverage=80%, HitCoverage=22%, E-value=2e-09, Identity=35%"; Hit description =Putative uncharacterized protein
MGPLQRQAFRKVYRKILDLTAAEVFTEVVVSLAQYYDQPLRCFTFGDFQMVPTIEEFEEILGCPLGGRKPYLFSGFLPSLSKIVAVVGDLAKELDRMKQTRNGVVGLPRKYLEGKARDMASQEKWGPFADILAC

SEQ ID NO: 113648 - protein, 138 aa, Glycine max
  Coding DNA Sequence Number=SeqID_21963
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
ASTFTFERLDILRDSIEHPSKKLLSFEFAQSFELQHSISSVSISNSCSPGDPLVLERPPPRWSSNSPYSESYYNSLAVVLQRRDWENPGVTQLNRLAAHPPFASWRNSEEARTDRPSQQLRSLNGEWDAPCSGALSAA

SEQ ID NO: 113649 - protein, 82 aa, Glycine max
  Coding DNA Sequence Number=SeqID_21964
  Subcellular localization annotation: CTP_CleavageSite=61; ConfidenceScore=5.44e-01
ITLWLPVPFINQGANELINVKRLTSSSAPFVIQGQFLLSSSGNIQAQQRARFFTAGQRRSGAMAKESVVVVQLCRFQDTKVC

SEQ ID NO: 113650 - protein, 152 aa, Glycine max
  Coding DNA Sequence Number=SeqID_21965
MTGHDWPLDFLFPTYRYIGTDASGDRVKTDRSLPLPDAKQAENVAARQPKMAPRKLASKRSRKDKAAEGTSSAPEYDSHRFRSAEHQQRFEAIKGWSFLRERRVQLRDDEYTDFQEEIVRRRWASLVTPMAKFDPDIVLEFYANAWPTEEGV

SEQ ID NO: 113651 - protein, 99 aa, Glycine max
  Coding DNA Sequence Number=SeqID_21966
GLALRDALKRNSHRAAGRILCRRLKYATGYCKWQSGPCCHDPLRFSPCRFDSSLPSKSPTNPVPPKKPINPVSLSSSTMFGQKRLPFVGSLSFCLPGAN

SEQ ID NO: 113652 - protein, 64 aa, Glycine max
  Coding DNA Sequence Number=SeqID_21967
MEPATEELINKTQLSPKIIPTSSRRLDGSTKEFHFSYSIAVILLPRLKVRDHHRYQPHGTKIAR

SEQ ID NO: 113653 - protein, 268 aa, Glycine max
  Coding DNA Sequence Number=SeqID_21968
MAQPPPRERTLREMAAPDFTYESLCIQYPDKDVPYVLKTGLIHLLPKFHGLAGEDLHKHLKEFHIVYSTMKPPDVQEDRGFLKAFPHGGRGSSKGLAVLPCSKTFALPCSNLEQLSSLKAYAANIYNRPPQPQQQNQPQQNNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQLNQKQSQNSDKLPSQAVQNPKN

SEQ ID NO: 113654 - protein, 154 aa, Glycine max
  Coding DNA Sequence Number=SeqID_21969
MDDYKSLQIEFENFKKDHYEEHMELQTELSYLKDLFRKLNKGKSDLHHLLSVQKHTTDKTGLGYDKQTTFSNKTEFASSKRVNQNKISKNKNIVHSKPNAKTYHYCMKRGHTSYKCYVRRFDIPKGKCVWIPKDLIVEINPIGPNLNLVSPLSN

SEQ ID NO: 113655 - protein, 127 aa, Glycine max
  Coding DNA Sequence Number=SeqID_21970
MGEVERCKSKDLGSTGGPHYAQSQNKHAFPPYGLPPNYTPPNVAYTPSENVNNSTPILIESRQPQTDHAHVSQPMGDTYEMPHHNLADFEPCLGYATEGQAIGGIPLQNPLEGPQYHPQLHLLHSTT

SEQ ID NO: 113656 - protein, 69 aa, Glycine max
  Coding DNA Sequence Number=SeqID_21971
MGAKHLTRTKERSHVIKQRSPDEIRESVCGSNVSQVYFDDAKDSSQESRVKQVSRIKESFNQSKFKNQD

SEQ ID NO: 113657 - protein, 152 aa, Glycine max
  Coding DNA Sequence Number=SeqID_21972
CAAAGIQLLIAVGALHFGAFVFLELAAQQRVVARVQLGQVNFVLRAQQLAGDQRRAGIVAQRAGTVEVVYHAHVGRQLFRQIVALPQQADAFQVFAGALGVFAAELITACARVGIQIQEWLLFFLQRLDDQALNGVFEHVGVVAGVETVAIT

SEQ ID NO: 113658 - protein, 223 aa, Glycine max
  Coding DNA Sequence Number=SeqID_21973
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=98%, HitCoverage=50%, E-value=5e-27, Identity=32%"; Hit description=CTV.20
EKKVFLEKLKKTLEVKPRQKDFITNNKFDVSNILKRLENSSTKPTTIQDLQTEINNLKREVKELRQQQEIHQIILSQLEEESDSENTNSEENQPENLEDDMFMGLINKIKIQKIYINIKIILNDFVLETMALFDTGADSNCILEGLIPTKFFKKTSEKLSTTNDSKLKINFKLSNAIIENQGLRINTNFLLVKNLKNEVILGTPFIRALFPIQISNEGISGIL

SEQ ID NO: 113659 - protein, 98 aa, Glycine max
  Coding DNA Sequence Number=SeqID_21974
MEHLNRLISKDLVVGLPKLRFEKERLELKVLPGITNQAISRRCIHHQAKYYEDIDQKIVGKEKHMATNRLAGVLKTYDGRCIKVHTYLSQEKRACNLW

SEQ ID NO: 113660 - protein, 80 aa, Glycine max
  Coding DNA Sequence Number=SeqID_21975
MVLKRDVTSEKEGVNAPPILGTLLNTGKIQDTDSASKSLLMSIDILRKTMHQKWKHPSQEAGQRRKVIEIEARRDGLKRR

SEQ ID NO: 113661 - protein, 56 aa, Glycine max
  Coding DNA Sequence Number=SeqID_21976
MENDSKKTLQLLDATKRRSKKVYIAWDDNDSSDGSEKEINLLSKDYESDENISQED

SEQ ID NO: 113662 - protein, 134 aa, Glycine max
  Coding DNA Sequence Number=SeqID_21977
  Subcellular localization annotation: CTP_CleavageSite=59; ConfidenceScore=5.04e-01
MMSVKKIMEANAVAIAATSVVAKVNPTSPSGLKQMNHPTSNMVGKDLGSTGGPHDVQIQNEHAFPSYGLPPNYTPPNVAYTLNENLNNSTPILIENQNLIRHISLKPKRERHMKFPTTILVFDVLGYHEQAVGS

SEQ ID NO: 113663 - protein, 127 aa, Glycine max
  Coding DNA Sequence Number=SeqID_21978
MGQLQRQAFRKAYAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 113664 - protein, 107 aa, Glycine max
  Coding DNA Sequence Number=SeqID_21979
MAANYQHFGTRVVEPSRTFSSAERLENKLIELTSLVRQLAIGQQQNVMTTNQPRLYGICYALDHPIDACSTLQEIEQVVDVSAMQPRQPFRPQQQQYNAYSKTYNLG

SEQ ID NO: 113665 - protein, 105 aa, Glycine max
  Coding DNA Sequence Number=SeqID_21980
MSCNFMDFMATGIKHFEVVKRRSHVDKQQSPNEIRRRSSWLQILNTREQRSLSSLQEAGFASWLITRHKRPTSFGFIARSGYNFLVVITRHKGPTFLGVHCKKRE

SEQ ID NO: 113666 - protein, 540 aa, Glycine max
  Coding DNA Sequence Number=SeqID_21981
  Gene Ontology: Mol. function=enzyme inhibitor activity; Cellular component=cell wall; Biological process=cell wall modification
  Homolog annotation: Hit_ID=A2Q3Z8; Match level="QueryCoverage=95%, HitCoverage=95%, E-value=0.0, Identity=74%"; Hit description =Pectinesterase; Pectinesterase inhibitor
  Pfam annotation: Domain name=PMEI; Domain location=33-184; Score =107.5; E_value=4e-29; Accession=PF04043.6; Description=Plant invertasepectin methylesterase inhibitor
  Pfam annotation: Domain name=Pectinesterase; Domain location=230-526; Score=690.4; E_value=1.3e-204; Accession=PF01095.10; Description =Pectinesterase
  Pfam module annotation: Pfam domain module=PMEI::Pectinesterase; Domain location=33-184::230-526
  Subcellular localization annotation: CTP_CleavageSite=35; ConfidenceScore=5.60e-01
MAHSSHKLFFLLLSIFFSHTCAVNSSNASTTLHTNLSSLKSFCTTTPYPEVCSNSLKLSISINISPNIINYLLQSLQVAISETTKLSNLFHNVGHSNIIEKQRGAVQDCRELHQSTLASLKRSLSGIRSSNSKNIVDARAYLSAALTNKNTCLEGLDSASGIMKPSLVKSVIDTYKHVSNSLSMLPKPEMGAPNAKKNNKPLMNAPKWASSSDQRLFEDSDGENYDPNEMLVVAADGTGNFSTITEAINFAPNNSMDRIVIYVKEGIYEENIEIPSYKTNIMMLGDGSDVTFITGNRSVGDGWTTFRSATLAVFGDGFLARDIAIENSAGPEKHQAVALRVNADLTAFYRCAIYGYQDTLYVHSFRQFYRECDIYGTIDYIFGNAAVILQECNIISRKPMPGQFTVITAQSRDSPDEDTGISFQNCSIIATLDLYSNSSSFKSYLGRPWRVYSRTVYLESYIDDFIDAKGWTKWSNEQGLNTLYYGEYDNYGPGSGTEKRVQWFGYHLMDYGDAYNFTVSQFINGDGWLDTTSVPYDDGI

SEQ ID NO: 113667 - protein, 114 aa, Glycine max
  Coding DNA Sequence Number=SeqID_21982
  Subcellular localization annotation: CTP_CleavageSite=32; ConfidenceScore=5.76e-01
MASPPASPPLPPPPPPPSDASVLPSFVNRTLKASRLRSLSTRPPGAERPVVHVDPATSKANGPHRKKLRTYLGIVARDKVDVTYENWKEVPTAQKDLIWEDIQAFFFFYLMFFN

SEQ ID NO: 113668 - protein, 355 aa, Glycine max
  Coding DNA Sequence Number=SeqID_21983
MTVILKQYITLKALSHLASKRGCPMLKEILSCQGRFSDVEVNSLVNVFATVATSLLSASVEATNAIVMPPPPTSAPSIPLSSVLAATLPSLSSHPMSPCITCTPPTKLIHYGGIENIIKGRPCIPKVNLGFNEPKIGVLFALGFDKPIELHRGLPKMNLRFCEPVKLTKKGPFDKPARTGNAVSCFCIRVTRGVACTEDVVVCSCICNTHGMVCTNDTMACSYIHLTHGTTLTGDVVACSCIRLTRGVACTRNMRLTKDGLWVYEPSTCAMLLHACNSWSGTYWRRDEFGELTKADLGFDEPSTCVMLLHTCHSWSGTYWIHGAFGELTRELSVLGFGETYQSWTLDLMSLAHIS

SEQ ID NO: 113669 - protein, 142 aa, Glycine max
  Coding DNA Sequence Number=SeqID_21984
  Gene Ontology: Mol. function=oxidoreductase activity; Cellular component=cytoplasm; Biological process=ethylene biosynthetic process
  Homolog annotation: Hit_ID=Q9XH70; Match level="QueryCoverage=78%, HitCoverage=30%, E-value=2e-36, Identity=63%"; Hit description =Putative uncharacterized protein p69RF
  Pfam annotation: Domain name=2OG-FeII_Oxy; Domain location=55-136; Score=64.9; E_value=2.6e-16; Accession=PF03171.11; Description=2OG -Fe(II) oxygenase superfamily
MNDLVLSLKNPGIKVKDIVAEYSKQLKALGATIFELLSKALGLNPSYLEEMDCTKALYVMGQYYPEFPEPELTLGISNHTDCDFITILLQDQIGGLQVLHENHWVNVSPVQGALVVNIGDILHITSEIVYYVFLQKINGLEI

SEQ ID NO: 113670 - protein, 112 aa, Glycine max
  Coding DNA Sequence Number=SeqID_21985
MHDEGLQPSPQSYKFTPQQHYHQDYGYNLHFYSARREDFLSNLIGIDLLTLENIHAKYVHIFVCILSPNYYRQFFNKNIDRHSPDKTLALLHKPRKPKIIDEITGLMHDESV

SEQ ID NO: 113671 - protein, 63 aa, Glycine max
  Coding DNA Sequence Number=SeqID_21986
  Subcellular localization annotation: CTP_CleavageSite=26; ConfidenceScore=5.71e-01
MAPHSPLLPPCSPITTTSSTRRKLTSATTPASSSSSRQHQLSALLQPELAAPGAKIVRYWQFF

SEQ ID NO: 113672 - protein, 53 aa, Glycine max
  Coding DNA Sequence Number=SeqID_21987
MAVEMGTGVPWVMCKEDDAPDQVKCRVNSSFGPFNHEGKVQHWEVTEMGWERW

SEQ ID NO: 113673 - protein, 113 aa, Glycine max
  Coding DNA Sequence Number=SeqID_21988
MWETSQGHSVLRECSNHMGSTYIGSKEHSNRVTPKAYTPKSPSGPLPPDSGKSYDAKGISLNSDIISKFPMGRMLGIELRTWCLNFTMIQRRMSLKSSFSETGLVVCGKKRGF

SEQ ID NO: 113674 - protein, 55 aa, Glycine max
  Coding DNA Sequence Number=SeqID_21989
MVCLPKRKTHGSRHQRLFKENIRKNRKEEMRAPGGLATRPSELELAQASCYFTLK

SEQ ID NO: 113675 - protein, 156 aa, Glycine max
  Coding DNA Sequence Number=SeqID_21990
MGEKLATQLAQASLACPGEQGCFLQKQQPSGGRSWKAQQHSAQRLQCQSPPADVSVGLCRQDIGIAPTRRPVDPKKSNRALGFTALVAGLCQSYRVPVPPARSCHRDIGIAPARHPVDPAWGWPVAGNRRTAITSRVHLSSSTKRLERCLRPMADQ

SEQ ID NO: 113676 - protein, 429 aa, Glycine max
  Coding DNA Sequence Number=SeqID_21991
  Homolog annotation: Hit_ID=B0JCV8; Match level="QueryCoverage=27%, HitCoverage=15%, E-value=3e-08, Identity=30%"; Hit description =Misfit TNP1-like protein
MATPPGSPQHSDMPLEATSRKTRQSTQLRTREKIPIIHSNWNDVPESLKNLAWDDILGKFDIPEGDKAKKKVMSTVATRCRQFKSSLMTKYVYADNDDNKKDDPSVKYGIDATTWAKFAKSRQTPTWEYGKRIGKFKNTITTPLTVSWGTVIGRPEHPGHVREEQLRKEVEEENKTYKKRGGGSTKGSCAEVDTIPSAKEPFDVHVDTMGFASTIHNVPYADDVVRVSVVKVYHSDAQVPFLTSEIQFVRQVIETFVGVTSAGMDISVLAVDPLGELVKNLFDVYQKPIELPWDGAKFGIPNVKEGFFITHANVTEIILGDKCLNISIRQLWTMAHWQLTVLCPWDNIVVWLCSLRKKPDVNIKGEINSAMKTLTSSLEGKGDQVVPRWIEPKQQGILGAQLVAPTTGLRPPVHGSSTQADGTQQHNQQ

SEQ ID NO: 113677 - protein, 38 aa, Glycine max
  Coding DNA Sequence Number=SeqID_21992
MKVLRFRNGGTVQGRRSCVRDSKNVIFIKQDAWPSVLV

SEQ ID NO: 113678 - protein, 32 aa, Glycine max
  Coding DNA Sequence Number=SeqID_21993
MEILAEQSKEKLEESHGTARDAVITIGLHSDP

SEQ ID NO: 113679 - protein, 44 aa, Glycine max
  Coding DNA Sequence Number=SeqID_21994
MLKKGFALLLQNQNQSLFIGKSIARTLSYPSSRKKTKTAGGYVG

SEQ ID NO: 113680 - protein, 66 aa, Glycine max
  Coding DNA Sequence Number=SeqID_21995
MGVVMAPFLIKILDVVAVVPTEVVEVAVPPILGLIPMLSPPFQVPISPGPCSQTPPLMVMVHLAPL

SEQ ID NO: 113681 - protein, 202 aa, Glycine max
  Coding DNA Sequence Number=SeqID_21996
  Homolog annotation: Hit_ID=A5AQC9; Match level="QueryCoverage=29%, HitCoverage=19%, E-value=1e-09, Identity=52%"; Hit description =Putative uncharacterized protein
  Subcellular localization annotation: CTP_CleavageSite=47; ConfidenceScore=5.08e-01
MVQEWVVTQGEVCAYGLYSFHNLKLQGNLSLLMFTSASIPNVEFPTSAATVNNSSNIVSNSDVTSSSSANVWHARLGLPNDHDYAFTTVVYLISRLATASLKFVVPFDTLFNKELDYHYLRIFGISPNLSPSFIASIPQTSQASPVNSSFAPPVPPGADVFHDPSLYKSVIGALQYATLTRPEISFIVNKICQFMAAPLDSH

SEQ ID NO: 113682 - protein, 34 aa, Glycine max
  Coding DNA Sequence Number=SeqID_21997
MKENGFEKVKLFELEHEAMKALANSDIQTKKHVT

SEQ ID NO: 113683 - protein, 193 aa, Glycine max
  Coding DNA Sequence Number=SeqID_21998
  Subcellular localization annotation: CTP_CleavageSite=31; ConfidenceScore=5.10e-01
MAEPSKKRKGSSSRSQRHSEAQDTPIPSSISSSSLFSSEKERIQYTNLFSSRSIIDSKFIDMDFFSDESFECIQAFQNSNLIPFMSLKLHVYSELVYGTKMVIDQSLFYDLTQLSSEGVPFEGTLDDDWKFDFSMHDAHRFDGLQTYVGERFDALERQVDMRFDTMDSRITKVEEDVTIIRDCLDLPPPPPSV

SEQ ID NO: 113684 - protein, 82 aa, Glycine max
  Coding DNA Sequence Number=SeqID_21999
MSRRWSGMKCSMSLLVLKGESLKGSKRVVVVENERARITTKKYTFNIARSLPLSLNKLRWFPCKHSIGTKAVFARYCTRNLK

SEQ ID NO: 113685 - protein, 216 aa, Glycine max
  Coding DNA Sequence Number=SeqID_22000
  Homolog annotation: Hit_ID=A5BSR3; Match level="QueryCoverage=29%, HitCoverage=20%, E-value=1e-07, Identity=46%"; Hit description =Putative uncharacterized protein
MARTKKIGQMMSKAAKEIAEKIDSLEEQASQGSFIPHGCQDVLTAAIGRPEHPGRVHATRASVTIKQYFGPAQRTSHTSSSIAPEELEQLTQQIRDQLEDQMQSQFQSQMQSHGLAQPPELEVGPSAAHVSTKGSCVDPSTTDPDVYEGSTTIHNIPLLHDQGKVGVEEALNTFLAWPTHLVKRLSEQGNVSPAKPTDRSHPEVDDPLYLMTLTIS

SEQ ID NO: 113686 - protein, 92 aa, Glycine max
  Coding DNA Sequence Number=SeqID_22001
MEDNLKIACEGLTGCTTLGNIMGHLEASITDKDLSPPSGACKFEVGIEVVEQLDTSPSPEPTTTKPNPNRPSLGHQTLGPRSPWQWKLGNQT

SEQ ID NO: 113687 - protein, 514 aa, Glycine max
  Coding DNA Sequence Number=SeqID_22002
  Gene Ontology: Mol. function=aspartyl esterase activity; Cellular component=extracellular region; Biological process=cell wall organization and biogenesis
  Homolog annotation: Hit_ID=Q43062; Match level="QueryCoverage=92%, HitCoverage=93%, E-value=0.0, Identity=69%"; Hit description =Pectinesterase PPE8B precursor
  Pfam annotation: Domain name=PMEI; Domain location=18-174; Score =55.4; E_value=2e-13; Accession=PF04043.6; Description=Plant invertasepectin methylesterase inhibitor
  Pfam annotation: Domain name=Pectinesterase; Domain location=197-497; Score=757.5; E_value=8.7e-225; Accession=PF01095.10; Description =Pectinesterase
  Pfam module annotation: Pfam domain module=PMEI::Pectinesterase; Domain location=18-174::197-497
  Subcellular localization annotation: CTP_CleavageSite=63; ConfidenceScore=5.27e-01
MELSSKKELLSRIVSTLTPTITLIFFFLVLSPSLCTSLGSTNTVGSELLKVAPSEFEGTVRTVVDVLQEVTSILSEFGSGFGDSRLSNAVSDCLDLLDMSSDELDWSVSATQSPKGKHNSTGNTSSDLRTWLSAALANQDTCIDGFDGTNGMVKGLVSTGIGQVMSLLQQLLTQGQYPSWVKTGERKLLQANVVSFDAVVAADGTGNYTKVMDAVLAAPNYSMQRYVIHIKRGVYYENVEIKKKKWNLMMVGDGMDATIISGNRSFIDGWTTFRSATFAVSGRGFIARDITFQNTAGPEKHQAVALRSDSDLSVFFRCGIFGYQDSLYTHTMRQFYRECKISGTVDFIFGDATAIFQNCHISAKKGLPNQKNTITAHGRKNPDEPTGFSIQFCNISADYDLVNSVNSFNSTHTYLGRPWKPYSRTIFMQSYISDVLRPEGWLEWNGDFALDTLYYAEYMNYGPGAGVANRVKWQGYHVMNDSSQASNFTVSQFIEGNLWLPSTGVTFTAGLGVV

SEQ ID NO: 113688 - protein, 157 aa, Glycine max
  Coding DNA Sequence Number=SeqID_22003
  Homolog annotation: Hit_ID=Q9M9E1; Match level="QueryCoverage=28%, HitCoverage=3%, E-value=3e-08, Identity=71%"; Hit description =Pleiotropic drug resistance protein 12
MTKEEMKRTWEKWLPRGEIVRHRPKANDKALNTRGTRKPLLPIPCGKRRDSAPEPLLEPSIVQEVSFDDDNEEEQFLDEFEYEFAYYFEQGVQEDRLVLLKGVSGAFRPGVLTALMGVSCGVPKLMTGLEGNSSLQSPEWPVHNSIRSHFFLTAHNL

SEQ ID NO: 113689 - protein, 324 aa, Glycine max
  Coding DNA Sequence Number=SeqID_22004
  Gene Ontology: Mol. function=metalloendopeptidase activity; Cellular component=integral to membrane; Biological process=proteolysis
  Homolog annotation: Hit_ID=Q0WNY2; Match level="QueryCoverage=29%, HitCoverage=9%, E-value=4e-34, Identity=73%"; Hit description =Putative uncharacterized protein At1g06900
  Pfam annotation: Domain name=ABC_tran; Domain location=16-158; Score=- 59.6; E_value=0.059; Accession=PF00005.18; Description=ABC transporter
  Pfam annotation: Domain name=Peptidase_M16_C; Domain location=118 -265; Score=2.4; E_value=0.0097; Accession=PF05193.12; Description =Peptidase M16 inactive domain
  Pfam module annotation: Pfam domain module=ABC_tran::Peptidase_M16_C; Domain location=16-158::118-265
MEQFIDNLPPMDLMRSEKMTFVQLIIPVESAHRAISYLGELGLLQFRDVSFLSDPTSLPLDSDFPSLLFFFDFVSEVCANTIVGNAMLRGISGGQRKRVTTGEMLVEPANALLMDEISTGLDSSTTYQILNSLKQCVHILKGTAVISLNFNEISIDLGIKPSGVFDKLLKHCFLQSALEILISEGRGSFLSFLKSRGWATSLSAGVGEEGIYGSSIAYVFVMSIHLTDSGVEKMLDIIGFVYQYLKLLSQDSPQEWIFKELQNIGSIDFKFVEEQPEMIMLLGLQGHTEKGKGEKLDPWEVGGKRGHGRREGVGIVGEEKVMLA

SEQ ID NO: 113690 - protein, 90 aa, Glycine max
  Coding DNA Sequence Number=SeqID_22005
  Subcellular localization annotation: CTP_CleavageSite=49; ConfidenceScore=5.00e-01
MKLKKKKKMKMKNMMMMMMTKKKKAMKWMELRVLVVVLGAKSFVLQCAAAMALWRRNYSRNRENKRKSLRNLRKLLEMLLSLSEYPREPT

SEQ ID NO: 113691 - protein, 110 aa, Glycine max
  Coding DNA Sequence Number=SeqID_22006
MGRGEKRNRRVRREEEQLMSGERNRRRGKKRNRRVGLKIKMARIQRRFWETAFEIFAIFTQLPSLYGFSSSDSFPLMLIATFQKELHIVIVAIAIAIVVTIATVIVAKSI

SEQ ID NO: 113692 - protein, 632 aa, Glycine max
  Coding DNA Sequence Number=SeqID_22007
  Homolog annotation: Hit_ID=A5BSR3; Match level="QueryCoverage=43%, HitCoverage=77%, E-value=4e-10, Identity=25%"; Hit description =Putative uncharacterized protein
MDQPRLAVYVDPATGRASGPMREKFHSYLGVVTREKSIFTLTECKVTNVCMQAKVDILEAAKVKTKDVVTKYGLDPKAWKQFEATRLTPNWEGIRKRAQSIQKHNNCPHLLSRGGYDLLEKKLLDEKRKRLEEEALLTENPASVNDPPSPIKRHVKWKVAWTRAYGNMTSESTQEIADKIDSLEEQVTQGSFVPHGRQDILNTAIGRPDHGGRVRAAGSGVTITQYYGRATRTCNNSSTSITQQQLDEVVARLREDMSGQIREELRSQIKEELRTHLEEENKRSLERMTMALKEAIKIELSHKGSPESLLIQPDIQQLGVRVNTKGSNAQSNVQPSREDDADVIPKMGLYVQREDGTLGLVAMGKMMDGDSVIHSMAYADDVVWVNVDTVIDPNVEIPYGTSKIQYVKQALDTFVAWPTHLVKVVLDEVTHEDKLANVDADDPMRGLIKYNFDIYDKPVEFKFDGSKFGIVDAPTSIFLTYYDVSEIIAGDKSLNISVQQLWLMYMHEWSQTLGQGSSYAFLEPQSLVVSKDTRGECQQYLERWLKESDREVYVGPYFHHVMTKLKTSSSPESKAVALKWIEVKSHVQTGCYECGYYVMHWMWNIITSDIKSDWSMWFGDETPLDKDNITTI

SEQ ID NO: 113693 - protein, 80 aa, Glycine max
  Coding DNA Sequence Number=SeqID_22008
MVVIVPKEHLVVWFCSLHNSALKGLDDVAQPKSKAPVRWIVVKGNRQKGSTECGYYVMHWMSTIILGSFRNSWEVYFNDP

SEQ ID NO: 113694 - protein, 230 aa, Glycine max
  Coding DNA Sequence Number=SeqID_22009
  Gene Ontology: Mol. function=RNA-directed DNA polymerase activity
  Homolog annotation: Hit_ID=Q9M5R0; Match level="QueryCoverage=19%, HitCoverage=58%, E-value=5e-11, Identity=73%"; Hit description =Reverse transcriptase
  Pfam annotation: Domain name=RVT_2; Domain location=87-229; Score= -158.8; E_value=0.00025; Accession=PF07727.5; Description=Reverse transcriptase (RNA-dependent DNA pol
MAFLIIQLLEEEEVVQLVLVEEIQHGYPPGHKYYKHQGPSINNVNAVKEENANLDVEQNQEAQGSDVKLNAQQYKALMTLLQQQGSSTHNSSHVNQIGTMTGSSHVLTGNVSSISCSMSKADLNEEVYMVIPQGMNPEKPGLVCRLRRSLYGLKRASRQWYARLLSPEVVNLIHNKKLHQETLEGLKTALCATQALLMDAEHKQGELVLEGSFNISSEREYMAGRMTKRP

SEQ ID NO: 113695 - protein, 161 aa, Glycine max
  Coding DNA Sequence Number=SeqID_22010
EKVLEYVNLMIWLGAKGFPPFTKQSSQEILLNNLGFTILAEANMPQWKWMSLGAHPETQLLTICTMNCGIPGVEVWLCEMLMSLLVQMQKENEEDHHKEEEGILALSPTLLDAPTKLLGAQSNTHNPKVHEDVGGKTEFLEAQQLYFAPRQLALTNGRCRL

SEQ ID NO: 113696 - protein, 705 aa, Glycine max
  Coding DNA Sequence Number=SeqID_22011
MERDDKVILEQLLASLDALAIFFLPSANDPLTALDGGTMPLSVATLTVGEGGQLAGEVGPLAVAIEVAPSAPSFVLVKRKRDDATKQSGRKKSKAPMSLCTLRQVAGLGPTVGCLTTVQDVPPALPVVEALAAVTPTAVTPTASPPLAAIVQEDYPATVEVAVLATQAESVVVLSSTIVAPLLSIGVATTGAPMVLPPSSLALVVLPAVVLATMASPSLSLRLRFSLNYLYTSSDADSLWGVTYKLEQKTLTDFVLAFDKNLIRSTGVQNATDSTKVFLQRSLAILEENRLWHQEAKMDLSCKVESMMGEKEGLAKRIAKLEAQLRESKSRLKESELQAAKEKKANKELEEKLLLYKKEAVEQHEKGFHKAVRQVGFFVKDLDLGLFNPFKDVNEGVLLDEEEIDAKKEAGDQRQVAAELGDDARVLPNSGVTVRLVELGPLTMVVEVAACERTKGVPWVFVEVFTKGQPWVFVPRADLGMRLSNGKGFTKGEPWVCRALDQERVCLGFVKPVSRLTKDGPWILWTYKDRQAWSLGLMSLVCSVGVVLLHTWHSPWVTCIDDELACSCIHASYRMVGLTRELYDLGFEHRALACMLVAVGGMHWRCGDILFAYMSLTDALACMAFAVGVIHWRLGDMLLHICHLPWVAHTEVIMACKDARACMPLAVGGMYWSHQDYMLLRVWQSPCVAHIRVVMLEERPTKGGP

SEQ ID NO: 113697 - protein, 60 aa, Glycine max
  Coding DNA Sequence Number=SeqID_22012
MDASEPYTGTMRGTMHKPRANLGADRKFSPDTSEPYTGAMRGHCVWASSEPRGESKFLTR

SEQ ID NO: 113698 - protein, 42 aa, Glycine max
  Coding DNA Sequence Number=SeqID_22013
MVGAFSQNSVTLTSLPMILPRVDGYVDDYEEPHARGHRNTML

SEQ ID NO: 113699 - protein, 87 aa, Glycine max
  Coding DNA Sequence Number=SeqID_22014
MPTNEDATNLAMEDPFLMIVLWFHPSKVAAKAVTLSIRQQFGQPWPTWGAIPKDHQELFSSILRDNWFGDPSKRMKLKKAFNSKASH

SEQ ID NO: 113700 - protein, 108 aa, Glycine max
  Coding DNA Sequence Number=SeqID_22015
MGFNCSFNLKLRNQPKEAIAHIYAQNLHFCSLCFLSFSLFHAALHLVREGSNVEVNSEGEGTGIERCGGWWRQTRYAEPPFLFADVWTSFQIILIRKPLTDQVDPEEY

SEQ ID NO: 113701 - protein, 121 aa, Glycine max
  Coding DNA Sequence Number=SeqID_22016
  Gene Ontology: Cellular component=integral to membrane
  Homolog annotation: Hit_ID=A3KBV8; Match level="QueryCoverage=66%, HitCoverage=18%, E-value=2e-20, Identity=55%"; Hit description=IGN1
MSALVLSTLGKRIDQAGKKKYVKQILEDVDSQIIGTLSGDGDEDDLNVEITKVHACLVDEENELGETPLFTTTEKGHLDVVELSLSDVDTWQSTSELNGQRPIEVSETNIAEFYKIGGPNL

SEQ ID NO: 113702 - protein, 253 aa, Glycine max
  Coding DNA Sequence Number=SeqID_22017
  Gene Ontology: Mol. function=protein serine/threonine kinase activity; Cellular component=cytoplasm; Biological process=protein amino acid phosphorylation
  Homolog annotation: Hit_ID=Q5XLG3; Match level="QueryCoverage=26%, HitCoverage=21%, E-value=1e-18, Identity=51%"; Hit description =Calcium-dependent protein kinase 1
MKTSPNTSSPSRDRDTSCMISGPPILNRESPRGLHPKLKAWHGLIRHNLPLHTQRHGTPIHLQVNPKAEAALHGGLRRRMHHLFEHPNVVRIHDTYEDTASVEACHWLGVMHRDLKHENFLFDTVEEGAKVKTIDFGLSVFYKPGLVALSLDLVFVEDAEGEGLVVGFGGGGDSDDVFEFSLAEELADAVDGVLGSGASAEAEDHARLDILDDLVGGNFLEVVFGEDDEGGGGVDTVEEEKKELGFFVTKETN

SEQ ID NO: 113703 - protein, 132 aa, Glycine max
  Coding DNA Sequence Number=SeqID_22018
MHLRNLHVQIILIAITTQSSYNLRINILKDLPHGAHVAPLRLQVELGVVVAPRHLLHVLLLPRLVNSLPQGRQHQRRHRRRRWRWRWGYLRKRVLETCWGGGSFSPCPSAPGPDTSKQKGHQKMKSLDRRRD

SEQ ID NO: 113704 - protein, 168 aa, Glycine max
  Coding DNA Sequence Number=SeqID_22019
MELGDWYTLYPYLAITLICHPCGCVRPPIPMRLSGIVGPCYVSSTNVREDHDDLMPPSYKEDEDDPSEDPSKILSYPNFVRGPLLDDVRPFFGPREAVASGGSNPARLGELGGNHLPYFAINRGGNEEGRAEALPKRFRNVFREESRKGFNRSSTFFIRSSSFFDLQR

SEQ ID NO: 113705 - protein, 109 aa, Glycine max
  Coding DNA Sequence Number=SeqID_22020
MAGEWRRRKGDWRRHFEEKMSQEQAHHHRKPWIRAWRKEKMTIVQPTNPRSNSRFSTKCAWVSIASEVEGMDVEGGAKEGVGKGGARLEGEGEEVRVEWTGQKTEMAFE

SEQ ID NO: 113706 - protein, 255 aa, Glycine max
  Coding DNA Sequence Number=SeqID_22021
  Gene Ontology: Mol. function=aspartic-type endopeptidase activity; Cellular component=extracellular region; Biological process =proteolysis
  Homolog annotation: Hit_ID=Q6XBF8; Match level="QueryCoverage=53%, HitCoverage=30%, E-value=3e-26, Identity=49%"; Hit description=CDR1
MSVGSKRIDFVDASTSNELKGNIIIDSGTTLTILLENFYTKLEAEVEAHINLERVNSTDQILSLCYKSPPNNAIEVPIITTHFAGVDIVLNSLNTFVSVFDDAMWFAFAPVASGSIFGNLAQMNHLVGYDLLRKTIKKANPEAEFKEISTMVIAKEKLETESMSLLEDEQKQRTAMELLEQYMQFKQEAEKDGKKNKKEKDPLKPKHPMSAYFLFTPLWNCVDKSGAFAPTYPPLERKSDLRSSFLSVNQAILLL

SEQ ID NO: 113707 - protein, 68 aa, Glycine max
  Coding DNA Sequence Number=SeqID_22022
  Subcellular localization annotation: CTP_CleavageSite=34; ConfidenceScore=5.77e-01
MASPPASPPPPPPPSPPPPPPPPPSNASASLCVVKQTRKASRLRSLSARPPGADRPVVHVDPTADKAD

SEQ ID NO: 113708 - protein, 214 aa, Glycine max
  Coding DNA Sequence Number=SeqID_22023
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=96%, HitCoverage=32%, E-value=3e-50, Identity=47%"; Hit description =Chromosome chr9 scaffold_7, whole genome shotgun sequence
MVCIKNQHRSLIRKITLILIREQHKILKELYLSFVLFKYGDRGASHVELHWPTRLKIIRGIAHRMHYLYTVLGSSDLPHKYLKSNNVLLGPDNEPMLIDYGFSHMVNPSTIAQTLFTYKAPEAAQQGQILTGRFPSQYLKNGKGGADVVQWVETTISEGRESEVLDPEIAGSRNWLGEMEQLLHIGAACTKSNPQQRLDMAKTVIRIMEIKFEC

SEQ ID NO: 113709 - protein, 359 aa, Glycine max
  Coding DNA Sequence Number=SeqID_22024
  Gene Ontology: Mol. function=transmembrane receptor activity; Cellular component=intrinsic to membrane; Biological process=innate immune response
  Homolog annotation: Hit_ID=A7NXD7; Match level="QueryCoverage=40%, HitCoverage=14%, E-value=9e-50, Identity=65%"; Hit description =Chromosome chr5 scaffold_2, whole genome shotgun sequence
MAVKNALKLNIYDDLVTVRKTWEDTNEERAIVLYKPDAQPPQANGSTTLEGSSKVHLLKVLETRKSALQKEQGMAFAHVVAAGFDIDYIPPLMSFVECFGASRMKDTCTKFRDLWRRKHETGQWLEIEAAEMTCNRSDFSPFNVSGIILPSMASASHTELDSESNGKASSVDFFPTWVIDNILTIPIKQFDYHDVLVWRFTVDGVYSGKSSYQLALNKEENAAKGSSEGCGDGWKIWSSNAIPHSIIERVPNSLPLPPRTLQIQSRTRTGFGVIFRDENVYVLVPVAKFMKEEFDVHLTVVSAIIVIGVRQLTVGSAIIVIVRGKVQPYVLSPGATIVLTLGKELKEADRASCSKFLHL

SEQ ID NO: 113710 - protein, 63 aa, Glycine max
  Coding DNA Sequence Number=SeqID_22025
CNRQKGSTKCGYYVMHWMSTIILGSFRNNLKTYFNDVRPLEAERLKTLRIQWALYYLKVKNQT

SEQ ID NO: 113711 - protein, 108 aa, Glycine max
  Coding DNA Sequence Number=SeqID_22026
  Homolog annotation: Hit_ID=A5BQV9; Match level="QueryCoverage=51%, HitCoverage=4%, E-value=3e-10, Identity=55%"; Hit description =Putative uncharacterized protein
MDPAPDKTMHKEAHAKWEVKDAQVMTWIIGSVEPNIILNLTPFNTATKMWDCSEIVYYCEIYQQAQQKFPTRALAFHDKLSPFSYNRGFWKQNSYYTVVGMSPPPLGT

SEQ ID NO: 113712 - protein, 228 aa, Glycine max
  Coding DNA Sequence Number=SeqID_22027
MAMNMTEGNKPRLKRRMRWTAVMLSGAGNGTGCCGMSAGCGSEVGMVMGAVSVGDRVGWSSKVSGRGSSVVGIGTTGGGDCRGKEDGEECGREKSRGGWFSEAIFEEVHPIGSRGGVEPHQLWPRRPQGVEGSREAMEGSHGSSIWRVVWVVVVKGGLAAMEALWSGRGCGSGSWHGSHGRQPWTLNKSTKLLRAAKMVAGFEGPAPPEEEEEKKIALGIRGPSCLLK

SEQ ID NO: 113713 - protein, 148 aa, Glycine max
  Coding DNA Sequence Number=SeqID_22028
  Subcellular localization annotation: CTP_CleavageSite=72; ConfidenceScore=5.19e-01
MSTFEQHATNASIHFPEPEPYSTTNTFTSMMNAIKSVSWVLAISSKVRILTKRLTSCLIMRKTLVPSLVRVLATYKDEWKDWGIYDMIMLCFVLPKAMVGPTLLDVVAILSLPIYGEELLSLYGNHYSTTPNTHGIKFSKDDLDIPNS

SEQ ID NO: 113714 - protein, 126 aa, Glycine max
  Coding DNA Sequence Number=SeqID_22029
MEETEVDKKIAITFDHPTLEMIKHLKPIYVRAQINGKTLLRVFVDEGAILNIMPLTILKKPKSQLDPKPCIMPSSLKMPSQLILCSLDPTNGIRAKVMSSIPNKAIVEGEIVFQVVASIVPWRRPR

SEQ ID NO: 113715 - protein, 200 aa, Glycine max
  Coding DNA Sequence Number=SeqID_22030
  Pfam annotation: Domain name=Transposase_23; Domain location=37-107; Score=-13.5; E_value=0.035; Accession=PF03017.5; Description =TNP1ENSPM transposase
MQSQGLALSPEVEVGPSAAHVSTKKSFVDPSRHEPEMGDSDKCGLYVNENTSRLVVLGRLYEGLTPVHNITLGNDQVKVNIEETRDVDAHILVPTQEVQLVAQALNTFIAWLTHLVKRLINRAEGPAKPVDRLDLDVDPLYLMTLSIPQLFLKPLQVSWDATMFGVYNDNFPLYIKHEDLSEITHGGQCLDISVIQLWIL

SEQ ID NO: 113716 - protein, 128 aa, Glycine max
  Coding DNA Sequence Number=SeqID_22031
KYCSQRQGQGDVPQAVDAPPPHQAGPAGLFDTERYLRHLVRQQAANHRAHVQTHDCLYQMSLSLQSQGFTSFPCPTPDQFRAEVAWPGDWPEAQAAEAPAEAPDEADEAREDEEMTNLLDFLGGSGAA

SEQ ID NO: 113717 - protein, 69 aa, Glycine max
  Coding DNA Sequence Number=SeqID_22032
  Subcellular localization annotation: CTP_CleavageSite=28; ConfidenceScore=5.54e-01
MEWNLSRRHALSASSTRSMSHLSPSRLSASLAQSRNSLNRAKCENGAKRDVEELPCYGRLNPQLGILVE

SEQ ID NO: 113718 - protein, 165 aa, Glycine max
  Coding DNA Sequence Number=SeqID_22033
  Subcellular localization annotation: CTP_CleavageSite=85; ConfidenceScore=5.37e-01
MDTLQSDLNKPFYLGCNKSLTLLSTVLSLVNVKARYGWSDKSFSSLLQVRPFPVPTSSPQATHMRFFTMSVNPLQSLNIAKVDVSLSKLNALSECHPISKVSTRLTDRRNLEGNRSRRHALNASSARLASRLSPSRLSASLALSGNSLTRANHDVEVNEPFLSLE

SEQ ID NO: 113719 - protein, 111 aa, Glycine max
  Coding DNA Sequence Number=SeqID_22034
MEEKKKKQLEEVAQSKSTDIVIDPPSPIKRHVKWKMAHTKKSGQMTSEVAKKIADKISLSLHKCCKIVLPLNFKVTLLVRSISVPRELSNVALKDDMAWHVDVPLKRCHVI

SEQ ID NO: 113720 - protein, 266 aa, Glycine max
  Coding DNA Sequence Number=SeqID_22035
  Gene Ontology: Mol. function=peptidase activity; Cellular component =nucleus; Biological process=proteolysis
  Homolog annotation: Hit_ID=A7PYW2; Match level="QueryCoverage=72%, HitCoverage=9%, E-value=6e-41, Identity=44%"; Hit description =Chromosome chr12 scaffold_38, whole genome shotgun sequence
MPWSLITSIPWVLEKPPPAKWKGKLLPEIDKGSGEGKELCSLVVDIVVSLLRCATAGLAKKDAHFRKVLLLVEERLDSNSYEKLHKMLVTHLGKCTLNLLGSTPFPDRYLVTLFWCTTLTEYVKSPIKDQVYKIALRVCSLLFALRDNNSLYIMDILESIVRECKVEEENTGTNFVELVYYCANKCQTANESFCSTFAAYLNKIAEHFKQKTRKYYSVSDLEIVDFKVLTRMNQYEIREVENTTKEKMEMTTPVFTSKMEITTPVL

SEQ ID NO: 113721 - protein, 147 aa, Glycine max
  Coding DNA Sequence Number=SeqID_22036
MDEILDWVEKVKVQWVQLIVNVEGVKVGQKWKDKVGKGNLRNCKVSSNGAKCSQPLHSYNHINPLYRVDENVWDCDREGNQWDIEVEKIGVVVTRLCSVVLRLVVEEMLPRVAGVRLGDGDDVEVAMAESFSMISSMVSISVACLQS

SEQ ID NO: 113722 - protein, 40 aa, Glycine max
  Coding DNA Sequence Number=SeqID_22037
MADSKTVYNQCRMSLITDVEGGEKCGVHNNIISIKGMFEF

SEQ ID NO: 113723 - protein, 151 aa, Glycine max
  Coding DNA Sequence Number=SeqID_22038
MTRMQEYCVCAAHGCNNKQMLRPVVNALSNGQKKGSGLDKPHRLAIHSHSLRLPHPTSDNTRPHLGARQTRHPLPVKTTHRQTSSSVCPLNKAHPQSQCVRLCTISWLLKSIAIPEDQSSELYYSVGAIAVGNHPYYAYCRVASNRSWSLT

SEQ ID NO: 113724 - protein, 47 aa, Glycine max
  Coding DNA Sequence Number=SeqID_22039
MASKATREIANKISKMQSQRLVLPLEPEVGPSTACVNTKGSCVDPLK

SEQ ID NO: 113725 - protein, 171 aa, Glycine max
  Coding DNA Sequence Number=SeqID_22040
  Gene Ontology: Mol. function=hydrolase activity
  Homolog annotation: Hit_ID=O65755; Match level="QueryCoverage=74%, HitCoverage=91%, E-value=1e-49, Identity=62%"; Hit description =Putative deoxycytidylate deaminase
  Pfam annotation: Domain name=dCMP_cyt_deam_1; Domain location=67-152; Score=41.0; E_value=4.3e-09; Accession=PF00383.13; Description =Cytidine and deoxycytidylate deaminas
MTDNESKWGVSFRRVSASGSVGNKREELEHHESESFKLRVGVRVVVQTKNGTVAVASAFAGHKEAIQQRDHKFLRIAVEEAYKGVDCEDGGPFGAIIVCNDEIVARCHNMVLRNTDPTAHAEVTVIRKAEAAIAIGFDDFISDALRGTGFYQKAQLEIKRADGKAANIAEE

SEQ ID NO: 113726 - protein, 87 aa, Glycine max
  Coding DNA Sequence Number=SeqID_22041
MSSSSRPMPRRESPWGVTREYHPKLKAHRCNDHVEDVKGVALAPTYLQEMREFGTMAACQSELMFSPKEIGSPRRAGSFSPKQFGGH

SEQ ID NO: 113727 - protein, 49 aa, Glycine max
  Coding DNA Sequence Number=SeqID_22042
MGSGSLAAMSVFESKYKESLSAICEGRPAMAAPLTTMACLYGGILAFWH

SEQ ID NO: 113728 - protein, 654 aa, Glycine max
  Coding DNA Sequence Number=SeqID_22043
  Gene Ontology: Mol. function=enzyme inhibitor activity; Cellular component=cell wall; Biological process=cell wall modification
  Homolog annotation: Hit_ID=Q9MBB6; Match level="QueryCoverage=99%, HitCoverage=100%, E-value=1e-127, Identity=55%"; Hit description =Pectin methylesterase
  Pfam annotation: Domain name=PMEI; Domain location=70-223; Score =126.7; E_value=6.6e-35; Accession=PF04043.6; Description=Plant invertasepectin methylesterase inhibitor
  Pfam annotation: Domain name=Pectinesterase; Domain location=343-639; Score=703.5; E_value=1.6e-208; Accession=PF01095.10; Description =Pectinesterase
  Pfam module annotation: Pfam domain module=PMEI::Pectinesterase; Domain location=70-223::343-639
MAFQDFDMITERRRNEQRLKMKKKILISVVSAVLLACVVGAAAFVVVQRTGTNAKHATPMPQNTATPHVDQNSRMVKMICGSAEYKEKCESTLEEALKKDPKLAQPKDLIMVSMILAEKEVTNAFDGTAKMMGNASEEEKGAYEDCKGLFKDAKEELELSITEVGDNDADKLSTKGAELNNWLSAVMSYQQTCIDGFPEGKIKDDFTSMFTNSRELVSNSLAVVSQFSSFFSIFQGAGGIHLPWETTSDDALAPTASGSASGAGAGAGAGSVFGSDPSSFGLGYASAPAGGVALAPGVAPAPGAAPGPVPSLPAGSIPAWTGSVPVWAGPSEFLGSNEKPTPNVTVAQDGSGNFKTISEALAAIPPQYDGRYVVYVKEGVYDETVTVTKKMVNLTMYGDGQQKSIVTGNKNFVDGVRTFQTASFVVLGEGFLGKDMGFRNTAGAEKHQAVAARVQADRAIFFNCAFEGYQDTLYAQTHRQFYRDCYISGTIDFIFGDASAVFQNCTMVVRKPLENQQNIVTAQGRLDKQENTGFVLQKCVIKADTDLVPLKDTIKNYLGRPWKEYSRTIIMETQIDDLIHPDGFLPWEGNFALSTLYYGEYNNNGAGSSTTARVNWPGRKVINRDEATRYTVEAFLQGTWINGTGVPAQLGLYS

SEQ ID NO: 113729 - protein, 103 aa, Glycine max
  Coding DNA Sequence Number=SeqID_22044
  Homolog annotation: Hit_ID=A5B9T5; Match level="QueryCoverage=64%, HitCoverage=9%, E-value=1e-10, Identity=37%"; Hit description =Putative uncharacterized protein
MISHISEKALVARNSVNAMDMEASLWHRRLSHISEKGLNCLAKKDMLTGLKNADLQKCCHCMVDVCGPLKVKSFSGVDMMTKTLLTGKFEACCEIVGLAVIST

SEQ ID NO: 113730 - protein, 81 aa, Glycine max
  Coding DNA Sequence Number=SeqID_22045
MASSSGGGGRSLFLLRRFCHLMKFYRISIGRYEGLKIREKEARREECGCAALLVYVAIYRRWHYVIDYKDAVIDYKLSVPV

SEQ ID NO: 113731 - protein, 93 aa, Glycine max
  Coding DNA Sequence Number=SeqID_22046
MPKDFTMYKVDNLREHVKANGLSKRIELVIASPLLRYNFIGPMTKSKTKQSMGTLQQMVGDILSKAQVEKDEGPSGEGRRPKWRRTKPPSGEG

SEQ ID NO: 113732 - protein, 185 aa, Glycine max
  Coding DNA Sequence Number=SeqID_22047
MKKEKHVSYSSHNSCKSLSEELRDYYEGRHRSHLRAHSHRREKERKPQEANINLPYFDGKDNVEANLDWEIRVEQQLKKKFTSKSYGSHSHPKKDQGQGILGVTASKPKDDKGKTIEKQAHKASMQEKTSSIKCFKFLGRGHITSQRSSLHRSPTSKLPSVKVEVKLIEGDNVAKTIVDLSEILI

SEQ ID NO: 113733 - protein, 81 aa, Glycine max
  Coding DNA Sequence Number=SeqID_22048
MFLVFNSALKGLDDTPEPKSKAAARWIVVKCNRQKGSTERDYYVMHWMSTIISGTFRNNWETYFNDVRPLEEEIFKALQIQ

SEQ ID NO: 113734 - protein, 144 aa, Glycine max
  Coding DNA Sequence Number=SeqID_22049
MMQSYLPRVLDRRLQEDWARAAKEGPRVLMNLRLSSSFSRKLLKEVSLAIRGCLSHGGGASGDIVLLSLMRWKASMTFQGLTKPHQGRVVKGRLRDLQWSMAVVREMKGWKLAAVTEIGLFGIFNSMSMKLFQGWRSLHHRFIY

SEQ ID NO: 113735 - protein, 259 aa, Glycine max
  Coding DNA Sequence Number=SeqID_22050
MDEKRKKKLEEVAQSGSTNTVIDPSSPIRRRVKWKIARTKKTRQMTSEAAEKLLRRLIRWRSRPHRVPLSPMDVRITKENCVDTSRNDPDTGDSDKYRLYIKENPPCLVALGRVYEGSTTVHNIPLLHDQVKVGVEEVGDADSPIPIPTELVKLLGQTLNTFLAWSTHLVKHLSKQVMWNATVFGVFNENFPLYIKHEDLPGIALSGQCLIISVIQLWILPDNYFKGLINSALKGLEDTPQSKSKAGARWIVVKTKRKH

SEQ ID NO: 113736 - protein, 127 aa, Glycine max
  Coding DNA Sequence Number=SeqID_22051
MEQRYEEELRKLKADHDQLDARVRRPQGDEHSTYTLPKCTQGDSQSTLKMIQANLYTNDNAILRHVFLTSIKEATLISYGGLPPRSIDNFDTLSRILSEQSEEKLEKSQGTAIDAAIVVGRHVSPLR

SEQ ID NO: 113737 - protein, 79 aa, Glycine max
  Coding DNA Sequence Number=SeqID_22052
MQSLQDVVQQRLVMSVEEFLWKVAWLGVQPFPLGGGEASATQEPQPDQEDDSSEGTPTPPEPFIFEDDPVIIEACIKLD

SEQ ID NO: 113738 - protein, 93 aa, Glycine max
  Coding DNA Sequence Number=SeqID_22053
MAQSNFSRLGFPSLITALCRSRGVGYDALTSYRSLRPGQGKPGPEQLVFPLLQHQQPHLPKAPRLQMLSCRVCLRDRFSICRAYKNWPTRGQS

SEQ ID NO: 113739 - protein, 97 aa, Glycine max
  Coding DNA Sequence Number=SeqID_22054
MVTTSLMYIHNIHHHNDIFNINNISSQCHYQHQHHLVEAKIHGESKVIQRCFDYNNDDDKGDDKKAQRSIKNSSSESRTIQEFKIRIKKNSRLKKKV

SEQ ID NO: 113740 - protein, 191 aa, Glycine max
  Coding DNA Sequence Number=SeqID_22055
NEDKGYVGVRELIWRWATRDGGLYVICGCGELLCTIARPPPSTTCDGMVPGDMSQGSGDLGDVRRAPDSQQIKGTKTTKQGGLCGGWASCESCVIYGLWPLVIDYQGLENEVRKLGELLASKGNWKTVEVSGNRLAVCVIDYTEEWVTGNRLPECTPFFSFLYIVMAAQLIHDRVEMECLEGAWETLEGNT

SEQ ID NO: 113741 - protein, 105 aa, Glycine max
  Coding DNA Sequence Number=SeqID_22056
MGHLSDQGVPKDPKRIKIIPNWPTPPSIREIWGCHDLTNFYKSVREGAQSMRTSDLRSNPFQVEGMMQSYPARALGRRLQVDWARDPRVGPRVLMSLRVDFEPMG

SEQ ID NO: 113742 - protein, 206 aa, Glycine max
  Coding DNA Sequence Number=SeqID_22057
  Gene Ontology: Mol. function=triose-phosphate isomerase activity; Cellular component=cytoplasm; Biological process=pentose-phosphate shunt
  Homolog annotation: Hit_ID=A8GLA8; Match level="QueryCoverage=91%, HitCoverage=73%, E-value=1e-91, Identity=90%"; Hit description =Triosephosphate isomerase
  Pfam annotation: Domain name=TIM; Domain location=2-197; Score=320.6; E_value=3e-93; Accession=PF00121.9; Description=Triosephosphate isomerase
AKHALAGSRIALGAQNVDVNLSGAFTGEVSANMLKDVGAQYIIIGHSERRTYHKESDEVIAEKFAVLKEAGLIPVLCIGETEAENAAGKTEEVCARQIDAVLKTLGAPAMKGTVIAYEPVWAIGTGKSATPAQAQAVHKFIRGHIAKHDAAVAAEIIIQYGGSVNDKNAAELFSQPDIDGALVGGASLKADAFAVIVKAAAAAKKA

SEQ ID NO: 113743 - protein, 240 aa, Glycine max
  Coding DNA Sequence Number=SeqID_22058
  Gene Ontology: Mol. function=thiamin pyrophosphate binding; Cellular component=chloroplast; Biological process=menaquinone biosynthetic process
  Homolog annotation: Hit_ID=A5FG67; Match level="QueryCoverage=97%, HitCoverage=42%, E-value=4e-49, Identity=45%"; Hit description=2 -succinyl-6-hydroxy-2, 4-cyclohexadiene-1-carboxylate synthase
MKEVLLCALGMAKSEKKPVAITCTSGSATVNYYPAVTEAFYQNVPLLVLTADRPVDFVDIFDGQTIRQNNIFHQHSYGDFQLLEDKEENAEDINFEMIKKAIELCFEKQGPVHINIPLEEPLYELVSELPTFPTVEKTIKKKEYEIPSNLVADWNTSQRIMILVGTKDYIPELENQLSQLVKNHTAVVLSEANSNVYHEKFFRFIDRYIFNFTEEDYKKYAPDLLITVGQNVVSKKVKQF

SEQ ID NO: 113744 - protein, 49 aa, Glycine max
  Coding DNA Sequence Number=SeqID_22059
MRLKNQGSHSVHYASHQGNQGAEKKFVKKHDKGKGSLKINDDSLQIQKK

SEQ ID NO: 113745 - protein, 106 aa, Glycine max
  Coding DNA Sequence Number=SeqID_22060
  Homolog annotation: Hit_ID=Q2HTA0; Match level="QueryCoverage=89%, HitCoverage=15%, E-value=1e-15, Identity=47%"; Hit description=IMP dehydrogenase/GMP reductase, related
  Pfam annotation: Domain name=DUF1723; Domain location=43-92; Score =66.6; E_value=8.5e-17; Accession=PF08330.1; Description=Protein of unknown function (DUF1723)
ERPDLKLVSHGRKVTLIGRPVLEIEGLVSATGLSPLIDCSVLTGDPGLISAFVERWHNETSTFHLPVGELTITLDDVSSLLHLPITGALHSFHALSTEEARFLLTE

SEQ ID NO: 113746 - protein, 76 aa, Glycine max
  Coding DNA Sequence Number=SeqID_22061
MLYGALTKPVLELESWVSRGGARADEGRHGGHERANGGHDEHEEDNGSPMRLQLPLPALLLRNGKVGSSRGKAQGH

SEQ ID NO: 113747 - protein, 115 aa, Glycine max
  Coding DNA Sequence Number=SeqID_22062
SPHQLDLAPYASEPYNAQWNAPGLLRDKHTLRSSRILGEMEVDEPWLGLWLPLNYQVDMGSSLAYDTGIWGESYRLFAAKFISWLVFFLESFTAWVSPSFSPSSFAPVFSVILVG

SEQ ID NO: 113748 - protein, 70 aa, Glycine max
  Coding DNA Sequence Number=SeqID_22063
MEAIKEQMATMMKAMMSMKKIMEAYAVIVAAISAVAKVNPMLPSGLKQMNHPTSIWNGKVGSSRGKAQGH

SEQ ID NO: 113749 - protein, 142 aa, Glycine max
  Coding DNA Sequence Number=SeqID_22064
MKKKLLQTVDERLRQFKLDLTRKWALVANQDGVDDTVCEKYDISKEKWAQFCQTRRDPSWEDVRKKALAIQKQNTAPHVLSREGYEYLEQKLLAEKTKKKLEEALMASSTLHPPIPLRSSRTQGCFIPRGRQDYFHPLLMDV

SEQ ID NO: 113750 - protein, 96 aa, Glycine max
  Coding DNA Sequence Number=SeqID_22065
MASKAANYNKLPSPIVRSPERLRSQDYLGEATKERIEGFFSTKSLRWILRILIQLKCSSWCGGSAASSSDSWWPLVVVGGGEEGVRVWVGVWRGGE

SEQ ID NO: 113751 - protein, 118 aa, Glycine max
  Coding DNA Sequence Number=SeqID_22066
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=25%, E-value=4e-31, Identity=75%"; Hit description=DNA -directed RNA polymerase subunit beta
  Pfam annotation: Domain name=RNA_pol_Rpb2_3; Domain location=1-45; Score=48.8; E_value=1.8e-11; Accession=PF04565.7; Description=RNA polymerase Rpb2, domain 3
LTGRTASFRIRDIHPSHYGRICPIDTSEGINVGLIGSLAIHARIGNSLALNRDIQEEQTVPARYRQEFLTIAWEQGQILADGAATVDGELALGKNVLVAYMPWEGYNSEDAVLINERL

SEQ ID NO: 113752 - protein, 81 aa, Glycine max
  Coding DNA Sequence Number=SeqID_22067
MLVRMIHTRLFAAAQVNLAPETTGPLTGSASLGEASKGKGPYILLSPLKVIGTSTQGFTFMRKQEIDSSRGPVIQQDWTRD

SEQ ID NO: 113753 - protein, 179 aa, Glycine max
  Coding DNA Sequence Number=SeqID_22068
  Gene Ontology: Mol. function=chloramphenicol O-acetyltransferase activity; Biological process=response to antibiotic
  Homolog annotation: Hit_ID=P62577; Match level="QueryCoverage=56%, HitCoverage=46%, E-value=1e-54, Identity=98%"; Hit description =Chloramphenicol acetyltransferase
  Pfam annotation: Domain name=CAT; Domain location=21-176; Score =103.6; E_value=5.9e-28; Accession=PF00302.9; Description =Chloramphenicol acetyltransferase
VDGIDKLDARAKEAKMEKKITGYTTVDLSQWHRKEHFEAFQSVAQCTYNQTVQLDITAFLKTVKKNKHKFYPAFIHILARLMNAHPEFRMAMKDGELVIWDSVHPCYTVFHEQTERFYRSGVNTTTISGRFYTYIRKMWRVTVKTWPISLKGLLIKCFTSHTIPGFIMPFVMASMSQNA

SEQ ID NO: 113754 - protein, 192 aa, Glycine max
  Coding DNA Sequence Number=SeqID_22069
TLVVVEEGETLCGYSRFVLLRPDPQELAAKLCIPGREFELNADEQPLKILRKSMTTLAQTWSVLSFSNQIPISHTSDVTLDRAKLICGIIMKMDMNVGYLISHQISLIAQHDTSRLGFPALITTLCKARGVQLDSRSLESLSPAINLAYIKKNCWNLDDPTITFRGPRKARGERSEAPSTSASEALAPSSST

SEQ ID NO: 113755 - protein, 154 aa, Glycine max
  Coding DNA Sequence Number=SeqID_22070
MLVRMIRTRLFAAARVKSCPGMHSSCVIASLSGCARTGGAPPISGGGPSGEEPLKGNYCPLKVRTRSPLKERVCSPLKFRTCRPFKARSVVLTVEGPLMVRTCSPLKARTCSPLNGEVPKVRACNPLKARTTGPLKVRACSPLMVRTCSPLNGE

SEQ ID NO: 113756 - protein, 138 aa, Glycine max
  Coding DNA Sequence Number=SeqID_22071
HALAFRGLHVLPFRGLHVLPFRGLDVLSFRGLHVLTFRGLHLVPFRGLQDYTSSSSEDYMPSPSEGYAPSPSEGYTPSPSKDYTSTPSEDCMSRPSEDYMSSSSKDYTSSPSEDYTSSPLEDYMSSPSESRTPSPLED

SEQ ID NO: 113757 - protein, 239 aa, Glycine max
  Coding DNA Sequence Number=SeqID_22072
MSSHQRTTRPHLQRTTRPHLRGLHALAIRGLHVLTFVGLHALTVERASRPRHQRTACPHPQRTARPHFQRTARPHPQRTTRPHPQRTTQDLHALAIRGLHVLTFVGLHTLTFRGLHALAIRGLHVLTLRGLHVLTFRGLHVLTLRGLHAFTSRGLHVLALGTSYPHLQRTTHPRLERTTRPHHQRAARPHHQRTARPRLRSATCPHIRGLHVLTFRGLRVLTLEDYTPSPSEDYTSSPS

SEQ ID NO: 113758 - protein, 95 aa, Glycine max
  Coding DNA Sequence Number=SeqID_22073
MAPKKLSTKRSRRDAQVESSSAPMEFDSHRFRSAEHQQRFEAIKGWSFHREKRVQLREDEYSDFQEEIACRHWTPLVTLMAKFDPEIVLEFYANA

SEQ ID NO: 113759 - protein, 240 aa, Glycine max
  Coding DNA Sequence Number=SeqID_22074
MAPKKLSTKRSRKDATGEGSSVAPQADMDFDRHRFWSTEHQQWFEAIKGWSFLRERRVQLRDKEYVEFQEEIARRQWAQLVSPMAKFDPEIVIAYRRRSQRHALLGQRCEFSQRRSQASDFEDYASEIPSGPEGFLALITGLCQFYGMEEGVGSGTPAAKGIPAAAAVDAPPPPLEEDLSPFPWPTPEQFEATVAWPGDKTDFKTQAGPTGALGMTKELRRITTWLTCWTSSLDKAELHD

SEQ ID NO: 113760 - protein, 81 aa, Glycine max
  Coding DNA Sequence Number=SeqID_22075
  Homolog annotation: Hit_ID=A5B7I7; Match level="QueryCoverage=55%, HitCoverage=5%, E-value=4e-15, Identity=88%"; Hit description =Putative uncharacterized protein
MQGCLSYRKPIDSERWIYVGDGFLPIQILLELVHSWSSTKSKHIDIKFLVVQEMVQSGQISIEHLGTNSMIVDPLTKGLPP

SEQ ID NO: 113761 - protein, 68 aa, Glycine max
  Coding DNA Sequence Number=SeqID_22076
ASKALLPQRGPQAYANLLGQVLFHPSFLGAHLHLLKGIREGHNAGWRSSGKENPQALDSLEGLGNEPG

SEQ ID NO: 113762 - protein, 139 aa, Glycine max
  Coding DNA Sequence Number=SeqID_22077
MLESFQQQDQMSILELYIEKDVAGGSMFHFANSLTSCGKTLSNNEAQSPRNVSNLHESLDEDDSVDNISDTDDEVTDMIQPVRIVHPAEGVEGIQKSIFGMMLCIYNNINWSHPDEEDICGLEMPSNFNVGKNICWHGF

SEQ ID NO: 113763 - protein, 73 aa, Glycine max
  Coding DNA Sequence Number=SeqID_22078
  Homolog annotation: Hit_ID=A2Q141; Match level="QueryCoverage=82%, HitCoverage=16%, E-value=8e-07, Identity=45%"; Hit description =Transposase, putative
MQHLMKLLEHDQYIHWHRLKDEVVVRDLFWCHPDAVKLCNACHLVFFFIDSTYKTNRFRIDKNVKAKCKSLIG

SEQ ID NO: 113764 - protein, 225 aa, Glycine max
  Coding DNA Sequence Number=SeqID_22079
MSYTSKDYMSSTSEDYTFSPLEHYMSLPYEGYTASPSEDYTPSPSEDYTSSPSEDYTCSHLQRITQPRLPRARRPRLQRSTHPPLERATRPRLRRVTHPYLQRSTRTQHQRTIHRRHQRLHVLAFRGLHVLHFRGLHAHTFKGYLHRTTRPWLRKASRPHLQRTTHARLQRTTRLCLRRATRPHLQRTTHPRFLSDTCPRLQRTTRLTFQGSARPCLQWATRPCL

SEQ ID NO: 113765 - protein, 131 aa, Glycine max
  Coding DNA Sequence Number=SeqID_22080
FGYCKERDGSWVKKNAPIQAAEDRSPSPHSQRDDSSSLLHSILERFDGLQTYVGERIVIIKKGEIVEAMLSKIILMMPKTQVKNQESSKFQESKGHSINASFKNQRVIKSKQVSRIKELFNQSKFQESRLK

SEQ ID NO: 113766 - protein, 123 aa, Glycine max
  Coding DNA Sequence Number=SeqID_22081
MGLYMCPVVGRLLANQMPQILLRIKRSGWTGLMRWRRICGLRSIPLGLSLRAILLNKSSGDGRPNHLARCDRESERLAESCDQGGKSQGPVGLIRVQRVPGWCTPADTSVGGGRNYGRWAGCC

SEQ ID NO: 113767 - protein, 63 aa, Glycine max
  Coding DNA Sequence Number=SeqID_22082
  Homolog annotation: Hit_ID=Q6WAY3; Match level="QueryCoverage=63%, HitCoverage=1%, E-value=3e-08, Identity=62%"; Hit description =Gag/pol polyprotein
MVAITSSRFPQPPFLRGYDSNATCAYHGGAPGHSIEHCRALKHKVQGLIDAGWLKFEENCVEK

SEQ ID NO: 113768 - protein, 93 aa, Glycine max
  Coding DNA Sequence Number=SeqID_22083
MKKIFLLCTDTFQRVTIGKPREFIDRPSDLNIWEAIELGPQDIPKSYSATRCQAQVTTRPKNLEMKCIEEDRKRKIQYDLKKPKTYIRPRNRQ

SEQ ID NO: 113769 - protein, 41 aa, Glycine max
  Coding DNA Sequence Number=SeqID_22084
MNLRGRLLLPMMTGIPLCLITLIMKVADPTCITARTCSGSV

SEQ ID NO: 113770 - protein, 106 aa, Glycine max
  Coding DNA Sequence Number=SeqID_22085
  Subcellular localization annotation: CTP_CleavageSite=38; ConfidenceScore=5.45e-01
MPISPCGSISWSVPSRHRDRTHKTPSGPRKVQQGPGVSSSGYGPLSVLQGARTPRQGHVIIGIAPARHPVDPKKSNRVLELSSSNYGSLSILRSTYHLQQGHQAPY

SEQ ID NO: 113771 - protein, 67 aa, Glycine max
  Coding DNA Sequence Number=SeqID_22086
MASKKLSPKRSRRDAAAEGSSATPEFDSHRFRSTEHQQRFEAIKGWSFHRERRVQLREDEYMDFQRR

SEQ ID NO: 113772 - protein, 70 aa, Glycine max
  Coding DNA Sequence Number=SeqID_22087
MILSSWQNKLDKYFMCKTLVMKGEDDDAYMDTYVSPLSTQITLNVVGEEEADDVHANHNDHDEGELINIV

SEQ ID NO: 113773 - protein, 173 aa, Glycine max
  Coding DNA Sequence Number=SeqID_22088
  Gene Ontology: Mol. function=structural constituent of ribosome; Cellular component=ribonucleoprotein complex; Biological process =translation
  Homolog annotation: Hit_ID=A4GYN8; Match level="QueryCoverage=51%, HitCoverage=65%, E-value=5e-43, Identity=98%"; Hit description =Chloroplast 30S ribosomal protein S12 B
  Pfam annotation: Domain name=Ribosomal_S12; Domain location=54-172; Score=151.7; E_value=2e-42; Accession=PF00164.16; Description =Ribosomal protein S12
MDKLLFLGTHIRYHEKDNDIPSTQHRSSKGSRRPTNARKPGSFRKWIPIRRVHNRMDKLTLTRQFGIQFGSLGGIGKEFWNSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 113774 - protein, 103 aa, Glycine max
  Coding DNA Sequence Number=SeqID_22089
  Homolog annotation: Hit_ID=A0ST23; Match level="QueryCoverage=24%, HitCoverage=51%, E-value=3e-07, Identity=100%"; Hit description =Putative reverse transcriptase
MAKIVVRETLVRRLNNIFVTNARGARYQLLFPLVRVNFELGVIMVIAVSFGKPVVPAALMNRPTRGERRFAYWALAECILAYYVGTDEGVSEVLHVAGEKGCT

SEQ ID NO: 113775 - protein, 70 aa, Glycine max
  Coding DNA Sequence Number=SeqID_22090
  Homolog annotation: Hit_ID=P03845; Match level="QueryCoverage=60%, HitCoverage=100%, E-value=9e-12, Identity=76%"; Hit description =Putative uncharacterized protein 1
MDNFFAPRFHHGQILYARRQGADAAGDSVVLLHVFPGWTQDDSYRIRRSGRTERGVRAYSPAWSELPTRN

SEQ ID NO: 113776 - protein, 164 aa, Glycine max
  Coding DNA Sequence Number=SeqID_22091
  Homolog annotation: Hit_ID=Q2HTA0; Match level="QueryCoverage=57%, HitCoverage=15%, E-value=1e-06, Identity=33%"; Hit description=IMP dehydrogenase/GMP reductase, related
HRGFRAFKEISSFQGQLRWGHMVVTVRPKRVVRQFGYIQSIPPPPVSARLSHDQIDDRWMQFADHLLPAGQLCLVPGQVSADYMEWFFRISHPFMTPTQAGDQRRDAPAVDPEDYIQPPSPQVPVAFDPPPHVDDYEGYEAIAQRLERVLNLRIVTAGTELYDI

SEQ ID NO: 113777 - protein, 184 aa, Glycine max
  Coding DNA Sequence Number=SeqID_22092
  Subcellular localization annotation: CTP_CleavageSite=74; ConfidenceScore=5.19e-01
MGNHPRPNFNAGGYSGFQHGQQFNQQLGQWRTHPSNQFNKDQGRPSNRPQQQGPNLYDRTTKLEETLAQFMQVSMSNQKSTESAIKNLEVQVGQLAKQLADRPSSSFGANTEKNPKEECKVVMTRSKMVSMNEGNKRMGEEKQQLMTEPKIAPVVEPLSETEEEVEAKDDQQKEIPIIVSEKNK

SEQ ID NO: 113778 - protein, 203 aa, Glycine max
  Coding DNA Sequence Number=SeqID_22093
  Gene Ontology: Biological process=transposition, DNA-mediated
  Homolog annotation: Hit_ID=Q1J7G7; Match level="QueryCoverage=22%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLNSMELDKTNKEKQSLLSKIKKLEAEKQAGAGGARYQLLFPLVRVNFELGVIMVIAVSFGKPVVPAALMNRPTRGERRFAYWALAECILAYYVGTDEGVSEVLHVAGEKRLH

SEQ ID NO: 113779 - protein, 80 aa, Glycine max
  Coding DNA Sequence Number=SeqID_22094
  Homolog annotation: Hit_ID=A0ST23; Match level="QueryCoverage=33%, HitCoverage=55%, E-value=2e-08, Identity=100%"; Hit description =Putative reverse transcriptase
VSAALFALFKSTTIKLIDTVDLEGGPVGKPVVPAALMNRPTRGERRFAYWALAECILAYYVGTDEGVSEVLHVAGEKRLH

SEQ ID NO: 113780 - protein, 81 aa, Glycine max
  Coding DNA Sequence Number=SeqID_22095
  Homolog annotation: Hit_ID=A5BKI9; Match level="QueryCoverage=100%, HitCoverage=9%, E-value=7e-11, Identity=40%"; Hit description =Putative uncharacterized protein
MIENMCALQSTGTWDLLPFPPGKSTDGCHLLYTIKFAPMVPLINSSLFWYQMIYTSVQMYMEQPQGFVAQGESSTMVCQLQ

SEQ ID NO: 113781 - protein, 55 aa, Glycine max
  Coding DNA Sequence Number=SeqID_22096
MTHNANYKILKELAPTSKALVIQDVQGINETLGLIRILVVDLKRANKAALTLVNF

SEQ ID NO: 113782 - protein, 103 aa, Glycine max
  Coding DNA Sequence Number=SeqID_22097
EEGQECAPPPPHQAGPAGSFDMEQYLRHLVRQQAANHRAHSQGFASFSCPTPDQFRAEVAWPGDWPEAQAGEAPPEAPDDGEEAHEDEEMADLLDFLGGSGAT

SEQ ID NO: 113783 - protein, 87 aa, Glycine max
  Coding DNA Sequence Number=SeqID_22098
  Homolog annotation: Hit_ID=A0ST23; Match level="QueryCoverage=48%, HitCoverage=87%, E-value=1e-08, Identity=72%"; Hit description =Putative reverse transcriptase
MCPLPPWSNEEGDTFETLSDIKLIDTVDLEGGPVGKPVVPAALMNRPTRGERRFAYWALAECILAYYVGTDEGVSEVLHVAGEKRLH

SEQ ID NO: 113784 - protein, 300 aa, Glycine max
  Coding DNA Sequence Number=SeqID_22099
  Subcellular localization annotation: CTP_CleavageSite=29; ConfidenceScore=5.46e-01
MCVMKWPQGSLPQRGPGRTRQPKELVPLRSMTVTALGALYTSSASRPSRGWSFLRERRVQLRDDEYTDFQEEIGRRRWASLVTPMAKFDPEIVLNEFYANAWPTEEGVRDMRSWVRGQWIPFDADAISQLLGYPLVLEEGQECEYGQRRNRSDGFDEEAIAQLLCIPGQDFARTAAGRRVRIMRTNMTTLTQIWMTLLLSNIVPTDHNSDLPLPKCQLVYAILTRMSVHVAQLIADAIYIFAGMAPTRHPLDPDKSNRALGFPALITGLCQSFGVPVTPSKVIRPPITRAFIEKYCTQRQ

SEQ ID NO: 113785 - protein, 197 aa, Glycine max
  Coding DNA Sequence Number=SeqID_22100
MSVSIYYEIHSDIRVKSYCRLILLKASVMNFECLDILRDTIGHPSKKLLTFEFAHSIRCQLRASRYIKGGGSDIRVKRGVSFYFAQSFCFQFRASRYITGLNRISESKVIVVWICYELPVSITSVSICYGTQSDIRVKSYCRVNLLRASVVNYERLDILQDSFGHPSKKSLSFDFGQGFCSEFRASRYTTGHIRTSE

SEQ ID NO: 113786 - protein, 42 aa, Glycine max
  Coding DNA Sequence Number=SeqID_22101
MRAVAEKPGGTEGAERKLEEGIWESEGVEAETGGDRSGLRLK

SEQ ID NO: 113787 - protein, 54 aa, Glycine max
  Coding DNA Sequence Number=SeqID_22102
VSSLGRAELAWASNPCTKWVKKGKGEGFYTKNSSPPPPPLIQKEGYGNHQFCSP

SEQ ID NO: 113788 - protein, 272 aa, Glycine max
  Coding DNA Sequence Number=SeqID_22103
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=29%, HitCoverage=73%, E-value=2e-37, Identity=96%"; Hit description =Chromosome undetermined scaffold_79, whole genome shotgun sequence
  Pfam annotation: Domain name=Complex1_49kDa; Domain location=44-246; Score=-48.1; E_value=2.1e-09; Accession=PF00346.10; Description =Respiratory-chain NADH dehydrogenase,
VPLMIILCVLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQGHALSENAYAGYLTKIANFAGKMTTGSSVYSTSIHHFELYTEGFSVPAPSTYTAVEAPKGEFGVFLVSNGSNRPYRRKIRAPGSAHSQGLDSLSKHHMPADVVTIIVDEIGRVVSVGDGIARVYGLNEIQAGENG

SEQ ID NO: 113789 - protein, 156 aa, Glycine max
  Coding DNA Sequence Number=SeqID_22104
MLPYYFQIPLGAILPIVDPVVAVSPPKPPPKPDLEVDDPLYLMTLTIPELFLRPYQVRWDATVFGVVNPDFPLYIKHEDLSEIAHGGQCLSISVLQLWILHLTETCMRAGNSDIYGFLEPQSIQRSRQSQFESESYIKSWMQSSQRDVYLGAYLNG

SEQ ID NO: 113790 - protein, 205 aa, Glycine max
  Coding DNA Sequence Number=SeqID_22105
MISIAQSNSCRLGFPALITALCRARGVVSDSLTFERLSPAINLADIRKNCWNIDDLTIAFRGARRARARPTDIPSTSAAPTSTFAAPSVLAHVDSQRFEAMLQNIHQGSILSVEQFLERVAWPGAQPSLDRESEGPTAQVPQQAGEEQARPETAATPERSLEGTSEPHTPVANFLFPNCNYFLFIYVSRKFQWGFIGKRTGSSSI

SEQ ID NO: 113791 - protein, 75 aa, Glycine max
  Coding DNA Sequence Number=SeqID_22106
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=10%, E-value=4e-31, Identity=66%"; Hit description=DNA -directed RNA polymerase subunit beta
  Pfam annotation: Domain name=RNA_pol_Rpb2_3; Domain location=1-45; Score=48.8; E_value=1.8e-11; Accession=PF04565.7; Description=RNA polymerase Rpb2, domain 3
LTGRTASFRIRDIHPSHYGRICPIDTSEGINVGLIGSLAIHARIGNSLALNRDIQEEQTVPARYRQEFLTIAWEQ

SEQ ID NO: 113792 - protein, 262 aa, Glycine max
  Coding DNA Sequence Number=SeqID_22107
  Gene Ontology: Mol. function=unfolded protein binding; Cellular component=plasma membrane; Biological process=response to stress
  Homolog annotation: Hit_ID=P50019; Match level="QueryCoverage=96%, HitCoverage=39%, E-value=1e-112, Identity=84%"; Hit description =Chaperone protein dnaK
  Pfam annotation: Domain name=HSP70; Domain location=1-228; Score= -31.4; E_value=8e-13; Accession=PF00012.11; Description=Hsp70 protein
AGVLQGDVKDVLLLDVTPLSLGIETLGGVFTRLIERNTTIPTKKSQTFSTADDNQQAVTIRVSQGEREMAQDNKLLGQFDLVGLPPAPRGVPQIEVTFDIDANGIVQVSAKDKGTGKEQQIRIQASGGLSDADIEKMVKDAEANAEADKKRREAVEAKNQAESLVHSTEKSLKDYGDKVSEADRTAISDAIAALKSSIEATEPDAEDIKAKTQTLMEVSMKLGQAIYEAQQAEAGTADASAGDDNVVDADYEKSRRRPQKSA

SEQ ID NO: 113793 - protein, 155 aa, Glycine max
  Coding DNA Sequence Number=SeqID_22108
  Gene Ontology: Mol. function=peptidase activity; Cellular component =cytoplasm; Biological process=proteolysis
  Homolog annotation: Hit_ID=P76403; Match level="QueryCoverage=89%, HitCoverage=30%, E-value=7e-73, Identity=97%"; Hit description =Uncharacterized protease yegQ
  Pfam annotation: Domain name=Peptidase_U32; Domain location=75-155; Score=-48.8; E_value=0.00015; Accession=PF01136.10; Description =Peptidase family U32
MFKPELLSPAGTLQNMRYAFAYGADAVYAGQPRYSLRVRNNEFNHENLQLGINEAHALGKKFYVVVNIAPHNAKLKTFIRDLKPVVEMGPDALIMSDPGLIMLVRENFPEMDIHLSVQANAVNWATVKFWKQMGLTRVILSRELSLEEIEEIRTQ

SEQ ID NO: 113794 - protein, 57 aa, Glycine max
  Coding DNA Sequence Number=SeqID_22109
MKNIPDSGVVFTFEEGISTSHVDKSGALAPTYPSSKRKSDLRSSFKRANQTILFTWK

SEQ ID NO: 113795 - protein, 151 aa, Glycine max
  Coding DNA Sequence Number=SeqID_22110
  Subcellular localization annotation: CTP_CleavageSite=18; ConfidenceScore=5.06e-01
MPQIKCARDFKRSMRGCPCSYVSSSAMRNSYLPSSLKTKRAIKVLDLERSQAKGHFGVVVARLGELKLSAEAMSSPRRAGFFTMKLFGGLSEPEASLGKLGSRKPRKRPFCPLFLVFFAFFIKTLKDHLFRTVTGVQHCKSTSKDQKINER

SEQ ID NO: 113796 - protein, 113 aa, Glycine max
  Coding DNA Sequence Number=SeqID_22111
  Subcellular localization annotation: CTP_CleavageSite=72; ConfidenceScore=5.41e-01
DCTHKTPSGPKGVQQGPGISSSGYGPLSVLQGARSPQQGITPARNPVDPKKSNRVLGFLALVTGLCQFYGVPAAPNKVIRPPINWIFIEKYYAPGRRRARHHSSGQQAHRHHL

SEQ ID NO: 113797 - protein, 92 aa, Glycine max
  Coding DNA Sequence Number=SeqID_22112
MGEVEDVQEKMKADMEAMKEQMATMMEAMMIMKKIMEASAIAVAATSTVAKTHEIPYHNLANFEPCLGYATEGQAVGGIPLQNPLEGPQYHP

SEQ ID NO: 113798 - protein, 112 aa, Glycine max
  Coding DNA Sequence Number=SeqID_22113
LSLASKTDETSIVEKLRKEVAFLTNDFGKFPESSKTLTTLSKLHQHPHDKSYLGFEKGTTSFESLSALDKCDFYGKGQGLSWYKDNGCSRHMTRERSMFLDLKPHERGVVAL

SEQ ID NO: 113799 - protein, 151 aa, Glycine max
  Coding DNA Sequence Number=SeqID_22114
  Homolog annotation: Hit_ID=Q6WAY6; Match level="QueryCoverage=86%, HitCoverage=27%, E-value=2e-07, Identity=28%"; Hit description =Putative uncharacterized protein
MGTNQTGKRFYQVKIKGLDITSIKELGRLMGPLQMQASRKTYGKILDLTIAEISPEAIASLTQYYDQPLRCFTKPYLFSGFLPSLSKIAVVVRDPARGLDRVKQTRNGIVGLPQKYLEGKAMDMVNQEEWVPFMDVLALLIFGVVLFPNVD

SEQ ID NO: 113800 - protein, 108 aa, Glycine max
  Coding DNA Sequence Number=SeqID_22115
MDKSLKEGEDEWRETERKSTKFYASNEPMDSKSILRLMRTLGPSLTSLVQSSWSLLSNALEGISLQLKHSSLSGGSATSNSGSWWPPMVMGGGEEGVRVWVGVWRGGE

SEQ ID NO: 113801 - protein, 189 aa, Glycine max
  Coding DNA Sequence Number=SeqID_22116
MAKYNLEMVMEFYANAWPTEEGVSDKCSWVRGHWIPFDEDAINQFLGHPLVLEEGQCCEFSQRKSQASGDHTSQTPSGPGEVQQALGFPDLITSLCQSYGVPVGAGSGTAVASRRCTVAPSTGDTVPGVHLRSPGESQDTRPFLWPTPEQFEATVAWPRDEPDFETGQDPQRPLGTTRELRRMMIWLMC

SEQ ID NO: 113802 - protein, 53 aa, Glycine max
  Coding DNA Sequence Number=SeqID_22117
MRIRATWEYVSSVEEWYLEICRGGQETLGTSGGVLLPKTKLDQSRPNPGVVSQ

SEQ ID NO: 113803 - protein, 241 aa, Glycine max
  Coding DNA Sequence Number=SeqID_22118
MASLVDWLARLKVVSEESFEAPEEDEEVQALKSELGKAKLAKEKFKLATTHIRKECAGLREENATTARALEQETKRARKEEYGRNKFRRALWGSNNELKLRREERDQSRAHSIVLKEELVACSRSKRSLSQRLCEMETNMLAIIAKYQEVLGLATAHERRVADEYAQVYAEKEARGRVIDSLHQEATMWMDRFALTLNGSQELSPLVSQGQGDGRHLLRPRRDSWASRLLSAYDKLNGPHN

SEQ ID NO: 113804 - protein, 208 aa, Glycine max
  Coding DNA Sequence Number=SeqID_22119
  Gene Ontology: Mol. function=motor activity; Cellular component=cell projection
  Homolog annotation: Hit_ID=UPI00006A2D9E; Match level="QueryCoverage =89%, HitCoverage=87%, E-value=1e-13, Identity=16%"; Hit description =UPI00006A2D9E related cluster
MRGTVHEPQRTTLLANRGLHALTLRGLCVLTFRGLHVLTFRGLHALAIRGLHVLTFRGLHALAIRGLHVLTFRALHALAIRGLHVLTFVGLHALTFRGLHVLANRGLHALTLRGLHVLANVGLHALTFRGLHVLANRGLHALTFRGLHILAFRGLHVLTLRGLHVLALRGLHVLALRGLHVLTIRGLHALTSRGLHVLALRGLRGSSR

SEQ ID NO: 113805 - protein, 205 aa, Glycine max
  Coding DNA Sequence Number=SeqID_22120
MEGEQLMPSSRMIDRGRLEVGDEGSEEQHTRMQSADERSFGRPKPLVVYFTRDSAPQTPQHPSIFKPVPFPYRNSHAVPWRYAPPSERKEEATNISLLSAKVTNITGLSGVTRSNHVFAPPDLPTQPANVKGKAKMVEEQNDKTTLTLNEDIPVKGLLEKRDGCGKKDVSLEEAGEFLRIIQQCEFKVIEQLNKPWPRSLFWNYS

SEQ ID NO: 113806 - protein, 160 aa, Glycine max
  Coding DNA Sequence Number=SeqID_22121
  Subcellular localization annotation: CTP_CleavageSite=38; ConfidenceScore=5.07e-01
MPISPCGSISWSVPSRHRGRAHKTPSGPGEVQQGPGVSSSDYGPLSVLRGARTAQQGIAPAGHLVDPKKSNRVLGFPTLITGLCQFYGVLVTPSKVIRPRINRAFIMKYCAPRQAEGKTPQQPGDGWQQVTKSKAKGKQSTRSVTDKSSGVQLKTLKKRY

SEQ ID NO: 113807 - protein, 53 aa, Glycine max
  Coding DNA Sequence Number=SeqID_22122
MASYGVASPIMFLLLHSTAIKLQEAKGSIDKEDPRPTSSIRATSCGIRASSSR

SEQ ID NO: 113808 - protein, 70 aa, Glycine max
  Coding DNA Sequence Number=SeqID_22123
MARSVSASCPYSRDLYGRELTRLLVIIPKVVISLLMVSRGIIPFEEHTATVGTTSNNMFSKRKTLDEGSL

SEQ ID NO: 113809 - protein, 93 aa, Glycine max
  Coding DNA Sequence Number=SeqID_22124
MGITPTETPIGPEEVQQGPGVSSSGYGPLSALQGARSPPASSCRCGIGKECLSPPARSSGPPLPIELSSRSTAPPGRRRAKHHISIGMAGSGQ

SEQ ID NO: 113810 - protein, 118 aa, Glycine max
  Coding DNA Sequence Number=SeqID_22125
MVGYTPSSFADLVFTDERIKVGLEKGKSDHPALMNAKTGANEEDGNEGETLAMTAIPTRSNFPSAQQCHYSANNNPSHPIIHKSHPQISHKAYLLTTRLMPKHHLQCKPKKNFAAKSL

SEQ ID NO: 113811 - protein, 118 aa, Glycine max
  Coding DNA Sequence Number=SeqID_22126
MAAQLIHDRVVMECLEVHPEQPAHTLQQPVEWILPTPTPYRLVEPVQVIEVSSSEEDLEEDPEELPPVPAMDAPDLPEDDEDPLPDVDSPEDIILASEADSTEESGPGGTTNSDDSSS

SEQ ID NO: 113812 - protein, 136 aa, Glycine max
  Coding DNA Sequence Number=SeqID_22127
MEMMQKTLHGMQMGETAIECSVIQLIPPTYGNLSGYSVKGHRGCPIFEEDTSYIQLKHGLPAGSTPKCGIWKDLKEGKKLISGLNTHPPLSAIEESGRASISRPHAKREISVLSAVVVFSQDQRTTSVKLKSTYLR

SEQ ID NO: 113813 - protein, 79 aa, Glycine max
  Coding DNA Sequence Number=SeqID_22128
MGDHLEDMIRDLGQESFQQAHAPVCEALQSDLKKPLYMGCKNSLTLLSVVLSLVNVKDRHEFQEMSKCPICGTSRYKVR

SEQ ID NO: 113814 - protein, 164 aa, Glycine max
  Coding DNA Sequence Number=SeqID_22129
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIMRGQDIYSIQDEATTSPTSRKSEEAKGEESSEEIYLQEEGQLLMVKEECKEVSVSSKRLAKKEIHFEIKTNIKEISPLLQPTLLRVSEARLTGASSIGGKCAESPPTLIERKTLEKPKETGHEEYSRFRSYHYV

SEQ ID NO: 113815 - protein, 300 aa, Glycine max
  Coding DNA Sequence Number=SeqID_22130
  Gene Ontology: Mol. function=helicase activity; Biological process =viral genome replication
  Homolog annotation: Hit_ID=Q2A9E0; Match level="QueryCoverage=99%, HitCoverage=19%, E-value=8e-62, Identity=43%"; Hit description =Putative uncharacterized protein
MPNNPPKFAQLYIYDTDNEIINRLSQNPLVFILMSHMMHDMLDEQIIIAIKDMLDHHNHYAQKFRMARDKLHSAVVPDLKMKLISQRQTNGRLYNLPTTTEVAALIVGDEHSADKRDIIIEKQSRLLKRIHELHPAYLPLQYPLLYPKGEDGYRLNIPHKDHANIHAAKRKQVTLHEYFSYRLQSRTDEAQTILHSRRLFQQWIVDGYCMIESQKLNYVSQHQQQLRVDKYINLIGSNDHPQTLGRDRGKRIILPSSFVGGQRYIEQLYFDGMAICGHLGFPDLFLTMTCNPTWPEIRRK

SEQ ID NO: 113816 - protein, 164 aa, Glycine max
  Coding DNA Sequence Number=SeqID_22131
  Gene Ontology: Mol. function=motor activity; Cellular component=cell projection
  Homolog annotation: Hit_ID=UPI00016621D1; Match level="QueryCoverage =97%, HitCoverage=40%, E-value=3e-12, Identity=32%"; Hit description =UPI00016621D1 related cluster
MHVLVFRGFLALTFRGLLVLPFRGLHILAFRGLHALTFRGLHILTFRGLHVLAFKGLHVLHFRGLHVLPFRGLHILAIRGLHVLTFRGLHALIGLHALTFIGLHVFTFGGLHTFAFRGLHALAFKGRHVLDFRGLHALAFRGLRLLTFSGLHIRTLREFKVLRP

SEQ ID NO: 113817 - protein, 139 aa, Glycine max
  Coding DNA Sequence Number=SeqID_22132
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=70%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRAFAVTHHPVSS

SEQ ID NO: 113818 - protein, 297 aa, Glycine max
  Coding DNA Sequence Number=SeqID_22133
  Homolog annotation: Hit_ID=Q6WAY6; Match level="QueryCoverage=69%, HitCoverage=33%, E-value=4e-20, Identity=34%"; Hit description =Putative uncharacterized protein
MWMGGVDLAAIDAFLAYHNHKESPVVAMLADLYDTFDRRCEKSNTRIVCCTPALYVWLVSHLFRQEVRHACLLESHCSCTEKGGANWDQLLANKEGASVNWFPRWKEGRTKVLISCGGFPNVPLMGTRGCISYNPVLAIRQLGYPMRGAPLEDELAPVISQGFNKTNMETLQKVRKAWEVLQKKDKELRGSNNGPIGGYRKWLKAHVQGLDWLPSLRTAKRKEVEAPEEDEEVQVLRTELKQAQTVKERYKSAALKIRKENAELRDINIATTKALEQETKRARREEHGRNSSEGLCG

SEQ ID NO: 113819 - protein, 283 aa, Glycine max
  Coding DNA Sequence Number=SeqID_22134
MRATGEGSSAALEFDSHRFQSAEHQQCFEAIKGWSFHRERRVQLREDEYPDFQGEIACGHWARLVIPMAIFDPEIVIEFYANAWPTEEGVQDMRSWVRGHWIPFDADALSQFLGNPLILEDNQQCEFSQRRNQTDSFDEEAIAQLLCILGKDFARTAAGRRVRIMRTSMTTLTQIWMTLVLNNVLPSDHNSDLPLPKCQLVYAILIRMSVHVAQVIADAIYFFAGMAPTRHPLDPEKSNRALGFSALITGLYQLYGVHVTLSKVIRLPITRALIEKYCTPRQA

SEQ ID NO: 113820 - protein, 66 aa, Glycine max
  Coding DNA Sequence Number=SeqID_22135
MAVSGGGSRASSNNTPKVWPMLFYDQEVNSMSIILKVGHVVLNTVHADLAQLMLTPTMLPNCHQYK

SEQ ID NO: 113821 - protein, 199 aa, Glycine max
  Coding DNA Sequence Number=SeqID_22136
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLKLQKAFGTKKKKKFKEIQGLLFMSGQEDHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 113822 - protein, 214 aa, Glycine max
  Coding DNA Sequence Number=SeqID_22137
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=71%, E-value=3e-24, Identity=69%"; Hit description=LacZ protein
  Subcellular localization annotation: CTP_CleavageSite=50; ConfidenceScore=5.47e-01
MKHFTDTLISANIVSQYTTPASAQYANRLSPRVGRFINAAGTTGFPTGKRAVSATQLIKSGYARKFIRLWLMYMVISCVAALAAQKIPKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 113823 - protein, 468 aa, Glycine max
  Coding DNA Sequence Number=SeqID_22138
  Homolog annotation: Hit_ID=Q6WAY4; Match level="QueryCoverage=76%, HitCoverage=62%, E-value=2e-43, Identity=33%"; Hit description =Putative uncharacterized protein
MGTNQNGKRFYQVKVKGLDVTSLKELGRLMGPLQRQAFRKVYGKILDLTVVEVFTEAVVSLAQYYDQPLRCFTFGDFQMVPTIEEFEEILGCPLGGRKPYLFSGFLPSLSKITAVVGDSAKELDRTKQTRNGVVGLPRKYLEGKARDMASQEKWGPFADILALLIFGVVLFPNVDGLVDLAAIDAFLAYHHSKESPLVAILADLFDTFDRRCEKNSARIVCCLPALCVWLTSHLFRQDTRHPCPLQTCRSCAEKGRVVWDQHLAVIGSSTIHWFPRWKEGKEGVLFSCGDYPNVPLVGTRGCINYNPALAIRQLGYPMRGAPTEESLTPFLVRDLGAQSLKVIQRIHKAWRSPLRKDKELRGIRNGVIGGYHGWLRIHTRGLDWLSKLKVINEENFEAPEEDEEVRALKLELGKARLAKEKFKSAATHIRKECTELQEETRPLQKPLNKKPKGPARRIWPEEFRGALW

SEQ ID NO: 113824 - protein, 129 aa, Glycine max
  Coding DNA Sequence Number=SeqID_22139
MTGPLNESISCFLIRADPWVLVPSPLEDCTSSLSEDYASLPSEDYTSSLSESYTPSPSKGCTPSPLEVPGPPPDIGGQPTVQAQPEREAITQLLYIPGQDFTRAAAKKTSVDHARQLDHSYTDINDVAT

SEQ ID NO: 113825 - protein, 136 aa, Glycine max
  Coding DNA Sequence Number=SeqID_22140
KSLAFVDHTAFCCHNSRAGSPRRHLTVIRTLLSSRGGGPDDKQRPSFGHSAHMIRGATLRVICTPLPFRHSRVQWHAETKTLDSMQGLTQSSAPFVPPGTTKSFTCGNFMVARDSRQPRGAKLVSYTDFRGPLLDD

SEQ ID NO: 113826 - protein, 235 aa, Glycine max
  Coding DNA Sequence Number=SeqID_22141
  Homolog annotation: Hit_ID=A0ST23; Match level="QueryCoverage=10%, HitCoverage=51%, E-value=8e-07, Identity=100%"; Hit description =Putative reverse transcriptase
ISVTGIYSAQSASAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIKFMIGITQGQNKVLITDRMWARLLSSTNLPSFIIAKTVSKEKREEEANGHVPEVNFELGVIMVIAVSFGKPVVPAALMNRPTRGERRFAYWALAECILAYYVGTDEGVSEVLHVAGEKRLH

SEQ ID NO: 113827 - protein, 119 aa, Glycine max
  Coding DNA Sequence Number=SeqID_22142
MAYTHIPDSTSDSPQISASPYQLGLAPYASEPYNAQWNAPGLLRDKHTLRSSRILGETEVDEPWLGLWLLLNYQTDFVVDLGMAFVDNWVVGKEEEWQSQHGFLPLSHPLYLPQFSQSS

SEQ ID NO: 113828 - protein, 178 aa, Glycine max
  Coding DNA Sequence Number=SeqID_22143
  Homolog annotation: Hit_ID=Q6WAY6; Match level="QueryCoverage=45%, HitCoverage=15%, E-value=4e-10, Identity=43%"; Hit description =Putative uncharacterized protein
MTRSTGDVKRVAQELFVVHWLSMCGWFHIFFSKKVGPSIRYKEGRIRILSSCEGCPNVPLMGTRGCINYNPILTIRQLGYPMRGAPLDESISPFITRGFSDPNAKDRELRGSSNGIIDGYHKWLRVWTQGLDWLPNLKTVRDDEIKASEESDEVQALKAELERARVVKEKFKSIAIKV

SEQ ID NO: 113829 - protein, 128 aa, Glycine max
  Coding DNA Sequence Number=SeqID_22144
MAYTHISVEDSTSDSPQISASPYQLDLAPYASEPYNAQWNAPGLLRDKHTLRSSRILGEMEVDEPWLGLWIPLNYQVDMGSSLAYDNGIWGEPYRLFAAKFLFVGVFLLCAKGGLRHWKCGRQTLWLI

SEQ ID NO: 113830 - protein, 127 aa, Glycine max
  Coding DNA Sequence Number=SeqID_22145
LCQSFGVPVTPSKVIRPPITRAFIEKYCTQRQVQGDAPQAADAPPPHQDGPAGLFDTEQYLRHLMSLSLQSQGFTSFPCPTPDQFRAEVAWPGDWPEAQAGEAPAGAPAEDEEMTDLLDFLGGSGAA

SEQ ID NO: 113831 - protein, 61 aa, Glycine max
  Coding DNA Sequence Number=SeqID_22146
EEKKPEENKVKEKKANEEEKKEEEKKLEESKDDKESKEESALPEIVLGTTIAMHGHFKHDF

SEQ ID NO: 113832 - protein, 95 aa, Glycine max
  Coding DNA Sequence Number=SeqID_22147
MPYVEAAEESLETAFQSFEVVSISSVDSLFGQPCLSDAAVMMARVMLGNGYEPGMGLGKDNGAGKLASGGTLRHLRDEHNVNLYGFKSSIVGPRL

SEQ ID NO: 113833 - protein, 104 aa, Glycine max
  Coding DNA Sequence Number=SeqID_22148
MSDPESKPELGGTRAVVGAEGRECLPWCSDLFEGPTRVQSKKAMVNQEGQGPRRTQVVTMRPLVIAVVAQPLFTADCHLLRCESLDGKLRRRGRKRGQGFRQQG

SEQ ID NO: 113834 - protein, 111 aa, Glycine max
  Coding DNA Sequence Number=SeqID_22149
  Gene Ontology: Biological process=transposition, DNA-mediated
  Homolog annotation: Hit_ID=Q1J7G7; Match level="QueryCoverage=27%, HitCoverage=42%, E-value=2e-10, Identity=100%"; Hit description =Transposase
WPGLPGINRDTRIYLFCEVIFRPQWLLFLSAVPPVQLLTGWCVTAKAPPDISAGKCSGHPARNHPHPPRLMRRYRARPIRHSGCATVGKGDRCGPLRYYASWRKGDVLQGD

SEQ ID NO: 113835 - protein, 88 aa, Glycine max
  Coding DNA Sequence Number=SeqID_22150
MEIPSATETQTPKGCILSSILSAIDEYPETLIGERVPPPFINRSLSVNLMSEKGVRPQPARKTNYLIFIYVIERGTAHQPAFQASYSL

SEQ ID NO: 113836 - protein, 189 aa, Glycine max
  Coding DNA Sequence Number=SeqID_22151
  Subcellular localization annotation: CTP_CleavageSite=76; ConfidenceScore=5.86e-01
MRPVASKSRSTQVRPSGSSGTPMKIVGVRIARAISARSSSGATSSTRMASTRLLAVTRFIPSAVCSSGLGEGEDVGAAARQHPRPGVGLVAQRPHRLLDASTGLLGDRALAAERVRPPADRHAGPLLPPHGSSSSGLRCRRAHHRSVSLASAVMIRRRCSGCKRFVVSHNIFAGSSAAGAGVYGSVPVQ

SEQ ID NO: 113837 - protein, 101 aa, Glycine max
  Coding DNA Sequence Number=SeqID_22152
MVTRSMASSSSCASSIQTRSGPIEGDVLWMQPKHVSEHVWNGEADRKLHIRRAVPTYQGEEQIPEEIIPLLRQCGFYWIITMGYLKINAALISAFIERWRP

SEQ ID NO: 113838 - protein, 59 aa, Glycine max
  Coding DNA Sequence Number=SeqID_22153
MPSPATSGIPHGLRRGPSLPDNQYGGFRECARTAAVLLMSTKWGREKQVSENYGNKESR

SEQ ID NO: 113839 - protein, 75 aa, Glycine max
  Coding DNA Sequence Number=SeqID_22154
  Subcellular localization annotation: CTP_CleavageSite=57; ConfidenceScore=5.65e-01
MGGANSTQAHLGPPEDSSRRRKSKPSAPKRFRNVSVRNLAKVSTVFDVLHSFFIVLRSSTGKYLEPSFSIHSMYP

SEQ ID NO: 113840 - protein, 290 aa, Glycine max
  Coding DNA Sequence Number=SeqID_22155
  Gene Ontology: Mol. function=helicase activity; Biological process =viral genome replication
  Homolog annotation: Hit_ID=A2Q378; Match level="QueryCoverage=91%, HitCoverage=17%, E-value=6e-67, Identity=44%"; Hit description =Putative uncharacterized protein
MVHGPCGILRPTSSCMKEGKCSRFYPKEFQPTTLIDGDGYPVYHRINTGRTITKNGIIIDNRCIVPYNPKLLKKYQAHINIEWCNQSTSIKYLFKYINKGYDRVTAVMVHDNNGTVPHANTLNDEIKEYLDCRKPSIERLHFHLLGQHSVHYQDHDDIDDLLSNPSISESKFIAWMNTHQAFVEGQSLTCSEFVTKFVYNQKQRCWQLRKKGYAIGRLQWVPPTTGELFYLRMMLTVSRGPISFKDIRTVASVEYPTYREACFAMGFFYRMIENSLLQSRKQKTGAEHLI

SEQ ID NO: 113841 - protein, 181 aa, Glycine max
  Coding DNA Sequence Number=SeqID_22156
TETNMLAIIAKYQEELGLATAHEHRIADEYAQVYAEKEARGRVIDSLHQEATMWMDRFALTLNGSQELPRLLAKAKAMADTYSTPKRFMGFSAIEQMKADMSALKTNGLHDGGHVKYEAAHREERGHAAAVSSAAEADPTLLATAHHPPSNIVGWGRDTLGHDGSPHLGYNRAAFPYGLPP

SEQ ID NO: 113842 - protein, 159 aa, Glycine max
  Coding DNA Sequence Number=SeqID_22157
  Gene Ontology: Mol. function=small conjugating protein ligase activity; Biological process=ubiquitin-dependent protein catabolic process
  Homolog annotation: Hit_ID=A5B472; Match level="QueryCoverage=25%, HitCoverage=16%, E-value=1e-09, Identity=78%"; Hit description =Ubiquitin carrier protein
  Subcellular localization annotation: CTP_CleavageSite=48; ConfidenceScore=5.21e-01
MVTPGVREKGVHSSLFPTLRHMLNMFPAVVFISNKHSSCTSSELCFFSCSISQELRCNLLYTGIHAKPKPKFKSGAISESTTALNVDQTNTSVISGDIKTTPASAALPVPVLATTTTRGNNQEQAAAVNGSSAATVISAASAPPKKEGGQQKLRRTRRR

SEQ ID NO: 113843 - protein, 246 aa, Glycine max
  Coding DNA Sequence Number=SeqID_22158
  Pfam annotation: Domain name=Retrotrans_gag; Domain location=29-86; Score=3.0; E_value=0.028; Accession=PF03732.8; Description =Retrotransposon gag protein
MPLSWLKNINTRLPLNITPGVPDNAIRLSLFSFSLTGEAKRWHHSFKGNNLKTEALERFRGLLRKTPTHGFSKPIQLNMFIDGLRPQTKQLLDASVVPFVVVLINQSIAFPLKSIIMKLITWEISRGKGTTKEDSQVSSKVPTISKRTTKLEETLAQFIQVTISNHKSTESALKNLEIQDEDIVALKEQVALKDTTDKKNDKEVPYPLVPSKKDKECHLARVLDIFRKLEITMPFGEALQQMPLYS

SEQ ID NO: 113844 - protein, 144 aa, Glycine max
  Coding DNA Sequence Number=SeqID_22159
MKDKRDEEEKLEKQKKKNDNKALSSKAKREEKEEKDSSKKIVKKENHFATKGDIKRALLLKQSFNLLLSRETSLSTATIPTFETLAAKVQELLQEFGDIFPKEIPVSLYSADFYPLAKPTCLLSESFAECNTPRLSAKKNLEEG

SEQ ID NO: 113845 - protein, 47 aa, Glycine max
  Coding DNA Sequence Number=SeqID_22160
  Homolog annotation: Hit_ID=A5BSW9; Match level="QueryCoverage=87%, HitCoverage=3%, E-value=2e-10, Identity=70%"; Hit description =Putative uncharacterized protein
MEEMFPEHKKSKLQPRGDGPFQVLENINDNAHKFDLPSEYNMEGPWI

SEQ ID NO: 113846 - protein, 43 aa, Glycine max
  Coding DNA Sequence Number=SeqID_22161
  Gene Ontology: Mol. function=structural constituent of ribosome; Cellular component=ribonucleoprotein complex; Biological process =translation
  Homolog annotation: Hit_ID=P56791; Match level="QueryCoverage=95%, HitCoverage=19%, E-value=1e-11, Identity=70%"; Hit description =Chloroplast 50S ribosomal protein L2
MAIILYKTSTPSTRNGAVDSQHRCGKGRNARGIITAGHRGGRS

SEQ ID NO: 113847 - protein, 109 aa, Glycine max
  Coding DNA Sequence Number=SeqID_22162
MTRGNPSDLQPFDPEIDRTFHRLVRHHLVPFEHPEHSVIGDFEHYSSQHSDFEYSENMAHPPPRERTLRELAAPDFTYESLCIQYPDEDVPYVLKTGLIHLLPKFHCLA

SEQ ID NO: 113848 - protein, 145 aa, Glycine max
  Coding DNA Sequence Number=SeqID_22163
DGGLGERKMLGIQIQIRVRIADTVQSTIGLRTGLRSSGDFVLCSTVHPHGDLRVLLIQEGIGDGDQATFYSILSGAERLGGLIVSERTSAFTFNTGWSASIVTPENGRGEDSGAPEPRDSWQVMASVSPSVRGGTHASHAPAGRQ

SEQ ID NO: 113849 - protein, 135 aa, Glycine max
  Coding DNA Sequence Number=SeqID_22164
IRRARASLLSTTPPFVTMTQELVACGDTLRLSAPRHSVIPSVIDKQRPKTKFGHSAPLYHPEAAGPMIRGDTLRLFAPFCHPEAAGPMTSRDQVWSFCTLVSSRGGGPDDTRRYLTVIRTLLSSRGGRPDDKQRP

SEQ ID NO: 113850 - protein, 138 aa, Glycine max
  Coding DNA Sequence Number=SeqID_22165
  Gene Ontology: Mol. function=chloramphenicol O-acetyltransferase activity; Biological process=response to antibiotic
  Homolog annotation: Hit_ID=P62577; Match level="QueryCoverage=95%, HitCoverage=90%, E-value=2e-40, Identity=69%"; Hit description =Chloramphenicol acetyltransferase
  Pfam annotation: Domain name=CAT; Domain location=6-136; Score=159.9; E_value=6.9e-45; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDANPWVSFTSFDLNVGQYGTLLRPVFTMGKYYTQGDKGADALAIQVHHAVCDGFPCRQNA

SEQ ID NO: 113851 - protein, 117 aa, Glycine max
  Coding DNA Sequence Number=SeqID_22166
  Gene Ontology: Mol. function=protein binding; Cellular component =integral to membrane; Biological process=protein amino acid phosphorylation
  Homolog annotation: Hit_ID=Q9LJW7; Match level="QueryCoverage=89%, HitCoverage=68%, E-value=4e-19, Identity=46%"; Hit description =Disease resistance protein-like
  Pfam annotation: Domain name=LRR_1; Domain location=27-48; Score=1.2; E_value=1.8e+02; Accession=PF00560.24; Description=Leucine Rich Repeat
  Pfam annotation: Domain name=LRR_1; Domain location=3-25; Score=14.2; E_value=0.5; Accession=PF00560.24; Description=Leucine Rich Repeat
  Pfam annotation: Domain name=LRR_1; Domain location=50-75; Score =11.9; E_value=1.9; Accession=PF00560.24; Description=Leucine Rich Repeat
  Pfam annotation: Domain name=LRR_1; Domain location=77-99; Score =11.9; E_value=1.9; Accession=PF00560.24; Description=Leucine Rich Repeat
  Pfam module annotation: Pfam domain module=LRR_1::LRR_1::LRR_1::LRR _1; Domain location=27-48::3-25::50-75::77-99
MTSLTHLDLSDSGFYGKIPPQIGNLSNLVYLDLREVANGRVPSQIGNLSKLRYLDLSDNYFLGEGMAIPSFLGTMSSLTQLDLSYTGFMGKIPSQIGNLSNLLYLGPGRMGIKYVEA

SEQ ID NO: 113852 - protein, 190 aa, Glycine max
  Coding DNA Sequence Number=SeqID_22167
  Homolog annotation: Hit_ID=A5C995; Match level="QueryCoverage=58%, HitCoverage=7%, E-value=3e-13, Identity=38%"; Hit description =Putative uncharacterized protein
MTRQLVVHAECSCMTRGNPSDLQPFDPEIDRTFHRLVRHHFIPFEHPEHFVTGESVHYVIGDFEHPDFEHYNIEHSDFEHSENMAQPLPRERTLREMAAPDFTYESLCIQYPDEDVPYILKTGLIHLLPKFHGLAGEDPHKHLKEFHIVCSTMKPPDVQEDHIFLKAFPHSLEGVAKDWLYYLAPRSITS

SEQ ID NO: 113853 - protein, 92 aa, Glycine max
  Coding DNA Sequence Number=SeqID_22168
MSEEDDMDDENEQECGLNEQHIDCSDAFNTYQLCGKPVVGGPGWMVKFMCGSYNHELAKSLVGHPYVGQLTKDEKIIIVDMTKSMVNLRTFC

SEQ ID NO: 113854 - protein, 138 aa, Glycine max
  Coding DNA Sequence Number=SeqID_22169
  Gene Ontology: Mol. function=chitin binding; Cellular component =extracellular region; Biological process=chitin metabolic process
  Homolog annotation: Hit_ID=Q54WQ8; Match level="QueryCoverage=94%, HitCoverage=20%, E-value=7e-09, Identity=30%"; Hit description =Putative uncharacterized protein
  Subcellular localization annotation: CTP_CleavageSite=38; ConfidenceScore=5.28e-01
EQKLVPGPPSRSTVSISLIPLKERTYIPLKARTCSPLKARTSSPLKARTCSPQKARTCSPQKARTCSPLKARTYNPLKARTYSPLKVRTCSPLKARTCSPLKINCPFERGDNSCNLILSFANLFGNSLRVYILFDLVT

SEQ ID NO: 113855 - protein, 116 aa, Glycine max
  Coding DNA Sequence Number=SeqID_22170
  Homolog annotation: Hit_ID=A5BP71; Match level="QueryCoverage=65%, HitCoverage=19%, E-value=1e-11, Identity=45%"; Hit description =Putative uncharacterized protein
  Pfam annotation: Domain name=zf-CCHC; Domain location=89-106; Score =17.9; E_value=0.003; Accession=PF00098.14; Description=Zinc knuckle
MVVIVNAEACGYVSMNYYQYIDVVYTNEHILKAYSAQWWPLANEAAIPPSLDDAWTLIPDPTTIRAKGRPKSTRIRNEMDWVEPSEHRTKCSRCGAEGHNRRRCPMQSERGSCSNP

SEQ ID NO: 113856 - protein, 90 aa, Glycine max
  Coding DNA Sequence Number=SeqID_22171
  Homolog annotation: Hit_ID=A2Q246; Match level="QueryCoverage=100%, HitCoverage=36%, E-value=2e-39, Identity=87%"; Hit description=CENP -B protein
MINRCGYRNNLDIDNLMNYPDENEACSEVQSLEDIVDTIIENNAEDDGEDDTVSLEPVMRKEALMASNILHNFMIQYKNTTPELLDAIKK

SEQ ID NO: 113857 - protein, 92 aa, Glycine max
  Coding DNA Sequence Number=SeqID_22172
  Homolog annotation: Hit_ID=Q6UUU1; Match level="QueryCoverage=93%, HitCoverage=58%, E-value=2e-31, Identity=79%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCLAAFVSIHA

SEQ ID NO: 113858 - protein, 68 aa, Glycine max
  Coding DNA Sequence Number=SeqID_22173
  Gene Ontology: Mol. function=non-membrane spanning protein tyrosine kinase activity; Cellular component=integral to membrane; Biological process=capsule polysaccharide biosynthetic process
  Homolog annotation: Hit_ID=P58764; Match level="QueryCoverage=100%, HitCoverage=16%, E-value=1e-26, Identity=58%"; Hit description =Tyrosine-protein kinase etk
METENNILMITGATPDSGKDELNKVIQHFGKGGFDVITRGQVPPNPSELLMRDRMRQLLEWANDHYDL

SEQ ID NO: 113859 - protein, 68 aa, Glycine max
  Coding DNA Sequence Number=SeqID_22174
  Subcellular localization annotation: CTP_CleavageSite=30; ConfidenceScore=5.04e-01
MMITKDDDKGDDKKLKDQSKNNSSESRRIQDSRRKSRIKIQGSRSQESRSRFKTQDSRMKRRLNQDKY

SEQ ID NO: 113860 - protein, 106 aa, Glycine max
  Coding DNA Sequence Number=SeqID_22175
MTKSRPAAARCLDARPAPFPGWFICYRQQRQVAPALRAFIEAVREGAAMGRTELEIWTLPAEQTTTQSVRFEPSQMPPKAPMNCAAIRSPNATRKATSALKARMKQ

SEQ ID NO: 113861 - protein, 30 aa, Glycine max
  Coding DNA Sequence Number=SeqID_22176
MACSFFPVSYPNFVRGPLLDDVRPFFGPRE

SEQ ID NO: 113862 - protein, 163 aa, Glycine max
  Coding DNA Sequence Number=SeqID_22177
  Homolog annotation: Hit_ID=Q6UUU1; Match level="QueryCoverage=52%, HitCoverage=55%, E-value=8e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPEDMQKHHWQQPL

SEQ ID NO: 113863 - protein, 39 aa, Glycine max
  Coding DNA Sequence Number=SeqID_22178
MPTSPERAQMTILASALSIKLEVQITIRGLPRATQLLGH

SEQ ID NO: 113864 - protein, 219 aa, Glycine max
  Coding DNA Sequence Number=SeqID_22179
MRYRSFDLHQLLFHFSKHGNKSNRQEVLPSQGQKPRYHQHQGIGAVDGTPPNASLPQDLRKDLRVDHSRGVHRSHCITYPILRPALEMLHIRDFQLVPTIEEFEEILGCPLGGRKPYLSSGCLPSLSRIATVVKDSARGLDRIKQTRNGIAGLPQKYLEDKARGMANQGDWVPFMDIYLTHLIEGAKRVAHGSSVAYPPSVFGWFHTCSNKTQDIHVCS

SEQ ID NO: 113865 - protein, 36 aa, Glycine max
  Coding DNA Sequence Number=SeqID_22180
  Homolog annotation: Hit_ID=A5AJF9; Match level="QueryCoverage=100%, HitCoverage=2%, E-value=5e-08, Identity=72%"; Hit description =Putative uncharacterized protein
MVLEDKEKTMFVTLWGAFFSKVMSFGLKNAGATYQR

SEQ ID NO: 113866 - protein, 78 aa, Glycine max
  Coding DNA Sequence Number=SeqID_22181
MAPLPSVEAKLHGESKNNSRVQDKNQEEFKTQEESLESRIKIQGSRSQESRSRFKTQDSRIKRRLNQDKYEKFFSKIE

SEQ ID NO: 113867 - protein, 175 aa, Glycine max
  Coding DNA Sequence Number=SeqID_22182
  Gene Ontology: Mol. function=protein binding; Cellular component =outer membrane-bounded periplasmic space; Biological process=cell wall organization and biogenesis
  Homolog annotation: Hit_ID=A4WBP9; Match level="QueryCoverage=81%, HitCoverage=56%, E-value=3e-66, Identity=84%"; Hit description=Type 1 pili usher pathway chaperone CsuC precursor
  Pfam annotation: Domain name=Pili_assembly_N; Domain location=41-153; Score=-21.4; E_value=0.00012; Accession=PF00345.11; Description=Gram -negative pili assembly chaperone
MTAYFRRICLGSLLGVMALAAGQVQAAATILLWPIDPWLAADAKATELWIQNQGNSPTTMQVRIVRWKQEGGFERYSAQQDVVASPPIVTIAAGSKQLIRLIKQGTVPVGVEQAYRIIVDEIPQPDNKAEPAIGLKLQMRYSIPLFVYGQGIPTSKEGAHHAFVDTHNLSWAGKK

SEQ ID NO: 113868 - protein, 181 aa, Glycine max
  Coding DNA Sequence Number=SeqID_22183
  Gene Ontology: Mol. function=chloramphenicol O-acetyltransferase activity; Biological process=response to antibiotic
  Homolog annotation: Hit_ID=P62577; Match level="QueryCoverage=64%, HitCoverage=52%, E-value=1e-62, Identity=97%"; Hit description =Chloramphenicol acetyltransferase
  Pfam annotation: Domain name=CAT; Domain location=6-144; Score=154.3; E_value=3.4e-43; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDSGSFYTYIRKMWRVTVKTWPISLKGADAAAIQFIMPFVMASMSQMLMNYNSTAMSGRAGRNFFKAVIGA

SEQ ID NO: 113869 - protein, 98 aa, Glycine max
  Coding DNA Sequence Number=SeqID_22184
MRQIWDEDSRDRASYYRSIGPLKNKKNGPQHRGKLYSTPPKQYGIRPNNQRTVAMGFLGGSGSIPNTFPTQITCYKCDKGGIFKEIVHIPRRSRMVGA

SEQ ID NO: 113870 - protein, 91 aa, Glycine max
  Coding DNA Sequence Number=SeqID_22185
LGGIDGDPVLRGMRIRATWEYVSSIEGGQLGMVDLCVICGCGESTCTIARSPPSTTYDGVPGDMSRGSGDLGTSVGAMPKTKLEQSRLNPA

SEQ ID NO: 113871 - protein, 73 aa, Glycine max
  Coding DNA Sequence Number=SeqID_22186
VNKAEMLLLLPLLASSKEKDSVLVVANIEGHHRDIPIGDREAFPPTSTSTGRAGKRVKSHPLNSRKEAIRHHD

SEQ ID NO: 113872 - protein, 235 aa, Glycine max
  Coding DNA Sequence Number=SeqID_22187
  Pfam annotation: Domain name=Retrotrans_gag; Domain location=14-92; Score=8.2; E_value=0.0086; Accession=PF03732.8; Description =Retrotransposon gag protein
MKPPDVQEDHIFLKAFSHSLEGVAKDWLYYLAPRSITSWDDLKRVFLENKFPASRTTTIRKDISVIRGVNEVATNSVASPTETKKLEGKLDALVNLVTQLALNQKFVPVARIYGLRAPLPTTIQTFALLCCNLEQLNSLKLMLQTSTIDLLNLNSKINHNRTIMTSPTIGTIPGGGIIPTLDGQVLHNSSNNYNLIFKMLLAQADHTFLHQSSNNNNSSNNPRNSKQLRLLRNLP

SEQ ID NO: 113873 - protein, 93 aa, Glycine max
  Coding DNA Sequence Number=SeqID_22188
  Homolog annotation: Hit_ID=Q6UUU1; Match level="QueryCoverage=93%, HitCoverage=58%, E-value=1e-29, Identity=78%"; Hit description =Putative uncharacterized protein
MAYERGGDFLEDARKILNREVRGPRQSRFSIGSAPLTSITKSDAQISGGETRQDYKDTRRFPLAAPSCAPLFLPFGLPVSFRLLWPRFVSFHA

SEQ ID NO: 113874 - protein, 191 aa, Glycine max
  Coding DNA Sequence Number=SeqID_22189
  Gene Ontology: Mol. function=protein-disulfide reductase activity; Cellular component=integral to membrane; Biological process =cytochrome complex assembly
  Homolog annotation: Hit_ID=P36655; Match level="QueryCoverage=67%, HitCoverage=22%, E-value=1e-41, Identity=64%"; Hit description =Thiol:disulfide interchange protein dsbD precursor
  Subcellular localization annotation: CTP_CleavageSite=23; ConfidenceScore=5.69e-01
MKRPPRIWRPKCSGKNSPPAPPSCRERRRSTTGKESLSRIPSPVSNPRTTGPAGYSRRQRLPLMAQRIITLILLLCSASASAGLFDAPGRSNFVPADRAFAFDFQQNQHDLNLSWHIKDGYYLYRKQITLTTKDAAIVDPSLPPGEWHEDEFYGKSEIYRQRLMLPITLTQAGKAATLTVTYQAVPTPGFC

SEQ ID NO: 113875 - protein, 60 aa, Glycine max
  Coding DNA Sequence Number=SeqID_22190
MRVEFPQAADWLDQIPKSKWTQAYDEGNSMTAGHRNSEDVYVMMQENQHIATSHYVRMHV

SEQ ID NO: 113876 - protein, 76 aa, Glycine max
  Coding DNA Sequence Number=SeqID_22191
  Subcellular localization annotation: CTP_CleavageSite=42; ConfidenceScore=5.52e-01
MKDCKNTSGEDVSFTSRISQPLTNASQALRTTSSSSSGGLVRARALSAILNRLAHISEFRLSVCLSRLADGLKRCA

SEQ ID NO: 113877 - protein, 193 aa, Glycine max
  Coding DNA Sequence Number=SeqID_22192
  Subcellular localization annotation: CTP_CleavageSite=41; ConfidenceScore=5.21e-01
MGKGWGPGTAGAVYTGRSCRSTAPSPYAWPPTDKPNAACTRASGAPSSACEPRWILGTMDDVEAVVVHLLPAAAADELCGRNRYPIELAETCDQCLKSQCPVGLFWVHWVSRRCDTYKLVDGIQDKLCYMNTDLSQDGIDQLAFRQREIRIMVTRKDVAEQKHPDLGQSGHASVHDPHPPPCHAPCKILSRGA

SEQ ID NO: 113878 - protein, 119 aa, Glycine max
  Coding DNA Sequence Number=SeqID_22193
MALYRIPGCLAATFSACPALGRDVDLSVVTLSSICIRPYVPESRKQQCVANRDYVVVLPWLISAVNFVSSSDHGLRRFCPCYYKICMCMCMHECFQCNDLLSESRLGSVLIKRLGHPMN

SEQ ID NO: 113879 - protein, 71 aa, Glycine max
  Coding DNA Sequence Number=SeqID_22194
MDRACPGELPGRFARLFQGKNIDGPFSPFSMSLVQAAIKAVQNLQGLGSRDRATSFSQADLKAEKIGARGA

SEQ ID NO: 113880 - protein, 41 aa, Glycine max
  Coding DNA Sequence Number=SeqID_22195
MPYKEMAPKKLSAKRSRRDAAAEGTSAAPEFDSHHFQSTVH

SEQ ID NO: 113881 - protein, 135 aa, Glycine max
  Coding DNA Sequence Number=SeqID_22196
  Pfam annotation: Domain name=G-patch; Domain location=38-91; Score =6.5; E_value=0.031; Accession=PF01585.14; Description=G-patch domain
MPYVEAAEESLEIAFQSFEVVSIASVDSFSGQPCLSDTAIMVARVMLGNGYKPGMGLGKNNGHKKEETVGSLGGPPCPICRSFISAGLGHEGQAIAICEDNSPSGLDLVRPCPPGFRLGNWQVEERPDIYVTSIM

SEQ ID NO: 113882 - protein, 75 aa, Glycine max
  Coding DNA Sequence Number=SeqID_22197
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=100%, HitCoverage=24%, E-value=5e-31, Identity=71%"; Hit description =Acetyl-coenzyme A carboxylase carboxyl transferase subunit beta
MGSSDRIELSIDSGTWNPMDEDMAVQTGTGQLNGIPVAIGIMDFQFMGGSMGSAVGEKITRLVEYATNQLLPLIL

SEQ ID NO: 113883 - protein, 59 aa, Glycine max
  Coding DNA Sequence Number=SeqID_22198
MGLKAETNQGKTVARPRFAAQCRFLLSGVFKVSIGCLIYPYGGSSKRTPTRREPYLCLP

SEQ ID NO: 113884 - protein, 257 aa, Glycine max
  Coding DNA Sequence Number=SeqID_22199
  Homolog annotation: Hit_ID=Q2HW90; Match level="QueryCoverage=55%, HitCoverage=26%, E-value=1e-14, Identity=37%"; Hit description =Putative uncharacterized protein
MPSQGEKTVSFLRLSSFLEQGCGCDWRFSKRVGSHEANPKRRSGLASEILGRKARDMASQEKWGPFVDILALLIFGVVLFPNVDGLVDLAAIDAFLAYHHSKESPVVAILADLFDTFDRRCEKNSARIVCCLPALCVWLISHLFRQDTRHPCPLQSYRSCAEKGRVDWDQPLAGIGGSALNWFPRWKEGKEGVLFSCGDYPNVPLIGTRGSRVPHEGSANRRKSLALPCEGSRRARSQGYTKNPQGVEESIEERQGA

SEQ ID NO: 113885 - protein, 198 aa, Glycine max
  Coding DNA Sequence Number=SeqID_22200
  Gene Ontology: Mol. function=transferase activity, transferring glycosyl groups; Cellular component=chloroplast; Biological process =aromatic amino acid family biosynthetic process
  Homolog annotation: Hit_ID=A6EE62; Match level="QueryCoverage=98%, HitCoverage=70%, E-value=1e-68, Identity=56%"; Hit description =Anthranilate phosphoribosyltransferase
  Pfam annotation: Domain name=Glycos_transf_3; Domain location=17-198; Score=68.5; E_value=2.3e-17; Accession=PF00591.12; Description =Glycosyl transferase family, ab domain
MGKYDSHQIAAFMTAYGGDGKNTFNISTIASFITAGAGYHVAKHGNIGVSSSCGSSNVMEYLGYQFSNDKSELQRQLDEANICFLHAPLFHPAMKTVAPIRRALGVKTFFNMLGPLTNPANPRFQSVGVFSLELARLYGYLYQNTNKQYSIIHALDGYDEISMTGDFKVINNRGENYYSMEELGFTPVSAQELTGVIQ

SEQ ID NO: 113886 - protein, 118 aa, Glycine max
  Coding DNA Sequence Number=SeqID_22201
MPLSLPVEHSYKRERCNLFLRVALEVGGGEAERGSYKKKKTSVAWLWSLPIQIGIAGAELRTVKAGLATSDSRSKWSSCPQSQRDRKERAQRKKIKGKLCFSFHRTQIRSGYGIMNHE

SEQ ID NO: 113887 - protein, 364 aa, Glycine max
  Coding DNA Sequence Number=SeqID_22202
  Homolog annotation: Hit_ID=Q84VH5; Match level="QueryCoverage=100%, HitCoverage=54%, E-value=1e-152, Identity=76%"; Hit description =Envelope-like protein
IAENPSLATSPREVDTEMDKKIRSIVSNILKNASVPDAEKDVPTSSTPDVAVPDAEKDVPTSSTPNTEVLSSPSKEESTEEEEEDQATKETPAPRAPEPAPGDLIDLEEVESDEEPIANKLAPGIAERLQSRKGKTPIKRSGRIKTMAQKKSTPITPTTSRRSKVAIPSKKRKEISSSDSDDDGKRCLGNVPDAPLDNISFHSIGNAERWKFVYQRRLALERELGRAALDCKEIMDLIKAAGLLKTVTKLGDCYESLVREFIVNIPSDITNRKSDDYQRVFVRGKCVRFSPAVINKYLGRPTDGVMDIAVSEHQTAKEITAKQVQHWPKKGKLSAGKLSVKYAILHRIGAANWVPTNHTSTVAT

SEQ ID NO: 113888 - protein, 132 aa, Glycine max
  Coding DNA Sequence Number=SeqID_22203
TGLCQSFGVPVAPSKVIRPPITRAFIEKYCTQRQAQGDAPQAAGAPPPPHQADPAGSFDTERYLWHSMRQHAANHRGLGQVHECLYHLSLNMQSQGFAPFPCPTPDHAYVVIVDNVYLKFRNRVEFHLGTSS

SEQ ID NO: 113889 - protein, 121 aa, Glycine max
  Coding DNA Sequence Number=SeqID_22204
MANGMWGNPGDLQPFDPKIDRTFHRLARHSVHPGHSVHFEHLDHFEHFVAGDSKYSDFEHSAINFHTENMTQPPPREKTLREMAAPDFTYESLCIQYPDEGVPYVKILISMLRSSILFVPP

SEQ ID NO: 113890 - protein, 71 aa, Glycine max
  Coding DNA Sequence Number=SeqID_22205
KREKLDHLEERLRTIEGGEDCAFSNLEELFLVPNIITRPKFKVSAFDKYKGTTCLKIIVERWRHMQKMRNY

SEQ ID NO: 113891 - protein, 232 aa, Glycine max
  Coding DNA Sequence Number=SeqID_22206
  Homolog annotation: Hit_ID=Q6WAY6; Match level="QueryCoverage=40%, HitCoverage=19%, E-value=8e-09, Identity=34%"; Hit description =Putative uncharacterized protein
MGWWTWKRSTFFSPIITTRKVRLSLCWPTYMTPSTEDVKKAMQGLFAVLQLSMWGWFHTFFSEKVGPSIRYKEGRIKILSSCEGCPNVPLMGTRGCINYNPILAIRQLGYPMRGVPSDESITPFIARGFSDPNARDRELRGSSNGIIGGYHKWLRVRTQGLDWLPNLKTVRDDEVKASEESDEVQALKAELERARVVEEKFKAAIVSSSSEGVKGIITGQRHDLEGRAKGLP

SEQ ID NO: 113892 - protein, 61 aa, Glycine max
  Coding DNA Sequence Number=SeqID_22207
MTTMMQVMVGDEMVVTMKVDGLGYVTGRGGGGRLMVMVVVEVDMVEENGGCNIPDVDELGE

SEQ ID NO: 113893 - protein, 34 aa, Glycine max
  Coding DNA Sequence Number=SeqID_22208
MWDGHRLKGALKLGVFTPKAYTPKSPSGSLPPDS

SEQ ID NO: 113894 - protein, 121 aa, Glycine max
  Coding DNA Sequence Number=SeqID_22209
  Homolog annotation: Hit_ID=Q0ZCD0; Match level="QueryCoverage=81%, HitCoverage=8%, E-value=6e-07, Identity=30%"; Hit description =Integrase
MNQKSTPVARVCGLCSSVDHHTDLCPFVLQSEAIEQPEAYAANIYNRSPQPQQQNQPQQNNYDLSSSRYNPGWRNHPNLRWSSPSQQQQQQQPYFQNVVGPSRPYVPPPIQQQQQQQQQQQ

SEQ ID NO: 113895 - protein, 223 aa, Glycine max
  Coding DNA Sequence Number=SeqID_22210
  Homolog annotation: Hit_ID=Q2HW90; Match level="QueryCoverage=81%, HitCoverage=36%, E-value=2e-16, Identity=30%"; Hit description =Putative uncharacterized protein
MVEVSTETIASLAQYYDQPLRCFIFGDFQLSPMVEEFEEILGCPLGGRKPYLFSGFYPSLARISKKVQISAQELDRQRQVENGVVGIPRKYLEVKARILADKGEWIPFIDILTLLIFGGGGVLFPNVDGLVDLVAIDIFLAYHNHKESPVVAMLADLYDTFDRRCEKAMQGLFAVLQLSMWGWFHTFFSKKVGPSIRYKVTARASKKERRIGTNSWLAWGGVC

SEQ ID NO: 113896 - protein, 213 aa, Glycine max
  Coding DNA Sequence Number=SeqID_22211
MGEVEEIQEKMKADMKAMMSMKKIMEANVVIVAATSAVAKVNPMLPSGLKQMNHPTSNMVGKDLGSTDDPVMCKFKTSTPSRHMACLPNYTPPNVAYIPNEDVNNSTPILIKSQQPQSDHAHVSRPMEETHEIPHHNLADFEPWLRYATEGQAVGEMGKLDHLEERLRAIEGGEDYALANLEELFLVPNIITPPKFKVLDFDKYKGLLVPRTI

SEQ ID NO: 113897 - protein, 121 aa, Glycine max
  Coding DNA Sequence Number=SeqID_22212
PNLLGVFYPMPLRGRIASFGQVFITVVVSPAKPPPKSDTEVIDPLYLMTLTIPKLFLRPYQFESESYIKTWMQSSKRDVYLGAYLNGPYNYLKGIINSALKGLDDAPQPKSKAPARWIVVK

SEQ ID NO: 113898 - protein, 80 aa, Glycine max
  Coding DNA Sequence Number=SeqID_22213
  Pfam annotation: Domain name=zf-CCHC; Domain location=8-25; Score =18.7; E_value=0.0022; Accession=PF00098.14; Description=Zinc knuckle
TEISSSTPKCFECNQPRHLRLDCPIFKKKMEKSEKKNFSEKKIKKAYITWDDNDMESSEDSGNEEINLCLMAKSYESDEE

SEQ ID NO: 113899 - protein, 213 aa, Glycine max
  Coding DNA Sequence Number=SeqID_22214
YNPVLAIRQIGYPMRGAPLDDELAPVISRGFNKTNMETLQKVRKAWEVLQKKDKELRGSNNGPIGGYRKWLKAHVQGLDWLPSLRTAKREEVEAPEEDEEVQALRTELKQAQTVKERARREEHGRNKFRGALWGSNSELKLRREERDQSRVDSLILKDELKGDRLATSEATMWMDRFALTLNGSQELPRLLAKAKAMADTYSAPEEIHGLLSY

SEQ ID NO: 113900 - protein, 101 aa, Glycine max
  Coding DNA Sequence Number=SeqID_22215
  Subcellular localization annotation: CTP_CleavageSite=6; ConfidenceScore=5.16e-01
MSSSVQDSTPSRAGCRPRWSWEPTYTFLGLALPQHLNQMRAPKRNQPSLFQKALLGRRCLFTSLGQCSKHESVTPPSPMLSHRQRLGKRGRATCRETCTSP

SEQ ID NO: 113901 - protein, 149 aa, Glycine max
  Coding DNA Sequence Number=SeqID_22216
  Subcellular localization annotation: CTP_CleavageSite=97; ConfidenceScore=5.08e-01
MTTLASACQSNLGSSNDKVRITGRCFRMLPNSWVMIAKGADNRKVSSHATGLSGRWIAKGVYGLPSGVSACHRTLGHYQKMLTSSERVQMNTLVSACQSYLGSPNDEVQITIRCLRMLPDSRVTRLQRVFAAYRRVSSHATGLLGHGNK

SEQ ID NO: 113902 - protein, 185 aa, Glycine max
  Coding DNA Sequence Number=SeqID_22217
  Gene Ontology: Mol. function=aspartic-type endopeptidase activity; Biological process=DNA integration
  Homolog annotation: Hit_ID=A6R7Q4; Match level="QueryCoverage=42%, HitCoverage=4%, E-value=2e-07, Identity=35%"; Hit description =Putative uncharacterized protein
  Pfam annotation: Domain name=zf-CCHC; Domain location=8-25; Score =17.3; E_value=0.0037; Accession=PF00098.14; Description=Zinc knuckle
MQEKTSSTKCFKCLGRGHITSQCSTKKTMIMRGQEIYSSQDEATTSPSSSKSEEAKGEESSEEIYPQEEGQPLMVKEECKETLVSIATSLRLEFNPQVKELLDEGLVRKRLNPCALLVPKIGVPMNPKRIKVIPEWPAPPSVRKIWGFQDLTNFYKRFAPYFSILVAPLIELVRNHVLHGKMPRK

SEQ ID NO: 113903 - protein, 199 aa, Glycine max
  Coding DNA Sequence Number=SeqID_22218
MVLAEGETLPIYSKYCRLPLDLREIEAALCIPGRGFILNAEGHPGRILRKDLTTLAQVWSVLSYSKLAPTSHTSDLTVDRARLIFGLVSRMDMNVGALISGQMTSIAHSNSSRLGFPTLITTLCRARGVVSDSLTFECLSPLLLQYPYQQLLQSQLRLILSILKPCFRAFIRDRSFYFRVYKWWHLQDPFLPFNSFWKG

SEQ ID NO: 113904 - protein, 143 aa, Glycine max
  Coding DNA Sequence Number=SeqID_22219
  Subcellular localization annotation: CTP_CleavageSite=48; ConfidenceScore=5.35e-01
MPISPCKSISWSVSSRHGDRTHKTPSGPGKVQQGPGVFSSGYGPLSVLQGARTPPARHPVDPKKSTGSWSCQALNTGLYQFKGSACCPQQGAGRNTTAALGWPVAGNRHTATTSRVHLSSSAKRLERCLRHMADQQATKSKAK

SEQ ID NO: 113905 - protein, 168 aa, Glycine max
  Coding DNA Sequence Number=SeqID_22220
EAKGASGNRLPACVIDYTEGWVTGNRLPGCVIDYQRWKALKYPFYLHVVIVMAAQLIRDRVEMECLEGAWETLEGNTSALWSDTTHAYTISSSEPVQVIEVTSSEEDPEEDLEELPPEPAVDALDFLEGDEDPLLEVDSPEEVMSASEADSTEDSGPGEMAISGGSSS

SEQ ID NO: 113906 - protein, 69 aa, Glycine max
  Coding DNA Sequence Number=SeqID_22221
  Subcellular localization annotation: CTP_CleavageSite=11; ConfidenceScore=5.32e-01
SESGSMQKLTSSSAPFVNLGQASLLTRRDKRSLLHHCHPGTKSGSRRRYPSGYPYKMVSVNPDPRSQVA

SEQ ID NO: 113907 - protein, 151 aa, Glycine max
  Coding DNA Sequence Number=SeqID_22222
MTQELVARGDTLRLSAPRHSVTPSVIDEQRPVWSFAPFPGMSTSSGGDFFKSHKLSRTTHSRVRWRAETKLVILHPLSSRGGDGPDDMRRQNLVIPHPFAIQTQSCLMAVQRQNLVILHPLSSRGGGPDDMRRFTSSSALTRSVILTFESC

SEQ ID NO: 113908 - protein, 219 aa, Glycine max
  Coding DNA Sequence Number=SeqID_22223
  Homolog annotation: Hit_ID=A5ZD10; Match level="QueryCoverage=94%, HitCoverage=69%, E-value=1e-08, Identity=22%"; Hit description =Putative uncharacterized protein
MVDTEFKTKVREAMLKDRENYGGSDTAYASTLSINKTSFNKIKNGQTEKVISDSSWLHIARLLHVSRDEKAWKVARTSVYIEMEDQFNFCQTNSKGMMLVDDTGIGKTVCGSHIVQFMKNAFYVDCSQATTKFKLIRSLARTIGADVTGKMDAVLQGVKDMLNFMEQPFMVLDEFGDLDYNALLLIKELQNATVGRCGWFAMGAEGLRKKMEREWLRRK

SEQ ID NO: 113909 - protein, 52 aa, Glycine max
  Coding DNA Sequence Number=SeqID_22224
  Gene Ontology: Mol. function=aspartic-type endopeptidase activity; Biological process=DNA integration
  Homolog annotation: Hit_ID=A5AFZ5; Match level="QueryCoverage=100%, HitCoverage=5%, E-value=1e-15, Identity=62%"; Hit description =Putative uncharacterized protein
MQDSNSEKWIEAMNEEYKLMQDNKVWELVPLPEGNVERYKARLVAKDYTQNE

SEQ ID NO: 113910 - protein, 129 aa, Glycine max
  Coding DNA Sequence Number=SeqID_22225
MMEAMMNMRKMMEAMTTATVVATNIATEMDPIHPAGSINKHSFPPYGLPPNYTLPTVVYASGYTTERHAFASIPMLNALDYLNVALLEKERIEHMEERLHAIEGGGTYVLANMTELCFVPEVVIPPKFK

SEQ ID NO: 113911 - protein, 116 aa, Glycine max
  Coding DNA Sequence Number=SeqID_22226
AFFSSSNPILLEPLAHGSSDWSLPREDCITKCHVKESLNKKLESEELFNNLHAHLEPQVNAIEPPLIEVTSQPPQIVENALATIITFTTPHEITLLTTFALTGVSEESIQDLLCLQ

SEQ ID NO: 113912 - protein, 99 aa, Glycine max
  Coding DNA Sequence Number=SeqID_22227
  Gene Ontology: Mol. function=peptidase activity
  Homolog annotation: Hit_ID=Q8H6W2; Match level="QueryCoverage=88%, HitCoverage=95%, E-value=2e-12, Identity=42%"; Hit description=Gag -protease polyprotein-like protein
MASSNFLFPEGNSINRPSILNGMGYHYWKTRMQIFIEAIDLNIWEAIEIGPYIPTMVVGNATIEKPREQWDEEERRKDWMNTLESQIVRIQKKCEIHCK

SEQ ID NO: 113913 - protein, 114 aa, Glycine max
  Coding DNA Sequence Number=SeqID_22228
MGIRTDLKSKFSSSVDNRNGDTVFGLWLTSIAGYSQILVIRMPWWLKWDIRYPPKKTMLFLEGPMGIGKLCCVAAWDLAKHRAWAWINAKGKGRKFSYCEWEMNPRACLNCLTL

SEQ ID NO: 113914 - protein, 107 aa, Glycine max
  Coding DNA Sequence Number=SeqID_22229
VGVEEVKDPDVPVPVPTDEVSLVGQAIHTFLAWPTHLETVYPAKPPQNPDPEVDDSLYLMTLTIPELFLRPYQSIQRSGQSQFETKSYIKSWMQSSKRDVYPRAYLN

SEQ ID NO: 113915 - protein, 68 aa, Glycine max
  Coding DNA Sequence Number=SeqID_22230
MEARNPHVSPEMRRGYHYSPRCVSFIRATRMRGDLPCLRIYIERCAAPPITKLNQSKVAATWKSAYWQ

SEQ ID NO: 113916 - protein, 127 aa, Glycine max
  Coding DNA Sequence Number=SeqID_22231
MFGSGGPFAKDDRSRSTGSRHHAVPWRYTPPNKKEEEATDISSLLAKVTNITGLSGVTRSGRVFVPPDLPIQPVNVKGKAKVVEEKDDKMPLTPNEDIPVKGLPEKRDGYGKKEVSLEEASEFLRII

SEQ ID NO: 113917 - protein, 83 aa, Glycine max
  Coding DNA Sequence Number=SeqID_22232
MVGYTPSSFADMVFAGKRIEVGMKRGKFGHPALIKAGANEEDENEGETHAVATIHIWPSFPPTQQCHYSTNNNPSPYPPPSYP

SEQ ID NO: 113918 - protein, 198 aa, Glycine max
  Coding DNA Sequence Number=SeqID_22233
  Homolog annotation: Hit_ID=Q6UUU1; Match level="QueryCoverage=43%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRAPLLFPAFRFTGCHSAVMARVCLISTALTLQFPGKAVSLPSWTVCTNPPVSVRPLRPYPELSSWVQPRKDMQKHHWQQPL

SEQ ID NO: 113919 - protein, 167 aa, Glycine max
  Coding DNA Sequence Number=SeqID_22234
  Homolog annotation: Hit_ID=Q6WAY6; Match level="QueryCoverage=23%, HitCoverage=6%, E-value=4e-08, Identity=64%"; Hit description =Putative uncharacterized protein
MEGLVDLAAIDAFLAFHHGKESPVVAILAMYDTFDRGCEKSSARIVCCALALYVWLEGRIRILSSCEGCPNVPLMGTRGCINYNPVLAIRPLGYPMRGVPSGESITPFIARGFSDHNARDRELRGSSNGIIGGYHKWLRVRTQGLDWLPNLKTVRDNEVKASEESDE

SEQ ID NO: 113920 - protein, 161 aa, Glycine max
  Coding DNA Sequence Number=SeqID_22235
MLDKQVAMSPAKPTDGPDPQLFLKSLQVMWDAIVFVVFKQDFPLYIKHEDLSEIPDSGQCLSISVIQLWILHPTKTSMRAGNSDVYGFLEPQSIHRSGQSQFESESYMKSWMQNSKCDVYLRAYLNGDHWQMVIILPKENLVVWFCSLHNRPYNYLKRIIN

SEQ ID NO: 113921 - protein, 341 aa, Glycine max
  Coding DNA Sequence Number=SeqID_22236
  Homolog annotation: Hit_ID=Q6WAY6; Match level="QueryCoverage=89%, HitCoverage=51%, E-value=3e-38, Identity=34%"; Hit description =Putative uncharacterized protein
MGTNQNGKRFYQVKVKGLDVTSLKELGRLMGPLQRQAFRKVYEKILDLTTAEVFTEAVVSLAQYYDQPLRCFTFRDFLMVPTVEEFEEILGCPLGGRKPYLFSGFLPSLSKIAAVVGDSSKELDRMKQTRNGVVGLPRKYLEGKARDMASQEKWGPFTDILALLIFGVVLFPNVDGLVDLAAIDAFLAYHHSKESLVVAILADLFDTFDQRCEKNSARIVCCLPALCVWLVSHLFQPDIRHPCLLQSYRSCVEKRIVDWDRHLAGIGGSAINWFSRWKEGKEGVLFSCGDYPNVPLIRTRGCINYNPALAIRQLGYPMRGAPTEESRSPFLLRDLGAQSLK

SEQ ID NO: 113922 - protein, 120 aa, Glycine max
  Coding DNA Sequence Number=SeqID_22237
  Homolog annotation: Hit_ID=A6FJQ2; Match level="QueryCoverage=31%, HitCoverage=84%, E-value=3e-11, Identity=92%"; Hit description=50S ribosomal protein L5
MTGETSDTCSSRRRSQLVCKRMPGADKPVRARQRMRKEKIPHQAPFAIQAAQLLGRAIGAGLFAITPAGERGMCCKAIKLGNARVFPVTTLGNVVKKGVKTPEYLLGFTMNALSMPATLS

SEQ ID NO: 113923 - protein, 125 aa, Glycine max
  Coding DNA Sequence Number=SeqID_22238
  Subcellular localization annotation: CTP_CleavageSite=60; ConfidenceScore=5.42e-01
MKHFTDTPHQCQHSKPVYTPLAPNTQTASPRALADSLMQLARQETAMTMITPSSKLTLTKGNKSWYRAPPRGQGLTFSPSVKVYDKFGLWLKACRTAGHDICQGLASGSGIKGMSHIISMIHMQQ

SEQ ID NO: 113924 - protein, 98 aa, Glycine max
  Coding DNA Sequence Number=SeqID_22239
  Homolog annotation: Hit_ID=Q84VH5; Match level="QueryCoverage=63%, HitCoverage=9%, E-value=7e-15, Identity=69%"; Hit description =Envelope-like protein
GTHVPDIVSTSGKAAASGAVSKDDLIAELKDTCKVLEATIKANTEKKMELERLIKRLSDNGVDDGEAAEEEEDAAEDTESDDDDSDATPMTSYWGMSL

SEQ ID NO: 113925 - protein, 71 aa, Glycine max
  Coding DNA Sequence Number=SeqID_22240
MENSSLTVNHLIQPYFNLLSENQLRGELPGNHITSETSKRVGLRPQKETTPENLAFHGFKQKTQLKHEAET

SEQ ID NO: 113926 - protein, 185 aa, Glycine max
  Coding DNA Sequence Number=SeqID_22241
MSCLAIITLISLYRSVSWCMPPTRHPLDSDKSNRALGFLALITGLCQPFGVPVTPSKVIRPPITRAFIEKYCMPRQAQGDAPQAADAPPPPHQGDPAGSLGMELYRQHLIHECLYQFNLSQQGQGFTPFACPTPEQFGAEVAWPGDWPEAQAGEAPAGSPGDVEEARMDEEMTDLLGFLGGSGAT

SEQ ID NO: 113927 - protein, 81 aa, Glycine max
  Coding DNA Sequence Number=SeqID_22242
MVNQRCFDDNNDDDKGDDKKLKDQSKNNSKFKIRIKNNSRLKKKVSSQESRFKVQDLKNQDSRIKRRLNQEEYKKFFSRSE

SEQ ID NO: 113928 - protein, 97 aa, Glycine max
  Coding DNA Sequence Number=SeqID_22243
  Homolog annotation: Hit_ID=P03697; Match level="QueryCoverage=28%, HitCoverage=12%, E-value=3e-08, Identity=96%"; Hit description =Exonuclease
MTPDIILQRTGIDVRAVEQGEDAWHKLRHQAYRYRRPRGGARIYSASSLTDSLRSVVRLRRAEMAYERGGDFLEDARKILNREVRGRAKPFFIGSAP

SEQ ID NO: 113929 - protein, 60 aa, Glycine max
  Coding DNA Sequence Number=SeqID_22244
MTWAKCASIAKRSFSATEEYGRASILRLCAKGEISALSAAVVFSQAQRTTGAKLTSTYSR

SEQ ID NO: 113930 - protein, 649 aa, Glycine max
  Coding DNA Sequence Number=SeqID_22245
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=99%, HitCoverage=59%, E-value=1e-152, Identity=48%"; Hit description =Cytokinin independent 2
  Pfam annotation: Domain name=HATPase_c; Domain location=122-317; Score=143.4; E_value=6.2e-40; Accession=PF02518.17; Description =Histidine kinase-, DNA gyrase B-, and HSP90-like ATPase
  Pfam annotation: Domain name=HisKA; Domain location=1-58; Score=56.3; E_value=1.1e-13; Accession=PF00512.16; Description=His Kinase A (phosphoacceptor) domain
  Pfam annotation: Domain name=Response_reg; Domain location=505-645; Score=79.6; E_value=1e-20; Accession=PF00072.15; Description =Response regulator receiver domain
  Pfam module annotation: Pfam domain module=HATPase_c::HisKA::Response_ reg; Domain location=122-317::1-58::505-645
MSHEIRSPLSGVVSMAEILSTTKLDREQRQLLNVMISSGDLVLQLINDILDLSKVESGADHLNFFPPHKTPLFSIGVMKLEATKFRPREVVKHVLQTAAASLQKILTLEGNVADDIPVEVIGDVLRIRQILTNLVSNAVKFTHEGKVGINLYVVTEPPFAKAEGHQKMITEQSTNSANGVKEEKRASTPRSNDDQNCLDGQKNNDHPSQNHAVNDECRSSVKSECSINGDTEEQTHSTETVWIRCDVYDTGIGIPEKAIPTLFRRYMQVSADHARKYGGTGLGLAICKQLVELMGGRLTVTSKEHCGSTFTFILPYKVSTVCDDSDDPDELSDVDDNDDDTTEGFFQFQPRTLGSLFSSNGPTRPQNVLPGFRSSHNFNGFSENSFSFLTTNIISKGTNSTEDASSVIVDAPEMSESTGSSSHSPQTKHENVVNTNNQNQDKAHARLQNGSVDSSQHKEAMTLGTMSSEPQQTCQGQVKTDITSQSVIKSNKYTSSEVTKSTLGPKILLVEDNKINVMVTQSMMKRLGYGMDVVNNGVEAVRAVQRHTYDVILMDVYMPVMNGLQTTKLIRSYEETGNWEAAREAGIEQCSPASNECSVPLKNRIHIIAMTANTMSESADECYANGMDSFVSKPVTFQKLKDCLEQYLR

SEQ ID NO: 113931 - protein, 523 aa, Glycine max
  Coding DNA Sequence Number=SeqID_22246
  Gene Ontology: Mol. function=nucleic acid binding
  Homolog annotation: Hit_ID=A7UQU7; Match level="QueryCoverage=60%, HitCoverage=61%, E-value=2e-35, Identity=30%"; Hit description=IMP dehydrogenase/GMP reductase, putative
  Pfam annotation: Domain name=DUF1723; Domain location=155-204; Score =39.1; E_value=1.5e-08; Accession=PF08330.1; Description=Protein of unknown function (DUF1723)
MAKALGFRVVGLGLISQGVIGRALGRQDHHDGDDVPQRRRPTASACRQQEATLVAEDAPEMSEDILAPGAEAADGGEGSAVDGAQGFPGGPRDPSVLTSFADHVALSIWNGEEHPELKLASHGRKVEKFERPALEIEGLVAATRLTHLITCSVDIGNRRVIFAFVERWHKETNSFHLSVGKLAITLDDVASLLRLPIIDAFHNFEPLHLDEAVIMLVELLEVSDEEARAETRRCEARHWNVAARAYLLHLVGCTLFTNKSATHVHVVYLDAFRDLAQSGSYAWGATALVHMYDQLNDVSQSTSRQLVGYITLLQCWIYEHFPSVHESMTNEGYDETSPCVCQWLTTKAYSKGFAASTYQTRIDTLTIPDGELRWGLVVVTHHLERVVRQFGYIQTIPPSPIGATLSFEDMDDRWMHYSDHLVAAVDLPRHPPVPQHETYVESDILEVPVAPKAGPSQAVDQPRHAMDACEAIAERLEHVLNLRIVTTGTKLHDIMEDCLRIARGVTSDGNVYVRTQRRRCMDQ

SEQ ID NO: 113932 - protein, 1120 aa, Glycine max
  Coding DNA Sequence Number=SeqID_22247
  Gene Ontology: Mol. function=binding; Cellular component=nucleus; Biological process=embryonic development ending in seed dormancy
  Homolog annotation: Hit_ID=A7Q4C0; Match level="QueryCoverage=51%, HitCoverage=83%, E-value=1e-132, Identity=44%"; Hit description =Chromosome chr9 scaffold_49, whole genome shotgun sequence
  Pfam annotation: Domain name=PPR; Domain location=137-171; Score=1.0; E_value=5.9; Accession=PF01535.11; Description=PPR repeat
  Pfam annotation: Domain name=PPR; Domain location=213-247; Score =10.7; E_value=0.42; Accession=PF01535.11; Description=PPR repeat
  Pfam annotation: Domain name=PPR; Domain location=248-282; Score =33.8; E_value=6.3e-07; Accession=PF01535.11; Description=PPR repeat
  Pfam annotation: Domain name=PPR; Domain location=283-317; Score =30.2; E_value=7.8e-06; Accession=PF01535.11; Description=PPR repeat
  Pfam annotation: Domain name=PPR; Domain location=318-352; Score =33.6; E_value=7.3e-07; Accession=PF01535.11; Description=PPR repeat
  Pfam annotation: Domain name=PPR; Domain location=386-420; Score =28.1; E_value=3.2e-05; Accession=PF01535.11; Description=PPR repeat
  Pfam annotation: Domain name=PPR; Domain location=421-455; Score =12.9; E_value=0.23; Accession=PF01535.11; Description=PPR repeat
  Pfam annotation: Domain name=PPR; Domain location=456-490; Score =10.6; E_value=0.43; Accession=PF01535.11; Description=PPR repeat
  Pfam annotation: Domain name=PPR; Domain location=491-525; Score =26.8; E_value=7.8e-05; Accession=PF01535.11; Description=PPR repeat
  Pfam annotation: Domain name=PPR; Domain location=526-560; Score =20.2; E_value=0.008; Accession=PF01535.11; Description=PPR repeat
  Pfam module annotation: Pfam domain module=PPR::PPR::PPR::PPR::PPR::PP R::PPR::PPR::PPR::PPR; Domain location=137-171::213-247::248-282::283- 317::318-352::386-420::421-455::456-490::491-525::526-560
MRYRRTHRIAVEGCLCLCRSWHSSSKWRRRNTVNSETLSRCPSDLIAFSLFLWSAQRRRHDSFAFDRIVTVLRRLTHRYDTVPAILSHLETIGCASLTNPVSQLVLLRIYSRAGMYAMLLEAYHHLQASYAFVPDTFARNLVMDALFRVGHSHLALTLTLSLFNHTHPPNFFTFHILLLHLSKLNNNNLNLNLPHIARMLRLMLWAGYSPSPLTFQMLLNSLCKINAFPQAYQLLALMTVLGINFSVNIWTILIHNYCKFGRLRLANNLFHNMLQTGCSPNVVTYTILFKAFMQSNMPSPAFRLFNVMLSSGQSPDLILCNVLIDCLSKAGRCQDAIQVFLSLSERNLKPDSYTFASLLSTICRSKMFYLLPKLVLVSRHVDADLVFCNALLSSLTKADLPSLAVGFYDHMIDEGFVPDKYTFAGLLSALCCAGRVDKAVNVYHGVVMSYHDIDAHIHTVIIVGLLKTGKFHKAVSVLRFAVMNKYPLDTVAYTVGICALLRGRRTQEACTLYDQMKNDGLKPSVHTYNMMLFTFCKERDLQMIKQILQEMIDSRIYLSGRNFSNLCKYMCRSDTHLSLLKLLAEIRDLRLLSAKALHFLNFDRHADGVQAKHKHQAEDNTEWNLILDTSSSEDLSDVAASVVGFDIVETPLPSEFTPWYGRAIGRPKEESTKLVIQYVKHRAVLGAKYHRIDWTSISDLPASPIACMRRMNSLNSNMRFRKASCEGILNNSSPDAEIQITSLNKEAWDDFENKNIKMALDEILRCKMMAKLGASSQKGQLQYDGWSDANANANGLVGGTGNERFELSQHFLQSVSKSPFPFNTGKQAVKFSAWLEERGKDLTEVGANLAEDLQCGDIFHLLALVSSGELSISPFLPDNGVGEAEDLRSAKRKYDTTESSYSDKAKKSKSFFGVEGEIISRREKGFPVVYAAIQKAGDQGLSMGEISQVINLPGAEIDVLIVDALQAFGQALKVNAYDTVRVVDVLYRHKYFLTPMSDFHLRVVQPSSSKTIEKSDHTCELYESEERDTTSVDTSRNEGCKQNRLGLSRVNHKKETLEFSSSKSCVPILPWVNGDGIINNIVYRVLRRRVLGIVMQNPGILEARNLGFWIFDKFGCYNPT

SEQ ID NO: 113933 - protein, 639 aa, Glycine max
  Coding DNA Sequence Number=SeqID_22248
  Homolog annotation: Hit_ID=Q2HVW0; Match level="QueryCoverage=10%, HitCoverage=47%, E-value=7e-07, Identity=46%"; Hit description =Putative uncharacterized protein
  Pfam annotation: Domain name=RRM_1; Domain location=110-180; Score =9.9; E_value=0.018; Accession=PF00076.13; Description=RNA recognition motif. (a.k.a. RRM, RB
MEEHSLRCGSNSRQRRNGDTHRRSFNGTSNRSLNRGQREHKRDDKECFNKNAKDASFGKIEEWTKVISRRKAKKRKKITSEDRTPHKYDIRGNPSNYHLNWRNKEDITSFYFTHVTDEVNEVRLWEKFKVWGDVREVFIAKRRNKEGRRYGFVRFKGVSDVKLLEVQLDNIFIDDQKLFVNLPRFARSAWNLEMQTRVGKGGEPKKGTIICPEATNRPRVRSYAEVTAQRGVSGGRTSCEGDTPIISDCISWELGYNISTKFLGDDMVILTGLPNNRVVWLQLWGFSIEVWDVDHMKQVVSIIGDVIETDEDTDDRHRLDRARLLVRTPLPPAIMKEVIVRTGDADYRVWLVEEVGDDGAVRRTRTPLSEEWTEEITSVEEDDDDDDTTFSYSAELSSTKNQLRSSHQSHAIPSGYCCQTPNHSSPLDNTPSADEYIDKSGDRGEHTQGSISAKVDPVVCFTEKAQGNALTDMITLDPAKAGSRQPVEDQIGNFLNCEDLAEKEQNIYGVNTRLVTDRGSQPGMPSLQFQKAIGPSSISGPIMKMEGCKKENHPTSAQTSKGSSDLFSKVYVRQRHGPSKAAPLEPVVEEDISLREDKGLGGLNDSSCKGPNNRTLEAFEGFKNTEENSLEDLEEAMQQ

SEQ ID NO: 113934 - protein, 62 aa, Glycine max
  Coding DNA Sequence Number=SeqID_22249
MHGGEKTPKECENEALCRLKKLGAWCKALFIAALFIVKTECRSSRGTASCDCATMGTNRILH

SEQ ID NO: 113935 - protein, 337 aa, Glycine max
  Coding DNA Sequence Number=SeqID_22250
  Gene Ontology: Mol. function=unfolded protein binding; Cellular component=cytoplasm; Biological process=response to stress
  Homolog annotation: Hit_ID=P55737; Match level="QueryCoverage=72%, HitCoverage=34%, E-value=1e-120, Identity=86%"; Hit description=Heat shock protein 81-2
  Pfam annotation: Domain name=HSP90; Domain location=4-335; Score =360.4; E_value=3.1e-105; Accession=PF00183.9; Description=Hsp90 protein
MAPYSSKHHHTSPGHCDWNSAFHGQNGGMGEQIVLQCRSAASIDCLLSRCTVRGEEITKEEYAAFYNSLTNDWEEHLAVKHFSVEGQLEFKAVLFIPKRACFDLFDTRKKPNNIKLYVCHVFIMDNCEELMPEYHSFVKGIVDSEDLPLNISREMLQQNKILKVISKNLVKKCIDMFFEIAENKEDYNKLYEAFSNNLKLGIDEDSQNKTKLAELLRYHSTKSGDDMTSLKDYVTRMKEGQNDIYYITGESKKAVENSPFLEKLKKKGYEVLYMVDAIDDYAVGQLKEFAGKKLVSASKEGLKLDESEDKKKKKEDWLLKFYHTLTEGTELEVYLVI

SEQ ID NO: 113936 - protein, 247 aa, Glycine max
  Coding DNA Sequence Number=SeqID_22251
  Subcellular localization annotation: CTP_CleavageSite=83; ConfidenceScore=5.56e-01
MAKVPLPLLLLHFVLSMNSVAMNSVLHQAPSFFKWHNASFAHSFVVFSPQCTVLLPRSSFVSLRSVWFGERLGSVKVKVKALRWSTVAYEMDEDQWMYEGIMPEEVDMDYENEEECGVNEPHVDCSDAFNTSQEAEIMWIGLWCLTTERMSDTNTSSRGRTSFVLIGCERSDEYWCRKKEFVRRDTRTRKCGYPFKLRCKPMVGGQGWTMKLICGIHNHELTNSLVGHPHDGQTKKHSADSKGAQCQ

SEQ ID NO: 113937 - protein, 145 aa, Glycine max
  Coding DNA Sequence Number=SeqID_22252
  Pfam annotation: Domain name=PPR; Domain location=17-51; Score=32.2; E_value=1.8e-06; Accession=PF01535.11; Description=PPR repeat
MVVAHKLFDTTAIPNLVSWNTMISGFDHNQMFEKSLEMFNRMHLLGVEPMSLVMGVFFWPVGLGGGDVNSLASAPIRPKLNYKWKKQGMDEVLYQMRERWATLKTLGLLDSRIRAQRASLAERDGMLSDGRFSRVLLRARRVSLH

SEQ ID NO: 113938 - protein, 285 aa, Glycine max
  Coding DNA Sequence Number=SeqID_22253
  Gene Ontology: Mol. function=transmembrane transporter activity; Cellular component=membrane; Biological process=transport
  Homolog annotation: Hit_ID=A7P669; Match level="QueryCoverage=72%, HitCoverage=52%, E-value=7e-81, Identity=72%"; Hit description =Chromosome chr4 scaffold_6, whole genome shotgun sequence
  Subcellular localization annotation: CTP_CleavageSite=3; ConfidenceScore=5.34e-01
MALANTSVASTTVLSSMSGLFTLFFGAILGQDSVNITKIAAVLISMAGVAMTTVGKTSAADENISMTQKHSIMGDIFALLSAICYGLFTVLLKNSVGSGEKVDMQKLFGCFGLYSFLGFWWLAWPLNVVGIEPHFKFPSSMSTWEIVIANSICSSVISDYLWALSIVWTAPLVSTLGMSLTIPVAMIADMVIHGRKYSAMYILGCIQSELNTIQREPLLLNDAVSQASMEKGKGVMGSGGRRWGVDFSDNSTSRDIPDPPGFSRASLDQAQALYNPFFSFNFVTF

SEQ ID NO: 113939 - protein, 115 aa, Glycine max
  Coding DNA Sequence Number=SeqID_22254
  Homolog annotation: Hit_ID=A5BEV8; Match level="QueryCoverage=83%, HitCoverage=13%, E-value=2e-10, Identity=35%"; Hit description =Putative uncharacterized protein
  Pfam annotation: Domain name=AFT; Domain location=6-102; Score=-32.0; E_value=0.0024; Accession=PF08731.2; Description=Transcription factor AFT
MSMIVFDSREDVLRWARSVAHENGFVTLIIRSDTNTGSRRKTSFVLIDCERSDEYRCRKKEFVRRDTETRKFGCPFKLRGKPVVGGQGWMVKLICGIHNHELAVISWTSICRAID

SEQ ID NO: 113940 - protein, 102 aa, Glycine max
  Coding DNA Sequence Number=SeqID_22255
MSSFWLDDVPVFCSAHFACNFKGLPQYRLALQQHVNIGKSWDLRLLPSWPYSIHDPRCNDGDDNDNNDDNDINSVGDNNNVKSDDVICDDDDHSDIGGGIKW

SEQ ID NO: 113941 - protein, 23 aa, Glycine max
  Coding DNA Sequence Number=SeqID_22256
MEGSAHTECIVTEDSEVAETFLN

SEQ ID NO: 113942 - protein, 210 aa, Glycine max
  Coding DNA Sequence Number=SeqID_22257
MITVMTIVVATNMIIIVVITVVIIAMTTIITTNMTIAATIDAINMTTIAATVVIAVATTVVIVVMTTVVATNMTVTVAGNGNHDDDHECDDCDNDGSCSDDLDLEESVQAEGGRKPWTIKEDLKTWILRRKGDLAWTINEGIFVDHGLLKYLDVAVAYCYLSVINSVKPKRDVDNADFFKTFLVHFGTIKVSSSSLENIAEQVSNEGQFS

SEQ ID NO: 113943 - protein, 115 aa, Glycine max
  Coding DNA Sequence Number=SeqID_22258
MKTQGFRSDEEEHGKRERERKEAYRESEVEDELEGELAELLEEEVAHYNEAGTGQRQARRSDVHRCQNPAIMRRQSAGDCDGGRHYTEVVRCRRPVVTLWIISSNSPRNEEIQRW

SEQ ID NO: 113944 - protein, 145 aa, Glycine max
  Coding DNA Sequence Number=SeqID_22259
  Homolog annotation: Hit_ID=Q2HRR7; Match level="QueryCoverage=74%, HitCoverage=38%, E-value=8e-08, Identity=33%"; Hit description =Cecropin; Plant MuDR transposase, putative
MDGNINLILHHGGRFTPHASDGKVEYIGGEFDVWEDISADYINIFILYDLVKACKKYSSIGDCFWLIDNDLDFNHGLRSCTTDGDILYLVRDALENENEINIYFHHEVDPIPEEVPQMLYLKCHPILKASNEDDLDDVPIDGHEE

SEQ ID NO: 113945 - protein, 132 aa, Glycine max
  Coding DNA Sequence Number=SeqID_22260
MISLSKKNFEIKTYRESESDYDTYTVSKNETDSDNTVSDTTMCRKSESETNKGFVREMSREGDESSWLNTEYKGPTFLGFIARSGICFLVDHWTTSFVSIARSGYNFLVVIIGHKDFIRILKISSGLLGDWT

SEQ ID NO: 113946 - protein, 597 aa, Glycine max
  Coding DNA Sequence Number=SeqID_22261
  Gene Ontology: Mol. function=peptidyl-prolyl cis-trans isomerase activity; Cellular component=spliceosome; Biological process=protein folding
  Homolog annotation: Hit_ID=A7P4N5; Match level="QueryCoverage=100%, HitCoverage=100%, E-value=1e-114, Identity=64%"; Hit description =Peptidyl-prolyl cis-trans isomerase
  Pfam annotation: Domain name=Pro_isomerase; Domain location=14-168; Score=179.3; E_value=1e-50; Accession=PF00160.12; Description =Cyclophilin type peptidyl-prolyl cis-tr
MSSVYVLEPPTKGKVVVNTTRGPLDIELWPKEAPKAARNFVQLCLENYYDNTIFHRIIKDFLVQSGDPTGTGTGGESIYGGVFADEFHSRLKFKHRGIVAMANAGTLNSNGSQFFITLDRCDWLDRKHTIFGKVTGDTMYNLLRLGELETDKNDRPLDPPKILSVEVLWNPFEDIVPRTLQKLQIEAKADTKNKESGKKGVKKLNLLSFGEEAEEEEKELASVKQKIKSSHDVLNDPRLLKEDTLNNELSSSRRDMQLSVRDALNSKKDEPQKDSDAGSMACLNFSDDDEADFDARMRMQILKKRKELGDLPPKPKLRNVCYISTSDLGNVSGSTYASFNDLITMTLCYQSHCQAALFIPSSSPTEDKSFRNYCGHLILIPSVNLKTKHKNDEGPVQRTMIRRLQPGSLWVAFGQYLLHVSALAYLGTKLFELVAKDPRSNAVSVDEDQPKVEKLSLKKKGVGSEARAERMSNADADLQLLNQAERGRQLQKQKKRRLQGREDEVLAKLEKFKNSLSAKATPPTDESEDVSNEELSDWKGVSLKFAPQTGKDRMSRNEDPNDYVVHDPLLEKGKEKFNRMIAKQKRREREWAGSSLT

SEQ ID NO: 113947 - protein, 399 aa, Glycine max
  Coding DNA Sequence Number=SeqID_22262
  Homolog annotation: Hit_ID=A2Q4S5; Match level="QueryCoverage=45%, HitCoverage=34%, E-value=1e-14, Identity=29%"; Hit description=IMP dehydrogenase/GMP reductase, putative
  Pfam annotation: Domain name=DUF1723; Domain location=91-140; Score =57.4; E_value=4.9e-14; Accession=PF08330.1; Description=Protein of unknown function (DUF1723)
MVRTRGLDRTLGKIIGRALGREPKETGVDDVVTNAESFSGEPHDTSVLIGYVHHVVVTFWSEEEHPELKLSYHRGKVEKFGSPLITCSLDTNDRGLISTFVERWHKETSSFHLPVGEVTITLDNVASLLHLPITSTFHSFKALHMDEVMLLLVELLEVSSEKAKAETIQCHGTYVWLSWLRDIYRYKCDAAQWTVAAQAYLLHLVGCTLLIQALFVALNQFSLHFRQLQCFKGSWTPQLPKARSASMSRRARVSEIPLSEHGRAKREKRQRPLWADAFRDLTQSGSYAWGTVALVHIPAQPGDPPKHPPVLHNDIFIAPDIPQHLVVAVVMDEAPTDAPVHEVCQTIDERLERLLNLRIVTEGTKAYTITKDCLRITRGVTAERNVDVRSGRRRHIKDT

SEQ ID NO: 113948 - protein, 49 aa, Glycine max
  Coding DNA Sequence Number=SeqID_22263
MEGIVGIGSKARIVTKRVLQAKDRALATVRIDELFKKFYRGNKNGLNIS

SEQ ID NO: 113949 - protein, 88 aa, Glycine max
  Coding DNA Sequence Number=SeqID_22264
MKVLEKGDEGITMEEEDLLMRSTKKIKNDQKEKGSENDVSYANKLLKPIGGNMDDVVLMDGVKDNGVLEEAPKESLSIMDQKLGGSEF

SEQ ID NO: 113950 - protein, 52 aa, Glycine max
  Coding DNA Sequence Number=SeqID_22265
MTSTHDALLYYNERWNMSCQHDFVGYSFTGKNSKRFDIPSGCSINGLKDVIN

SEQ ID NO: 113951 - protein, 122 aa, Glycine max
  Coding DNA Sequence Number=SeqID_22266
MAFLGETSSQIIVNSRLAFIFLNGSIIHNQSGVYFQNSTSIPIRVPNDCGFETRKNKMHNTLQLTDDQYLDEIYYRQHLSQIQRWNMSCQHDFVGYSFTGKNSKRFDIPSGCSINGLKDVIK

SEQ ID NO: 113952 - protein, 53 aa, Glycine max
  Coding DNA Sequence Number=SeqID_22267
  Subcellular localization annotation: CTP_CleavageSite=15; ConfidenceScore=5.06e-01
MAFCGIFFSNLTHVTRSRLASLHESTPSPLSLLQVCPKMSLLLSRLAGPKFNP

SEQ ID NO: 113953 - protein, 52 aa, Glycine max
  Coding DNA Sequence Number=SeqID_22268
  Subcellular localization annotation: CTP_CleavageSite=33; ConfidenceScore=5.21e-01
MVSKNDRSPGIITNFSPHKASVSLNPTSLPKITQKHSPKFGTNFSGFMSALL

SEQ ID NO: 113954 - protein, 180 aa, Glycine max
  Coding DNA Sequence Number=SeqID_22269
MTLRSLSQGPARPGPGNLRDHLHQRLLLLLHQLPYLRQHQLTLTPPLRAQTSLCRCCRAFTMASSAHHEHGGVCFLGGLARSLTFFFWGGEASATQKSQPEPEATQEDDPDVVEEDTVEDSLEMTPQALPVTTPVLELSSLQASTVATPVLELSEDEDDATAMDYAPSAPHDDPSAPQDP

SEQ ID NO: 113955 - protein, 141 aa, Glycine max
  Coding DNA Sequence Number=SeqID_22270
MYKALRANAPLPYPQLITLFLRHFQIPLDDEPFVQVKRSFAIGVGAVTSFGYRKDRNGQWLKKDAFPPQDERTPSPPLQREDSALMNEVLTELRGLRSYVGERFDSMNTRFASMDIRLTQLEEDVGYICQSFDLPPPPPPS

SEQ ID NO: 113956 - protein, 86 aa, Glycine max
  Coding DNA Sequence Number=SeqID_22271
MREQMSVKGRDRGSERALSWWTLSESEASPHENEGAVAVSSKREGMRRQLSVWNNVASATARCELAMMLVLQSVSCDDGGLMVVRH

SEQ ID NO: 113957 - protein, 167 aa, Glycine max
  Coding DNA Sequence Number=SeqID_22272
  Pfam annotation: Domain name=Transposase_23; Domain location=78-148; Score=-14.2; E_value=0.043; Accession=PF03017.5; Description =TNP1ENSPM transposase
MSLNTYNIGFQITDDVLTAAIGRPEHLGCVRVVEASVTIKQYFGPALRTFCTSSPMTPKDLEYIKESYVDPSGSDPDTGDLDKCGLYVEENPPRLVALGRLYQGLTTVHNIPLRNDQVKVGVEEVRDADAPILVPIQEIELGGQTLNTFVAWPTHLVKHFSVSELDS

SEQ ID NO: 113958 - protein, 277 aa, Glycine max
  Coding DNA Sequence Number=SeqID_22273
  Homolog annotation: Hit_ID=A5C3T2; Match level="QueryCoverage=45%, HitCoverage=15%, E-value=6e-23, Identity=44%"; Hit description =Putative uncharacterized protein
MGMVGGSTKLMDGGWFKFDNALGVADLDYVLHRDEPAELTNSSTSKEIALYERWERSNCLSIMFIKTHISTSIRGSISECQKVKDFKKALASTLMSKLSSMRLIGEKRRLAQEIGEGAFTVTQDKGKKERKEKNHIPPIVKIKKESRNAKFLENDVASRSDLTQGIGLEENQCEGAIPTSSYKLVVFGDTHQNCVTQAPHQVDHILEVEQHQTQNVEQPIEKHQTQEVEQPIEQQPEGVNVTLRRSTRIKKPTIPSDYEVYLQESQYDFGVKNDVMV

SEQ ID NO: 113959 - protein, 233 aa, Glycine max
  Coding DNA Sequence Number=SeqID_22274
  Subcellular localization annotation: CTP_CleavageSite=34; ConfidenceScore=5.78e-01
MTLSSWQNKLNRQMSTSPSSPPPPSTDSTSHSPSTMKRTRKATRLRSLATRPIGAERPLVHVDPATGKTDGLHKKKLRTYLGIVALDEVDVTYENLKLVSAAEKDLLWEDIQFDLASKWALVVDKDDVDNTICEKYNIRKEKWTQFCQSHKDPSWEEQNISAHVLSRGGYEFQENKLMEEKKKKQLEEAAKSKSTNIIIDPPSPIRQHVKWKMTCTKKIDQMTSEAAKDTTRK

SEQ ID NO: 113960 - protein, 154 aa, Glycine max
  Coding DNA Sequence Number=SeqID_22275
  Gene Ontology: Mol. function=DNA-directed DNA polymerase activity; Biological process=DNA replication
  Homolog annotation: Hit_ID=A7QGP0; Match level="QueryCoverage=92%, HitCoverage=34%, E-value=6e-58, Identity=74%"; Hit description =Chromosome chr12 scaffold_93, whole genome shotgun sequence
MISHTGDVAVLAHPWALKNPVPIVRRLKEAGLHGMEVYKSDGRLAAYSELADAYGLLKIGGSDYHGTGGHNESELGSVNLPVIVLHDFLKVARPIWCNAIREILECYAEEPSDSNLATITRFGRTCSFKGGSPLSCGQDLIDHLSSQEMEKCRV

SEQ ID NO: 113961 - protein, 184 aa, Glycine max
  Coding DNA Sequence Number=SeqID_22276
  Gene Ontology: Mol. function=DNA-directed DNA polymerase activity; Biological process=DNA replication
  Homolog annotation: Hit_ID=A7QGP0; Match level="QueryCoverage=61%, HitCoverage=27%, E-value=1e-40, Identity=72%"; Hit description =Chromosome chr12 scaffold_93, whole genome shotgun sequence
  Pfam annotation: Domain name=PHP; Domain location=61-184; Score=28.4; E_value=1.6e-05; Accession=PF02811.10; Description=PHP domain
  Subcellular localization annotation: CTP_CleavageSite=45; ConfidenceScore=5.23e-01
MGDGCVIEGTTGNSNSNNNNNNKKKNKKKKNRGGSKKKMTHKQVLAFKLKLLGRGGEKLLFELHSHSKFSDGFFSPSKVVERAHINAMKVLALTNHETMSGIPEAVESACKYGIKIIPGVEISTIFSPRGDSEVEEPVHILAYYSCIGPSRFEELDKFLSNIRDGCFLHAQNICLKTEQAQVAS

SEQ ID NO: 113962 - protein, 179 aa, Glycine max
  Coding DNA Sequence Number=SeqID_22277
  Gene Ontology: Mol. function=RNA-directed DNA polymerase activity; Biological process=RNA-dependent DNA replication
  Homolog annotation: Hit_ID=Q2HVE2; Match level="QueryCoverage=53%, HitCoverage=12%, E-value=9e-10, Identity=34%"; Hit description=RNA -directed DNA polymerase (Reverse transcriptase); Polynucleotidyl transferase, Ribonuclease H fold
MVARHVMSDSFMMKVAWESSTRMDSLWVRVVKAKYGCGNDLKPMINKDRHGSNLWRGIKAVWDSFDENCDWTIVNQKYAKCLKQQGFWWQYIWSNETLLAQLSHMNMPWNANKKLQDLLPDVSVRSQGVFTWIITEGGNIIVNCDGVVSHSTRKVVCGGVLRNSTATFLGAFSECGAAR

SEQ ID NO: 113963 - protein, 131 aa, Glycine max
  Coding DNA Sequence Number=SeqID_22278
MGFLLLSLRNTLEHIMGITPNVQRLLHHAMDPNRRPPNQQVTYLQDRWHSHPQCVLTLRDFHGSLHRSDFPVAQPWRVCLRVIRQAAHDGVGIHIGGADDEVLASADVSPPHVARVLCRRQPCRGGPWPYS

SEQ ID NO: 113964 - protein, 225 aa, Glycine max
  Coding DNA Sequence Number=SeqID_22279
  Gene Ontology: Mol. function=binding; Cellular component=mitochondrion
  Homolog annotation: Hit_ID=A2Q1R4; Match level="QueryCoverage=20%, HitCoverage=2%, E-value=5e-13, Identity=82%"; Hit description=HEAT
MLDPTPIVTTHSKHNSNSRTSKWTEEEPVVAHEFEGGLDDAVEEGTAAGVDGGLGRLVLLEADNIDFEDGDNEVGEGADVVARAGGPLGVDVVGLEKDEVRAGVGEEPGGAIVDVGGALHHLVRRKTHGGRNSLSGEREERIYGIKTIVKSYLPIKDAHVCPGIDGLLNILINMLSYGEISKDFQSRKLSVSLFSFQIGYEVQILCTRLCPLEAQLIRATELPSS

SEQ ID NO: 113965 - protein, 61 aa, Glycine max
  Coding DNA Sequence Number=SeqID_22280
MNLDEDDVVMGDATARSDATMFALYGTLKAIAGEAGVPFFYQAGLEFEEMILGSIFLECNN

SEQ ID NO: 113966 - protein, 112 aa, Glycine max
  Coding DNA Sequence Number=SeqID_22281
MNETRAKGIRFVQSNDTFDETYEAYINNTKNSSSKGDAILVAAEIKRVGKKKTNTQEFYTGSAKTCAYIQSPSDLQSLRFLFNLIKFLYKQRSTGDVPSLVLFEQPSGCTLH

SEQ ID NO: 113967 - protein, 68 aa, Glycine max
  Coding DNA Sequence Number=SeqID_22282
MEWMQGKQRTSFKDNSSDNMNFFEARKLTKTWRLRVALRDSVWGVRDNGNDEGGFARLSVSREKGFEF

SEQ ID NO: 113968 - protein, 180 aa, Glycine max
  Coding DNA Sequence Number=SeqID_22283
  Gene Ontology: Biological process=protein targeting
  Homolog annotation: Hit_ID=A7P5Y7; Match level="QueryCoverage=98%, HitCoverage=57%, E-value=1e-20, Identity=41%"; Hit description =Chromosome chr4 scaffold_6, whole genome shotgun sequence
MESLAEEYSGNTYHLIQKNCNHFCEDVCVRLTGKSIPRWVNRLARLGKGYRKLFMRFARSYDNCGNGYFIMNFFLSEKDDVLKDPCDTSPLDSRVTQTLFILVQNLSFLCNCVLPPSLNETKVRQVTIDRVQEGGEKKKMRSQSSRYEASPNPTLSSSQRHCLPPSSVINASPSSTLTVK

SEQ ID NO: 113969 - protein, 79 aa, Glycine max
  Coding DNA Sequence Number=SeqID_22284
MELVLHIQFETQDPAGRILQPGFKKRHYVFYSFYFKLETLQRYCNSEVIKNALGSRIDVPGNHGVLIDGNPSKIKCKYY

SEQ ID NO: 113970 - protein, 81 aa, Glycine max
  Coding DNA Sequence Number=SeqID_22285
MDSAASKHICRDREMFDIFKTNGEFNHFKLGNGEKMKVEGIGSVRMKLHDVVIRTFSNMGFVPSAIVNVIFDAILPPKGIG

SEQ ID NO: 113971 - protein, 41 aa, Glycine max
  Coding DNA Sequence Number=SeqID_22286
MDSKVAMTKSWWLDVAVVVVDISRESDRADNGDGVLSLWWW

SEQ ID NO: 113972 - protein, 286 aa, Glycine max
  Coding DNA Sequence Number=SeqID_22287
MGSSLLMGLIPLKSLSVKVIEGKLRCDGVIAHICAAGISDYLDLLLYLFFYPHHDSYVTSLGVLQGQTIFCVMTNTAMVSEMCNARTWALLGEDGTCPAYASCLTCVSRSWCFILACRIVRKLVRPYNEEHERDSSSACRRLASVANVMRCDWLVAYYTLKRSTKVSKLSMDHGGSPSCQLRLSGFQPKGMLASMMRSTKRSQRVVYPTGRCMWERLRTSLVLTVRRGCDFPWPSAFSAPSYGVLHVRNAILELLESIGIYHGCWWRVGAFERGLMSKARLSANHG

SEQ ID NO: 113973 - protein, 334 aa, Glycine max
  Coding DNA Sequence Number=SeqID_22288
  Homolog annotation: Hit_ID=UPI0000660385; Match level="QueryCoverage =50%, HitCoverage=96%, E-value=4e-09, Identity=29%"; Hit description =Homolog of Homo sapiens "PREDICTED "similar to MGC52970 protein
MELFPLMVIRSVFDLPMVTGLVNQSGDGSSWPMEPEPWTLVVIVAVSERTKGGTSFVVQVEGTSTWVVILRTREGTSLVDQFKWRVHPLGCSKRTRDGLPSIDLGFCEPVKLTKGRSWVGRAFGESTINASFLDFGKTYQGRTMGLTSLVSVSHMSCSCIHVTCGAACTGVVVSCSCIRVTCGVACTRVTMSCYCIRVTYGVARIRDVVSFSCIRDTYGVTHTGDVVSCSCKHVPRGVAHTRDVMLRSCIRVTHGVVRIRDVMSCSCICVTCGVACARDAMPYFCMRVTHGVACIGDIVLCSCTRVTRGVAHTGVVVCEPIGLFKGKLWVLTSL

SEQ ID NO: 113974 - protein, 159 aa, Glycine max
  Coding DNA Sequence Number=SeqID_22289
  Subcellular localization annotation: CTP_CleavageSite=31; ConfidenceScore=5.13e-01
MVNISRAPQTLYLTILPMNSYRKILMPPKVSGTSLRGGKSIGKGFKLALPEPTIKRSSSTSPGSPTQAGASSLKPKKEGSSTQIVTIKPEPSTQEPPKPATVKQTKADYAFSVQTLQALQEIGLIKLPKIVKKTWADIALESDDDSERDLQTMIQNSSQ

SEQ ID NO: 113975 - protein, 273 aa, Glycine max
  Coding DNA Sequence Number=SeqID_22290
  Gene Ontology: Mol. function=kinase activity; Cellular component =nucleus; Biological process=cell division
  Homolog annotation: Hit_ID=Q9M4K9; Match level="QueryCoverage=34%, HitCoverage=34%, E-value=5e-35, Identity=63%"; Hit description =Cyclin A3.1
  Pfam annotation: Domain name=Cyclin_N; Domain location=149-248; Score= 85.3; E_value=2e-22; Accession=PF00134.14; Description=Cyclin, N -terminal domain
MGEQEGEGEVEGQGEVEIESDEDAEPDHENEGKKEQSLQEVEVVEREEESEGRDSNNDAKDDGYNHVTSRVSRGRCHGERIKENLAWRFGTRGCGGGSPQWLQSDCTEEEVVATTFRLLEPLNAEFPILSYADFYQLPGIVAVEVTGRPEVPFHPEREVDPSKRPLMDYVQKIQRDVNANMRDVLVDWLVEAEVAIVGVASMLIASKYEEIKPPEVEDFCYITDNTYSKEEVVNMEAEILKALKFELGGPIEILEKILESWSSDQKKLYKYTL

SEQ ID NO: 113976 - protein, 78 aa, Glycine max
  Coding DNA Sequence Number=SeqID_22291
MVKINNKTEEMFSIVHVMDQSYDEVSRSFVIRWKDEQDPTWNLLHSSSNMYSVIYNQDLVSPALLVGWTELREFYGFT

SEQ ID NO: 113977 - protein, 295 aa, Glycine max
  Coding DNA Sequence Number=SeqID_22292
  Gene Ontology: Mol. function=transferase activity, transferring nitrogenous groups; Cellular component=chloroplast; Biological process=amino acid metabolic process
  Homolog annotation: Hit_ID=Q41199; Match level="QueryCoverage=94%, HitCoverage=60%, E-value=1e-156, Identity=99%"; Hit description =Aspartate aminotransferase
  Pfam annotation: Domain name=Aminotran_1_2; Domain location=34-295; Score=186.1; E_value=8.6e-53; Accession=PF00155.12; Description =Aminotransferase class I and II
MAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARYGKLDLPFFLISDGHV

SEQ ID NO: 113978 - protein, 139 aa, Glycine max
  Coding DNA Sequence Number=SeqID_22293
MGILPKFGDDRCQSRRSQDGLHIVKISFTISHVELHLDWGLIARLLRNRHGNGVGRGRVLFTPPPKSTGVGAGSGTGSGQVLRISSPTPNPNLVIGKNLTLTPVNSNFPRGGFGTGPTDSSPVTMSTKEDVHVLWNTWD

SEQ ID NO: 113979 - protein, 29 aa, Glycine max
  Coding DNA Sequence Number=SeqID_22294
MKGQDFLIAIGGDVRPLKREIDVWFRKEA

SEQ ID NO: 113980 - protein, 36 aa, Glycine max
  Coding DNA Sequence Number=SeqID_22295
MGESVYHRANDTMRDDLSLVRQIDSECSTKPKSLAL

SEQ ID NO: 113981 - protein, 151 aa, Glycine max
  Coding DNA Sequence Number=SeqID_22296
  Gene Ontology: Mol. function=ATPase activity, coupled to transmembrane movement of substances; Cellular component=integral to membrane; Biological process=transport
  Homolog annotation: Hit_ID=A7Q0Z8; Match level="QueryCoverage=76%, HitCoverage=8%, E-value=7e-33, Identity=56%"; Hit description =Chromosome chr7 scaffold_42, whole genome shotgun sequence
MVLEKGYTPGPEVLPLVVSHSPPKVSFLHLVYLNKPEIPEFVLGTLAAIVTRAILPLLGFLISNMINTFPEPTDELRKDSKFWALMFIALGVAGTIFHPIRSYFFVVAGSKLIIRIGLLCYKKIIHMEVGWFDKAGIRSEIYKLRVRYVQN

SEQ ID NO: 113982 - protein, 103 aa, Glycine max
  Coding DNA Sequence Number=SeqID_22297
MGDQEETQEQMKADMSALKEQMTSMMEAMLGMRQLVENNVATAAAVSSAAKADPTLPATAHHPLPNAVGRERSTLGQHQQPHLGYNRVAYPYGYHLLHATSHA

SEQ ID NO: 113983 - protein, 415 aa, Glycine max
  Coding DNA Sequence Number=SeqID_22298
  Homolog annotation: Hit_ID=Q6WAY6; Match level="QueryCoverage=76%, HitCoverage=61%, E-value=2e-32, Identity=30%"; Hit description =Putative uncharacterized protein
FYQVKVKSLDTTSIKELGRLMEPLQMQAFRKTYGKILELTIAEVSIEAIVSLTQYYDQPLRCFTFGDFQLVPTIEEFEEILGCPLGGRKPYLSSGCLPSLSRIATVVKDSARGLDRIKQTRNGIAGLPQKYLEDKARGMANQGDWIPFMDVLALLIFGVVLFPNVDGLVDLAAIDAFLAYHHSKESPVVAVLADLLDTFDRRCEKSGARIICCLPALCEIDWDQLLAGIGGRTSVGSPDGRKEKKEGCINYNPTLAIRQLGYPMRGAPTEESMSPFLVRDLGAQGSETIQRIHKAWETPLRKDKELRGVRNGIIPGYHEWLNPRIRGLDWLAKLKVVSEENFEAPEEDEEVQALKSELGKAKLAKKKFKLAATHVRKECAGLREENAITARALERETKRARKEEYGRNKFRGALW

SEQ ID NO: 113984 - protein, 77 aa, Glycine max
  Coding DNA Sequence Number=SeqID_22299
MVLLVGHSEAICPLPTHLKHFMFLVPVLDEEVEVLCLLPPPLDAADFLCGPDVAGIGKEDWCHPLKNLSKEARGQPP

SEQ ID NO: 113985 - protein, 159 aa, Glycine max
  Coding DNA Sequence Number=SeqID_22300
MGGYSAFDSRTKKKILQIVGERWRQFKSDLTRKWALAADKDGVDDIFCEKYGISKEKWAQCQTRRDPSWEDVRKKPSRLPEAKHPLPYILSHGGYEYLKEKLMAEKTKKRLEEAAQSGSTEGIIDPQSPIRRHVKWKMARTKKTGQMTFEAAKEIADRI

SEQ ID NO: 113986 - protein, 180 aa, Glycine max
  Coding DNA Sequence Number=SeqID_22301
MTSRDQVWSFCTLVSSRGGGPDDTRRYLTVIRTLLSSRGGGPDDKQRPKAAGPMIRGDTLRLFAPFCHPEAAGPMTSRDQVWSFCTLVSSRGGGPDDTRRYLTVIRTLLSSRGGGPDDKQRPSLVILHPCIIQRRRAHDTRRYLTVIRTLLSSRGGGPDDKQRPSLVILHPCIIQRRRAR

SEQ ID NO: 113987 - protein, 73 aa, Glycine max
  Coding DNA Sequence Number=SeqID_22302
MGEMLATQLAQTSWVASSRSNCLLEEFSGRPKWASFRHVTELHELPNDGCQVPRSGQTRVASHNGWSPDEIRV

SEQ ID NO: 113988 - protein, 202 aa, Glycine max
  Coding DNA Sequence Number=SeqID_22303
MWAFHKGLQIDWAHLVRYRMHKELRLNAPLPYPHLVTLFLQHFNIPLDSEPYVPIKKSFLIGASVIASFGYIKEHDGSWVKKGAGNVGEEGHEGEDSSLLSKILERFDGLQTFVEVVIIKKGETLEAKLHGESKVIQRCFDDNNDDDKGNDKKLKDQSKKNSSESRTIQEFKIRIQDSSRKSRDKNQDSRFKISRIKIKIQE

SEQ ID NO: 113989 - protein, 102 aa, Glycine max
  Coding DNA Sequence Number=SeqID_22304
  Gene Ontology: Mol. function=nucleic acid binding
  Homolog annotation: Hit_ID=A5C3F7; Match level="QueryCoverage=61%, HitCoverage=6%, E-value=5e-13, Identity=55%"; Hit description =Putative uncharacterized protein
MEKSEKKNHSEKKLKKAYITSDENDLESSEDSENEEINLCLMAKSYESDEEVSLRKKWYIDSGCSKHMTGDASNFTHISPKKSGHVTYGDNNKGRILGVGKI

SEQ ID NO: 113990 - protein, 139 aa, Glycine max
  Coding DNA Sequence Number=SeqID_22305
  Subcellular localization annotation: CTP_CleavageSite=54; ConfidenceScore=5.05e-01
RPQVGARRDTTAAWGWPAAGNRHTAATSRAPQFIHKKVRALPTTHGRPIGDQVQSQSRTHLVAHDPRNLNKTSTSSEGGEDTLDMHGENVNPYPRKKTQKEGKFSIKEWEKAKKKRRKIPNQRVGESKTRKERKFSIKD

SEQ ID NO: 113991 - protein, 110 aa, Glycine max
  Coding DNA Sequence Number=SeqID_22306
MDEDQWAYEYAMSQEVHMDYDYDNEEECGVTEPHVDCSNAFNTSQVFGTRDDVLQWARTVAHENGFVAVIMRSDTDTGIKNSLEKTLGVGNVVVPSGFVRNQCMEGKVGW

SEQ ID NO: 113992 - protein, 208 aa, Glycine max
  Coding DNA Sequence Number=SeqID_22307
  Homolog annotation: Hit_ID=A9MNV3; Match level="QueryCoverage=100%, HitCoverage=33%, E-value=7e-43, Identity=42%"; Hit description =Putative uncharacterized protein
MGWSWSDQGEVTVNLYSIAACYTTLGDTDFKNCHSNEGFYGFGWDQQAIGTLLKSGHTWNFAKEDLFRRASFFGEIMTSWPQLYPALSKAYREVNQNDPTLVNSSQKKIDWFTLNASKIAGVNLNQYFQQWNIPLSAEAIAAINALNLPQPKKVAKTFTGSLNGSSPITIEVPAEDNTVNIAFVTNTPKAGPTSLVWVEDGETPLYAQ

SEQ ID NO: 113993 - protein, 20 aa, Glycine max
  Coding DNA Sequence Number=SeqID_22308
MEEKRKAKENRRGEAPSTRE

SEQ ID NO: 113994 - protein, 216 aa, Glycine max
  Coding DNA Sequence Number=SeqID_22309
  Homolog annotation: Hit_ID=Q6WAY3; Match level="QueryCoverage=99%, HitCoverage=9%, E-value=2e-08, Identity=28%"; Hit description =Gag/pol polyprotein
GQLIIVSGEEDILVSCPSSTLYVEAAVEFLEMSFQALKVVSNAYVESPPIQPRSFGAALMVARVMLGHGYEPGMGLEPTCADVRRIALERMGRSMGQLQGLQVKKVPLCHINKSFVSMGWMCEGRITMIHKETPQEQSNWVQSCPLEFKLGNWRIVKQPRIFVASSISDNESCEGNDAEDTDVNFEQLINQAEEGEDEDWGLPPELKRTVEQEDRE

SEQ ID NO: 113995 - protein, 86 aa, Glycine max
  Coding DNA Sequence Number=SeqID_22310
MSGFTHDSPQISASPHQLDLAPYTSGPYNAQWNAPGLLHDKHTLRSSRILGEMEVDEPWLSRCKIHFLVGVLVYAKGGVCHWKCGR

SEQ ID NO: 113996 - protein, 139 aa, Glycine max
  Coding DNA Sequence Number=SeqID_22311
GHHLRELKEVPTAQKDLIWEDIREEFDVPERLLTFKSDLMKKWALAADQDGVEDTVCDKYDISKEKWAQFCQTRRDPSWEDVRIKAQAIQKQNTVPQVLSRGGYDYLKQKLVAEKTKKKLHSQEALMASSTLHPRSDAT

SEQ ID NO: 113997 - protein, 113 aa, Glycine max
  Coding DNA Sequence Number=SeqID_22312
  Homolog annotation: Hit_ID=Q8GEG1; Match level="QueryCoverage=67%, HitCoverage=84%, E-value=4e-26, Identity=57%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPNPGKTCKSTHWQQPLGN

SEQ ID NO: 113998 - protein, 198 aa, Glycine max
  Coding DNA Sequence Number=SeqID_22313
MQQPGAIEQPEAYAANIYNRPPQPQQQNQPQQNNYDLSNNRYNPEWRNHPNLRWSSPQQQQQQPTPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKNVSAISLRSSTSHFHSLQEQFPTKKWKRQRKRSWKHLEK

SEQ ID NO: 113999 - protein, 171 aa, Glycine max
  Coding DNA Sequence Number=SeqID_22314
MGDVEEVQEQMKVDMVALKDQMASMMEAMLSMKRLIESNTATAAAASAAAEVDPTHPSATNQAHQPTPDRAGRGGEVLRSTGGLHMGYNRNTYPYSLPPNYTPPTMHENVDHAILVTFEGQQPQPIGGAHEEPREHAQGDFDSYPLFTTEGSTLNAMPQPNIMGPSQPRPL

SEQ ID NO: 114000 - protein, 174 aa, Glycine max
  Coding DNA Sequence Number=SeqID_22315
  Subcellular localization annotation: CTP_CleavageSite=29; ConfidenceScore=5.02e-01
MDPRRAARPHLKKTVCPHLQRTACPYLQRATRPRHQRTACPHLQRATRPRHQRTAWLHALTFRGLHVLANRGLHALTLRGLHVLANVGLHALTFRGLHVLANRGLHALTFRGLHILAFRGLHVLTLRGLHVLALRGLHVLALRGLHVLTIRGLDALTSRGLHVLALRGLPALAL

SEQ ID NO: 114001 - protein, 310 aa, Glycine max
  Coding DNA Sequence Number=SeqID_22316
NVLGRNILTERKVEIYHTEFDDFKAELERHSLHKHLTNLVDGSIDVSSVKEFYANLYNSEGPSPKQARVRGHLVKIDADNLNTFLETPMVLAEGPSWEDPEEGLDNFSLAQYNSFRLGFPALITALCRARGVVSDSLTFECLSSVINLAYIRKKCWNHDDLIVAIRGARRARARSADLPSTSAAPTPAATSAAPSVPAQMDSQRFEAMLQSIHQGQIILLQSPTAQVPQHVEDASSEATIPKPFIVEEEAGETQVRQEATATPERSREIPEDPTTPVLTLNTSPPANPVLHLIDEEGVQTHDTQDQSHEF

SEQ ID NO: 114002 - protein, 176 aa, Glycine max
  Coding DNA Sequence Number=SeqID_22317
  Gene Ontology: Mol. function=aspartic-type endopeptidase activity; Biological process=proteolysis
  Homolog annotation: Hit_ID=A7PT07; Match level="QueryCoverage=90%, HitCoverage=9%, E-value=1e-39, Identity=46%"; Hit description =Chromosome chr8 scaffold_29, whole genome shotgun sequence
MTIVATAYQTFHECSEETIIDILIAGFSGQLKGWWDSYLTNDEKSKIYNIVKTDLNGKVITHDDNKEIPDAVNTLIFTIAQHFIGDPSLWKDRSVELLSNFKCRTLTDFRWYRDTFLTRVYTKEDSQQPFWKEKFITGLPRSLGDKKVTLKICQDDNSKAISQRKSPNKERSKIFL

SEQ ID NO: 114003 - protein, 157 aa, Glycine max
  Coding DNA Sequence Number=SeqID_22318
MLYLIVRILLPRSSNLAQVSEEDLIIMWVFLTGCQIDWAHLAAEDHSPSPPPQRDDSSSLMHNILDRLDGLHTFVSERFDSLDSRIDAIDARFAGMDTRITQLEEDMSFVCHHQKRGDCGSNAFYVYFDDAKDSSQESRVKQVSRIKEFFNQESRFK

SEQ ID NO: 114004 - protein, 94 aa, Glycine max
  Coding DNA Sequence Number=SeqID_22319
MTPVNRKAGTGERTRERQGETPGIFIVLSGFATTDLSVRFRDACQGGGAYGKTALPRPSHFPVKYLPGIFQEIFRPVRKPFPLAAVERPSVASQ

SEQ ID NO: 114005 - protein, 103 aa, Glycine max
  Coding DNA Sequence Number=SeqID_22320
MRIMKLAKYRLKALVEKDEGPSGEGQSPRVEKDEGPEAKTLSRLLITYQGNPCGVYPDLSSFTGSGVYPDLSSFIGSGVYPDLSSFTGSGVIQTFVACIKRSA

SEQ ID NO: 114006 - protein, 145 aa, Glycine max
  Coding DNA Sequence Number=SeqID_22321
MASRPSWLCRVWLICDDLAMGYYPDRMLRHFGYVQTIPLPVPQGSALGIPTEHNVIDRENFFNQVWERRFDYTIQNLMQGIWAVELHMIGPPLYLQPPDWTDRSTIRLNERRANEALAEVNTRNAAAFDYKKTLRARLMRRSSWS

SEQ ID NO: 114007 - protein, 366 aa, Glycine max
  Coding DNA Sequence Number=SeqID_22322
MAPRKLASKRSRKDKAAEGTSSAPEYDSHRFRSVIHQQRFEAIKGWSFLRERRVQLKDDEYTDFQEEIGRRRWAPLVTPMAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPCRSASWCMAPTRHPLDPDKSNRALGFPALITGLCQSFGVPVAPTKAAGAPPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 114008 - protein, 42 aa, Glycine max
  Coding DNA Sequence Number=SeqID_22323
MMQSSLGKGPVTRAISKRLQEDWTRAAKEGPRVLMNLKGSIM

SEQ ID NO: 114009 - protein, 86 aa, Glycine max
  Coding DNA Sequence Number=SeqID_22324
MTCDHSLVLVRCLAPIIRQFVKFQDMSKNQKILMHNPPIWALQKIPPEGGCFWRKQPCSPGRAGRQPPPLFAINRGGKQEGMGPAP

SEQ ID NO: 114010 - protein, 81 aa, Glycine max
  Coding DNA Sequence Number=SeqID_22325
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=A4QJB9; Match level="QueryCoverage=92%, HitCoverage=32%, E-value=2e-33, Identity=92%"; Hit description =Photosystem II G protein
  Pfam annotation: Domain name=Oxidored_q6; Domain location=1-70; Score= 72.8; E_value=1.2e-18; Accession=PF01058.13; Description=NADH ubiquinone oxidoreductase, 20 Kd sub
MAPSLVRLYEQMPEPKYVIAMGACTITGGMFSTDSYSTVRGVDKLIPVDVYLPGCPPKPEAIIDAITKRFGRIAKYSSRNI

SEQ ID NO: 114011 - protein, 122 aa, Glycine max
  Coding DNA Sequence Number=SeqID_22326
MTLLLSNIPSSDHKCRSPPAKVSVGLCHHEIGIAPTRHPVDPEEPNRALGFPALVTSLCQSYRVPVPPARSWHHEIGIAPERHPVDPEKSNRVLGFSALITSLCQFYGVLVTPSKVIRPPTN

SEQ ID NO: 114012 - protein, 97 aa, Glycine max
  Coding DNA Sequence Number=SeqID_22327
DRVQVGKRGCTSAGADCLTGTFGSSGCGVWTDPISESHNVLVGAQADVVDSAMDTSVRRTSLVVSIGGGLVLVVDIGEPGPSCTKPTTWEVRMGTSL

SEQ ID NO: 114013 - protein, 169 aa, Glycine max
  Coding DNA Sequence Number=SeqID_22328
IYHTEFDEFKAELERHNLDKRLTNLQDGSIDVAVVKEFYAKLYSPKDQSPKQVRGETLPTYSRFTRMRIDPQEFAARLCIPEGHPWKLLRKDLTTLAQTWNVLSYNNLTPTSHTSDLNIDRARLVYGLVTGMDMNIGALILGQISTIAQSNSSRLGFPALITTLCRAGG

SEQ ID NO: 114014 - protein, 73 aa, Glycine max
  Coding DNA Sequence Number=SeqID_22329
MKGIALKASSSIQKESDKEIDLDEDDDLSLFVKRFNKFRKSEEVKGDQILNLKEGQKSHLLLQNALNAINLDI

SEQ ID NO: 114015 - protein, 153 aa, Glycine max
  Coding DNA Sequence Number=SeqID_22330
  Homolog annotation: Hit_ID=Q6WAY6; Match level="QueryCoverage=73%, HitCoverage=18%, E-value=4e-14, Identity=37%"; Hit description =Putative uncharacterized protein
MAEVSTEAIASLAQYYDQPLRCQKSSIRIVCCTPALYVWLVSHLFRQEVRHACPLESHRSSTEKRGENWDRLLASKEGAFVNWFPRWKEGRTGILISCGGFPNVPLMGTRGCISYNPILVIRQLGYLMRGAPLEEELTPTIAPGFNKTNMEAL

SEQ ID NO: 114016 - protein, 112 aa, Glycine max
  Coding DNA Sequence Number=SeqID_22331
  Homolog annotation: Hit_ID=A0ST23; Match level="QueryCoverage=22%, HitCoverage=51%, E-value=3e-07, Identity=100%"; Hit description =Putative reverse transcriptase
GKPVVPAALMNRPTRGERRFAYWALAECILAYYVGTDEGYIPLPRSLTRYARSFDCGERKWLTNGAEISWKDARKILNRETNKDTRRFPLAAPRALSVPAFRFTGVIPLVMA

SEQ ID NO: 114017 - protein, 149 aa, Glycine max
  Coding DNA Sequence Number=SeqID_22332
  Gene Ontology: Mol. function=aspartic-type endopeptidase activity; Biological process=DNA integration
  Homolog annotation: Hit_ID=A5AL21; Match level="QueryCoverage=93%, HitCoverage=15%, E-value=2e-17, Identity=31%"; Hit description =Putative uncharacterized protein
SRSLDIEIEMASSNGNFPASMPVLKGKNYDDWNPTDAQKVAHRDLMKRDAKALFIIQQCVDADNFQKIRSADTAKKAWDTLEKSCAGDSKLKKQSDLGIIDKVLRTLTPRFDHIVVAIEQGQNLEEMKIEELQGILEAQEMRLNERNSQ

SEQ ID NO: 114018 - protein, 52 aa, Glycine max
  Coding DNA Sequence Number=SeqID_22333
VEDYQPMIPYYSQNIEPRPHTRTQNTEEDGKLTRGTHTRKNSPKGLSVINFL

SEQ ID NO: 114019 - protein, 228 aa, Glycine max
  Coding DNA Sequence Number=SeqID_22334
MAKFDPNIVLEFYANAWPTEEGVRDMRCYRPAPGYPLVLEEGQECEYGQRRNRSDGFDEEAIAHLLCIPGQDFARTAAGRRVRIMRTNMTTLTQIWMTLLLSSIQPSDHNSDLPLPKCQLVYAILTRMSIHVAQLIVDAIYIFAGMAPTKHPLDPDKSNRALGFPALITGLCQSFGVPVAPSKVIRPPITRAFIKKYCTQRQVQGDAPQAADAPPPHQAGPAGSFDTE

SEQ ID NO: 114020 - protein, 212 aa, Glycine max
  Coding DNA Sequence Number=SeqID_22335
MAPRKLASKRSRKDKTAEGTSSAPEYDSHRFRSAEHQQRFEAIKGWSFLQERRVQLRDDEYTDFQEEIVRRRWASLVTPMAKFDPYIVLEFYANAWPTEEGVRDMRSWVKGQWIPFDADAIGQLLGYPLVLEEGQECEYGQRRNRSDGFDEEAIAQLLCIPGQDFARTAAGRRVRIMCTNMTTLTQIWMTLLLSSIQPSDHNSDLPLPKYQL

SEQ ID NO: 114021 - protein, 140 aa, Glycine max
  Coding DNA Sequence Number=SeqID_22336
MASGNRLPRVGLKTRSGSYEGFWQQVVEASGNRLPVCVIDYTEEWVTEGAWETLEGNTRCRFRGTIRFTATSLVHPDEPARTLQHTMEWILPTPTPYRLVEPIQVIEYVSEKTLRDLEEPPPEPAVDALDFLEGDEDPFL

SEQ ID NO: 114022 - protein, 177 aa, Glycine max
  Coding DNA Sequence Number=SeqID_22337
  Gene Ontology: Mol. function=peptidase activity; Biological process =proteolysis
  Homolog annotation: Hit_ID=A3XGL4; Match level="QueryCoverage=60%, HitCoverage=23%, E-value=8e-16, Identity=43%"; Hit description =Peptidase, M28D family protein
MAPQRRRLIFDWKNYFLPYGVYDFDQTYAIQDISPLKKLDIPLAELVVDTQRYFDYHHSSEDTFDKAQGDSIQFSKISTEILNNGKGYEELRDLTQNIGNRLSGSEAYEKSVQWAAKELRNAGADKVWLQEVMIPVWKRGKESLYIKAGSGKPQASNAFFGNSEGTEGKDVSGEIVM

SEQ ID NO: 114023 - protein, 75 aa, Glycine max
  Coding DNA Sequence Number=SeqID_22338
MGGKEGGGCHPAHPGELGCFHQRAPPFVGTPWKAQVGLRHLFSFRNVAKLYGLRNNALFDFWNVVELYGLPNDGC

SEQ ID NO: 114024 - protein, 51 aa, Glycine max
  Coding DNA Sequence Number=SeqID_22339
SGIDDGEAAEEEEEAAEEEEEAAEEEEEAAEEEEDAAEDTESDDDDSDATP

SEQ ID NO: 114025 - protein, 121 aa, Glycine max
  Coding DNA Sequence Number=SeqID_22340
MSNLTGKRMVCPNNKTPPTDTMQNAFLYVNDSHSSTNSNVCILFQAIYQYAESPHFLADSHLKDGHYFSQWVMSHHRPAWISPKLRIFLLPTRSYQLIVMGAGISVTILTIITLIICQCIN

SEQ ID NO: 114026 - protein, 211 aa, Glycine max
  Coding DNA Sequence Number=SeqID_22341
MGKAEEVQEQMKADMKAMKEQMATMMKAMMSMKKIMEANAVAVAATSAVAKVNPMPPSDLNQMNHPTSDMVDKDLGSMDGPLLCANSKQARLSAICLPPNYTPPNVAYTPNENVNNSTPIPIESRQPHRVHVSQPMGETHEIPNHNLADFEPCLGYATEGQVVGGIPLQNTLEGPQYHPQPHPLHSTAGKNPHAMAEMGEVGSSRGKAHGR

SEQ ID NO: 114027 - protein, 73 aa, Glycine max
  Coding DNA Sequence Number=SeqID_22342
MKNGGKPSRNRPRKRLGSVTEAPRLGFSSWKQFFSLISSESQIPGGLNGKKGRWLPPSSPGQARLLPPEGTAF

SEQ ID NO: 114028 - protein, 123 aa, Glycine max
  Coding DNA Sequence Number=SeqID_22343
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSRVGSSEEPSKNRPAS

SEQ ID NO: 114029 - protein, 161 aa, Glycine max
  Coding DNA Sequence Number=SeqID_22344
  Gene Ontology: Mol. function=structural constituent of ribosome; Cellular component=ribonucleoprotein complex; Biological process =translation
  Homolog annotation: Hit_ID=Q2PMT2; Match level="QueryCoverage=100%, HitCoverage=87%, E-value=9e-74, Identity=73%"; Hit description =Chloroplast 30S ribosomal protein S2
  Pfam annotation: Domain name=Ribosomal_S2; Domain location=2-154; Score=195.1; E_value=1.7e-55; Accession=PF00318.11; Description =Ribosomal protein S2
MSPLYICKAVRGIHIPNLIRTARFLSEACDLVFDAAKTRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 114030 - protein, 68 aa, Glycine max
  Coding DNA Sequence Number=SeqID_22345
  Homolog annotation: Hit_ID=A8GG79; Match level="QueryCoverage=73%, HitCoverage=13%, E-value=7e-12, Identity=68%"; Hit description=ADP -ribosyl-(Dinitrogen reductase) hydrolase
MPVSTKVSSENKFVQADDADSVAATAGQIAGALYGYSEIPHEWLDKLAQRKKLELMAEKLFLMGCENA

SEQ ID NO: 114031 - protein, 68 aa, Glycine max
  Coding DNA Sequence Number=SeqID_22346
MSCSTLQDASSSGIQGGGSNECDASASDMDVNGQTIHQVPMKITSRLPSSFVSGLRNDLAQGSASYGY

SEQ ID NO: 114032 - protein, 75 aa, Glycine max
  Coding DNA Sequence Number=SeqID_22347
  Subcellular localization annotation: CTP_CleavageSite=30; ConfidenceScore=5.25e-01
MTTQNALKYKVKMRWAKCASIAKHNFSALSATEESGRASSSRLCAKREISALSTAVVFSLAQCTTGAKLKSTYSH

SEQ ID NO: 114033 - protein, 173 aa, Glycine max
  Coding DNA Sequence Number=SeqID_22348
  Subcellular localization annotation: CTP_CleavageSite=48; ConfidenceScore=5.23e-01
MKGRRHKYGFNNNKREKAEKIMGSPPASPPPPPLPSPSDASASPSAVKQTRKASRLRSLSTRPPSAERLEVYVDLATGKTDGPYRKKLRTYLGIVAHDKVDITYENWKEVPTAQKDLIWEDIQEEFDIPEASDTDQDGVEDTVCEKYGISKEKWAQFCQTRRDPSWEDVRKKA

SEQ ID NO: 114034 - protein, 216 aa, Glycine max
  Coding DNA Sequence Number=SeqID_22349
MAKFDPKIVLEFYANAWPTEEGVRDMWSWVRGQWIPFDIDALSQFLGDPLVLEEGQDCEFSQRRNRADGFDEEAIAQLLCTPGQDFARTTAGRRAFIEKYCTPRQAQGDTPQAAYAPLPPHQADPARSLGMERYLQHLVQIHECLYQLSLSQQAQGFAPFTCPTPEQFRAEVGWPGDWPEAHTGETPARSPADAEVAHMDEEITDLLGFLGASGAT

SEQ ID NO: 114035 - protein, 88 aa, Glycine max
  Coding DNA Sequence Number=SeqID_22350
MKGRVNLGLESENRCYEWKKSEALRVGRPNLNLVVFGGLMRKFGLCKREKQMTKVKARAISRDSIWAKLDEGKCDFENLHFMQNFAVK

SEQ ID NO: 114036 - protein, 44 aa, Glycine max
  Coding DNA Sequence Number=SeqID_22351
MKSSDMQGYHMVTRTFGQPGANEPVGARRLASSSTPFGVLTREV

SEQ ID NO: 114037 - protein, 120 aa, Glycine max
  Coding DNA Sequence Number=SeqID_22352
  Subcellular localization annotation: CTP_CleavageSite=66; ConfidenceScore=5.27e-01
MRSDCLVQLLHSQYFRSPKNCVFIHVSSTFEFGAMRSDCLVQFSILKSFQSPMNCVFVHVSSTFVFGAMRSDCLEPFSILTLFRSPMNCIFVHVSSTFEFGAMRSDCLVHLSILNIFGAP

SEQ ID NO: 114038 - protein, 136 aa, Glycine max
  Coding DNA Sequence Number=SeqID_22353
GCHHQKRGDCRSKLHDDESSSFDDDKKPKRMISRLSQQIQRTNRLRILCLNTLEGTSFVVQVEGTSTWVVVTENKRGYISCGSVQVEGTSTRLFKEKKGGYIPCGSLLVKYFTRLKEISRTGGFLGTGCRHGLLPN

SEQ ID NO: 114039 - protein, 57 aa, Glycine max
  Coding DNA Sequence Number=SeqID_22354
MPWKEKLHHQESALDKKLREEHMGNFLEKLEGSFLGKLEEESFLEKLEGGYSHPSNS

SEQ ID NO: 114040 - protein, 193 aa, Glycine max
  Coding DNA Sequence Number=SeqID_22355
MIDAASGGALGDMTPAEARNLIEKMTSNSQQFSARNDAIVIRGVHEVATNSSSSVETKKLEGKLDALVNLVNQLALESEICTYRKSLCNLEQLSSLKLMLQTFTIDLLILSSKINHSRTIMTSLATNAISDGGITLISYGLALNNSNNNLLLPSKMLLVQAGHTFLLQCNNNNSNNSNNNRDNNQLRPLLNLP

SEQ ID NO: 114041 - protein, 179 aa, Glycine max
  Coding DNA Sequence Number=SeqID_22356
MVLDEGKNFSKNTLLRSSQLKIDLGARWQAEIPEWLSVQRQLMLILTHEVRWQAEIPQLVIHTNTLLLILTHEVRWQAEIPQVVIRTHTVLLPRPVRSQVACRDALYGNPHTFQRKKCLQSLHAFKGDNVLTHFEDKNVFSHCMPSKGDNDPHLHFEDKNVFSHCMPSKAIMSSSTFRR

SEQ ID NO: 114042 - protein, 55 aa, Glycine max
  Coding DNA Sequence Number=SeqID_22357
CILSEDIILTLPNEGTHHVSFQEVLGEGLEVYSGALQAFVEKQTNACTHIPVKVE

SEQ ID NO: 114043 - protein, 48 aa, Glycine max
  Coding DNA Sequence Number=SeqID_22358
EEDGEAAEVEEEAAEEEEEAAEEEEEAAEEEEDAAEETESDDDSEATP

SEQ ID NO: 114044 - protein, 50 aa, Glycine max
  Coding DNA Sequence Number=SeqID_22359
MKKIHGLKVPHGATSCGNWKGGLVPSLEEFESRSEGPTTLRAIGLISTPS

SEQ ID NO: 114045 - protein, 98 aa, Glycine max
  Coding DNA Sequence Number=SeqID_22360
  Subcellular localization annotation: CTP_CleavageSite=17; ConfidenceScore=5.24e-01
LARLGKLSSPGRATPVRKYERGGGGTFSSPKTLPPHFKNSQAHGNYKNSSPQASVVEFCLSFHALIHSPQGIRNGCPSAIPSLEIPALSFNARQHTYD

SEQ ID NO: 114046 - protein, 35 aa, Glycine max
  Coding DNA Sequence Number=SeqID_22361
MFLHGKMPRKWVFRPYLTSTSQTPLIWLHNVGRVP

SEQ ID NO: 114047 - protein, 44 aa, Glycine max
  Coding DNA Sequence Number=SeqID_22362
MTEARQKGGTEREELATQLAQASKVASSRSNRLLEEETGRPKWA

SEQ ID NO: 114048 - protein, 66 aa, Glycine max
  Coding DNA Sequence Number=SeqID_22363
MGGCVILLQSWAWYHMPFIAPRVPRPETTFPLAKRWSGGRLEYRATPHGDLVGYRSRIDHMESHEV

SEQ ID NO: 114049 - protein, 428 aa, Glycine max
  Coding DNA Sequence Number=SeqID_22364
  Gene Ontology: Mol. function=oxidoreductase activity; Cellular component=membrane; Biological process=electron transport
  Homolog annotation: Hit_ID=A0JKZ4; Match level="QueryCoverage=90%, HitCoverage=47%, E-value=1e-178, Identity=83%"; Hit description=CoxL
  Pfam annotation: Domain name=Ald_Xan_dh_C; Domain location=103-189; Score=-36.3; E_value=0.046; Accession=PF01315.13; Description =Aldehyde oxidase and xanthine dehydrogenase, ab hammerhead domain
  Subcellular localization annotation: CTP_CleavageSite=43; ConfidenceScore=5.20e-01
GPTIASATLQVTSVPLRQPTAQVRHLLTALPAKAFELPAEQLTAAAGQVFVTRSPGRSLSYAQLASGQNLHVMLDKNVQLNSERQNHYVGRAVPRVDIPAKVSGGLTYVHDLRLPGMLHGRVVRPPYVGADSSAPLGGGLLSVDESSIAHLPGIVKLVVINDFIGIVAEREEQAIAAMRQLKTEWKPWAGLPDLSPEALPAALEANPKTDRVLRDDAGTDAALAALHTAVQADYVWPYHQHASIGPSCAVAEVKDGRAQVWSGTQNPHDLRKDIARLLELPPGQVHITRMEASGCYGRNCADDVSADAALLARATGRPVRVQLMREQESGWEPKGTGQLIRVRGGLDAQNRVAAYELKTSYPSNNAVTLPLVLTGKVAHRADVQQMPPSHRHSAIRVSAHAGDLPGRRADRAGFVDARRFGAAQRVRP

SEQ ID NO: 114050 - protein, 120 aa, Glycine max
  Coding DNA Sequence Number=SeqID_22365
MTKLGLCLSSGPPPLDDKRVRITVRYLRVSSGPPPLDDTRVRITVRMTKLGLCLSSGPPPLDDKRVRITVRMTKLGLCLSSGPPPLDDKRVRITIRYLRVSWMQNDQTWSLLVIGPAASG

SEQ ID NO: 114051 - protein, 56 aa, Glycine max
  Coding DNA Sequence Number=SeqID_22366
MAFTLIQGRTKPKEFWGMHLQNPRKIREITYCLSSSESEDEVRGEESSEEVYPHEE

SEQ ID NO: 114052 - protein, 210 aa, Glycine max
  Coding DNA Sequence Number=SeqID_22367
  Gene Ontology: Mol. function=methyltransferase activity; Biological process=metabolic process
  Homolog annotation: Hit_ID=A0Y156; Match level="QueryCoverage=62%, HitCoverage=55%, E-value=3e-11, Identity=32%"; Hit description =Membrane-associated protein
  Pfam annotation: Domain name=Methyltransf_11; Domain location=64-159; Score=73.6; E_value=6.5e-19; Accession=PF08241.3; Description =Methyltransferase domain
  Pfam annotation: Domain name=Methyltransf_12; Domain location=64-157; Score=54.1; E_value=4.9e-13; Accession=PF08242.3; Description =Methyltransferase domain
  Pfam annotation: Domain name=NodS; Domain location=16-199; Score= -66.6; E_value=0.00039; Accession=PF05401.2; Description=Nodulation protein S (NodS)
  Pfam annotation: Domain name=Ubie_methyltran; Domain location=35-210; Score=-146.9; E_value=0.075; Accession=PF01209.9; Description =ubiECOQ5 methyltransferase family
  Pfam module annotation: Pfam domain module=Methyltransf _11::Methyltransf_12::NodS::Ubie_methyltran; Domain location=64 -159::64-157::16-199::35-210
MNWKDEARQFFSHRAKVVGERPALHDLCYVSGRDPRVWADQSRYDDMMDSIVRTIGANASSRVLEVGCAAGFIACGVAPKIGQYVGVDVAEGAIECASSLNLPNATFRVGDGGALPFDSGAFDSVYCYDVLTNFPTFDSVKGVVQDMVRVVRPGGKVLLGSIPDASNVDAFLDAVARFQAELAQQAPATEPAVTPVSSAAKPAAPTLWTK

SEQ ID NO: 114053 - protein, 19 aa, Glycine max
  Coding DNA Sequence Number=SeqID_22368
MKKAPLSNSDLTMGNREVM

SEQ ID NO: 114054 - protein, 139 aa, Glycine max
  Coding DNA Sequence Number=SeqID_22369
MPISPCGSISWSVSFRHRDHIHKTPSGPEEVRQGPGVSSSGYGPLSALQGARFPPASSCRRGIGKDCARKTPSGPEEGQQGLGVASSKYRSLSVLGSACRPQQGHQAPLPIELSSRNTAPPGRRRAKHHVSIGMAGSGQ

SEQ ID NO: 114055 - protein, 234 aa, Glycine max
  Coding DNA Sequence Number=SeqID_22370
  Gene Ontology: Mol. function=catalytic activity
  Homolog annotation: Hit_ID=A7MJL0; Match level="QueryCoverage=97%, HitCoverage=97%, E-value=1e-93, Identity=73%"; Hit description =Putative uncharacterized protein
  Pfam annotation: Domain name=HD; Domain location=26-132; Score=61.2; E_value=3.6e-15; Accession=PF01966.13; Description=HD domain
MSLTHWQHRYESWLQLNWLHDDKAHDIAHLRRVWMSAARIMQNTNADPLVVLTACYFHDVVNLPKNHPERHLASTYAAEETRRILQQDFPDFPSALLDSVAHAVQAHSFSARITPKTLEAKIVQDADRLESLGAIGLARVFYTAGALGRPLFDSDDPLGKDRELDDVKWTLDHFQKKLLSLPQTMQTETGRLLAEHNADFLVRYMAKLCAELQGNLTDIDESVLRDFSPIPAQY

SEQ ID NO: 114056 - protein, 58 aa, Glycine max
  Coding DNA Sequence Number=SeqID_22371
  Subcellular localization annotation: CTP_CleavageSite=38; ConfidenceScore=5.12e-01
MDSGRFQVSVLGNSYPIPLYLSKSGTLNLGGVTILGTRNNSFSKGIIFTSFNGPEPFL

SEQ ID NO: 114057 - protein, 165 aa, Glycine max
  Coding DNA Sequence Number=SeqID_22372
METCLEVEELLQRMIDQGRLEVGIKGKEEQHICMQSTEGSGVAKPKPLVIYFTKSAASQKPGHPLMAKPVPFPYQNSHAVPWRYTSPGKKEEEVTDVSTLSAKVTNITGLSGVTRSGRVFAPPDLPVQPADVKGKGKVVEEQDGEAPHASSKDMPAKGPPREKGW

SEQ ID NO: 114058 - protein, 145 aa, Glycine max
  Coding DNA Sequence Number=SeqID_22373
MDGILISSVVLLADSRFTRPDMGFHPTKLNFVPSDADEAPLDVSICLHAFGIVGCGSFSGVKSCEREVPTIGSCVAYLPNGIRVASQTHSIQGLFVGDAGGFQSPTREPLNVGGLVPPHCSLKSVVSDDACPGACFVQRDATTLS

SEQ ID NO: 114059 - protein, 82 aa, Glycine max
  Coding DNA Sequence Number=SeqID_22374
MEQYLWHLVRQQAANHRAHSQGFASFSCPTPDQFRAEVAWPGDWPEAQAGEAPPEAPGDGEEAHEDEEMADLLDFLGGSGDT

SEQ ID NO: 114060 - protein, 179 aa, Glycine max
  Coding DNA Sequence Number=SeqID_22375
MVATDVRKECAGLREENAVTTKALEQETKRARKKEHGRDKFRGALWGSNSELKLRREERDRSRAHSMVLKEELAACSRVVDEYAQVYAEKEARGRVIDSLHQEATMWMDRFSLTLNGSQELPRLLAKAKAMADTYSALEEIHGLLDYCQHMIDLMAHIIRTARGTCIVTQILTSYKLFE

SEQ ID NO: 114061 - protein, 185 aa, Glycine max
  Coding DNA Sequence Number=SeqID_22376
  Gene Ontology: Mol. function=structural constituent of ribosome; Cellular component=ribonucleoprotein complex; Biological process =translation
  Homolog annotation: Hit_ID=Q95747; Match level="QueryCoverage=70%, HitCoverage=72%, E-value=1e-59, Identity=83%"; Hit description =Mitochondrial 60S ribosomal protein L16
  Pfam annotation: Domain name=Ribosomal_L16; Domain location=47-183; Score=175.7; E_value=1.2e-49; Accession=PF00252.9; Description =Ribosomal protein L16
  Pfam annotation: Domain name=Ribosomal_S3_C; Domain location=1-58; Score=45.5; E_value=1.8e-10; Accession=PF00189.11; Description =Ribosomal protein S3, C-terminal domain
  Pfam module annotation: Pfam domain module=Ribosomal_L16::Ribosomal _S3_C; Domain location=47-183::1-58
MKKGVEGIRICCSGRSEGAEIARTECGKYGKTSRNVFNQKIDYASAEVSTRYGISGRCSRGCKPDGTKLGFGRYGTQSCRAGRLSYRAIEAARRAIIGHFHRAMSGQFRKNGKIWVRVFADIPITGKPTEVRMGRGKGNPTGWIARVSTGQVLFEMDGVSLSNARQAATLAAHKPCSSTKFVQWS

SEQ ID NO: 114062 - protein, 730 aa, Glycine max
  Coding DNA Sequence Number=SeqID_22377
  Gene Ontology: Mol. function=histone-lysine N-methyltransferase activity; Cellular component=nucleus; Biological process=DNA mediated transformation
  Homolog annotation: Hit_ID=A7QEQ4; Match level="QueryCoverage=22%, HitCoverage=15%, E-value=3e-61, Identity=69%"; Hit description =Chromosome chr16 scaffold_86, whole genome shotgun sequence
  Pfam annotation: Domain name=PHD; Domain location=48-96; Score=-4.0; E_value=0.039; Accession=PF00628.20; Description=PHD-finger
MLQVAEFHANAVVSVKPKKPSFKERKQKLLTFLQEKYEPVCAKWTTERCAELEFIGLKILELIKVARCQIAVHQECYGARNVQDFTSWVCKACETPDIKQECCLCPVKGGALKPTDVDTLWVHVTCAWFRPEVSFASDEKMEPALGILSIPLNSFVKIEPVIKSHRLQRFVTNPQILLCFLSEDDCEAGIENPAFEVWEQQDQVLLTWLQSKLSTSILSRKSMREFLSQIQATSNSFALAGNDRDAGIENPAFEVWEQQDQVLLTWLQSKLSTSILSRVLGCAHSYEIQATSNSLALVGSLIMLQEHVDSILEGLLSDYHPIIVIIESNFEPQPIEQVGVLLLAHEARLNKILKASLTFVVDLVTAAVSMVVSTTAVVGASGGGGCGHGGGRGGGRFSNFQCQNYGPQNQYNATSGQSNPNSNSRQQYGDYHPSNEILRTFSSLNPLKDLTKSSLGNGQGLPISSSGLAKGNVGPDDLYNFSNIQLQHPLSTSVLACVSNPEKCCDFMPYDNHKFESSAPSGQSTSSSTQYYFPPIPISQPSNLPQPTQTQFPSVAGFPTHYLTVQSDSASVQSSHAARTEQSNAVASIPASNTAQPFHAEPTEQPHLSATSSEATPSTINPTSPNGDSGLKEVVMWEGNSKGAGEGVKMGLNQNAGEERTVRWEMQPAINSAGGLLCIWSDETFKMEKKVKGNGFIYLEGTWAGDVGKGGGSQKEFNDWITDLKVEDVP

SEQ ID NO: 114063 - protein, 312 aa, Glycine max
  Coding DNA Sequence Number=SeqID_22378
MDDDIPGATFCDDFSDGVSDDVLGGYSEHRDVLPSPNVRSDHWVQSLGRNCRDRSATFSDDVAQSQKDNVESQQCIGVEVAQENFNGQVPQNGLALNACDERPLQGSKLMEKAPITDSHADEGNSASQQQFEYHEPQQAPSGQHDLKVASEKMGQRISGPTLSATKVYVRRKEVLRSNSKAQQVEEPTGDFTSASKTDSMPSLQEDSIELQCALLKEMGLTYGEDANKDLTAQWDCVPSVQAAGGQLCMWNNSTFEVDRREKGRSFLLLEGRCISNNQRMMIVNVYAPCDLVGKKALWEDLRQLKASNPSGL

SEQ ID NO: 114064 - protein, 111 aa, Glycine max
  Coding DNA Sequence Number=SeqID_22379
MIRCRATLPTADVPESFNRDNENKLGSGTQVLVLLKPVTLRHRVHPASDTAYSSNRVLLGLLNVQVALRALQVWFSKVAIRGSTSTIRRERSEPTTNIGVERSSDSIGQVS

SEQ ID NO: 114065 - protein, 106 aa, Glycine max
  Coding DNA Sequence Number=SeqID_22380
MTDSLDESISCFLIRMDPRVLVPWSSEDYTPRQQRAARPHLKRTVCPHFQRTACPHLQRATRPRHQRTACPHLQRGYTPSPSEDCMSSPSEGYTPSPSEDCMSSPS

SEQ ID NO: 114066 - protein, 106 aa, Glycine max
  Coding DNA Sequence Number=SeqID_22381
AWNETNAAITAECAPQPETQEQESARGSPQGETPGIFIVLSGFATTDLSVRFRDACQGGGAYGKTALPRPSHFPVKYLPGIFQEISRPVRKPFPLAAVERPSVASQ

SEQ ID NO: 114067 - protein, 52 aa, Glycine max
  Coding DNA Sequence Number=SeqID_22382
MTFCYVTQAVLELLGSHLSLSECWKDGKGEFTAMLVELMIKLIDTVDLEGGP

SEQ ID NO: 114068 - protein, 142 aa, Glycine max
  Coding DNA Sequence Number=SeqID_22383
MDNKEGVQEQMKADMSALKDQMASITEAMLKIQKSIEDNATAVASNTAREAELVLQPAMNLGRDRSATGFNRRYSPQAYPYGLPTDFTSHTAPDDLSQAPTFEGQLPPHADYPLQEDDEGDAHLGPLLPPKEPPPMSFPKQT

SEQ ID NO: 114069 - protein, 402 aa, Glycine max
  Coding DNA Sequence Number=SeqID_22384
  Homolog annotation: Hit_ID=Q6WAY6; Match level="QueryCoverage=67%, HitCoverage=61%, E-value=2e-14, Identity=32%"; Hit description =Putative uncharacterized protein
FYQVKVKSLDTTSIKELGRLMEPLQMQAFRKTYGKILELTIAEVSIEAIASLTQYYDQPLRCFTFGDFQLVPTIEEFEEILGCPLGGRKPYLSSGCLPSLSRIAIVVKDSARGLDRIKQTRNGIAGLPREYLEDKARDLAAIDAFLAYHHSMESPVRRIDWDQLLAGIGGRTISWFPRWKEGKEGVLFSCGGYPNIPLVGTRGCINYNPTLAIRQLGYPMRGAPTEESMSPFLVRDLGAQNSKTIQRIHKAWETPLRKDQELRGIRNGIIGGYHEWLKVRIRGLDWLAKLKVVSEENFETPEEDEEVQALKSELGKAKLAKEKFKLAATHVRKECAGLREENAITARALERETKRARKEEYGRNKFRGALWGSNGELKLRREERDQSRAHSMVLKEELIACS

SEQ ID NO: 114070 - protein, 521 aa, Glycine max
  Coding DNA Sequence Number=SeqID_22385
RIANGLVGFKAHQPGDGQSDFACHPAVFHHDKTALDFAQPVSGQRHVVFAHPDNADIMAVMADGGGDGALFQAETLNETIGMVAVLAVAFDDGDLDDIVFEIDGGLVAVRRQSVATVLGNDLAGKHAHDRAFAFRDRHAKMRGEHGSRLDAVETDRCDRFARGKERIVDDPAAGKNHAGFAAFQAVDHHEIGAPARRDQAAIAQAKGFGGGNRGGAIDGERFHAAGDRGADHVVEMALFGDVEGVAVIGAERQIGRQPLGYDGHQGMQVFRDRAFAHQNVHALADFLQRFRCTRAFMLGADAGSEITVQRCSGKKRCVPVDMLTLKSLQLRHAHRVLVDDTGEIHEFSKADDLRVVPERQQLFNRQVGASGFQVSGGHAGGKLHADVHDGFHGAVEEELKPLHPEHIGNFMRIANGGGDAIRQNAAIELMRCHQRRFDMEMRIDETGDDDFAGNIDFPVTLIAFTGSHDRIATNGDIRGNEFSGDEIEEAAVLENHVCRFTARTLVDALFKSGIHAAFFGS

SEQ ID NO: 114071 - protein, 124 aa, Glycine max
  Coding DNA Sequence Number=SeqID_22386
  Gene Ontology: Mol. function=nucleic acid binding
  Homolog annotation: Hit_ID=A5BSC1; Match level="QueryCoverage=60%, HitCoverage=4%, E-value=5e-13, Identity=36%"; Hit description =Putative uncharacterized protein
MEKSDKKTFKDKKGKKAYITWEDNDIDSSSDSENEIINLSLMAKDYESKEEDSLKQNWYIDSGCSKHMTGDASKFTHISHKNSGHVTYGDNNKGHRTNNVYMIYLDKAPNQAQCFLSKEDESWL

SEQ ID NO: 114072 - protein, 70 aa, Glycine max
  Coding DNA Sequence Number=SeqID_22387
MAKEHQHRITLEDYSSSSVPQFFTREAKKWLHSFKGNTLKTWEEVVEKFLKKYFPESKTTEGKVVISSFH

SEQ ID NO: 114073 - protein, 149 aa, Glycine max
  Coding DNA Sequence Number=SeqID_22388
MPCQHAIATISHKGGKPEDMCHDWLSIEAYNKTYHHFIQPDDDLLAQDKQALNEAEEAAAHVQEGPVEINLSQPNLSQDSDMEFMVPASIVDVPPVARYKLNITRPKQKNISHTSTVDAPVVDGPPTTPLFYMPTPRFTGRKAADKDPV

SEQ ID NO: 114074 - protein, 233 aa, Glycine max
  Coding DNA Sequence Number=SeqID_22389
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRCLWARAWAIAQGSRALKPPMSIAFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114075 - protein, 84 aa, Glycine max
  Coding DNA Sequence Number=SeqID_22390
MGEAEKVQEKMKAENGGHKRANGHNDEGHDEHEEDNGSQCGQAVGGIPFENTLEALSFAHNHNHCIFAVGRAPPAMAEKGKRII

SEQ ID NO: 114076 - protein, 225 aa, Glycine max
  Coding DNA Sequence Number=SeqID_22391
MTTLTQIWMTLLLSNIQPSNHNSDLPLPKCQLVYAILTRMSIQVAQLIADAIYIFAGMAPTRHPLDPDKSNRALGFPALITGLCQSFGVPVVPSKVIRPPITRAFIEKYCVQRQAQGDAPQAVDTPPPHQAGPAESFDTEQYLRHLVRQQGGQPPGSSCRARVFTSFPCPTSDQFRAEVAWPGDWPEARAGEAEAPAEAPDEADEAREDDEMTDLLNFLGGSGPT

SEQ ID NO: 114077 - protein, 213 aa, Glycine max
  Coding DNA Sequence Number=SeqID_22392
  Homolog annotation: Hit_ID=A3XNV7; Match level="QueryCoverage=93%, HitCoverage=91%, E-value=4e-13, Identity=28%"; Hit description =Putative uncharacterized protein
MACMGIIMHAQTGNVGIKTTTPTETLDVNGDSFTNSLYIRNPGEPTTTGGHFLATSQNSLQIYDPNLESSGLFNYIKLTLTGVPGAGITDYDTKIDADNFLLVPHNYSFKLNDGTTSVALDYKDNGINDNAQGSPNVVAFKSNGTWHLKAGFTDSKLIAFTSANPSRTYNNFTVEFYLMVYKRLITKQNIGDINTDLGGTNGSAQTINKPSGF

SEQ ID NO: 114078 - protein, 175 aa, Glycine max
  Coding DNA Sequence Number=SeqID_22393
GGPLGTSTLTFRGLHVLAFRGLHALAFKGRHVLNFRGLHALAFRGLRVLTFSALHIHTLREFKFLGPPPDIGRWPTVRAQPEREAIAQLLCIPGARFHPCPLQRIAPTKTPSGPEKVKQGPGVFSSGYGPLSVLQGARIAPARHPVDPKKSNRVLELSSSNYGAKHHSSLGMVGS

SEQ ID NO: 114079 - protein, 269 aa, Glycine max
  Coding DNA Sequence Number=SeqID_22394
  Homolog annotation: Hit_ID=Q6WAY4; Match level="QueryCoverage=79%, HitCoverage=37%, E-value=2e-15, Identity=28%"; Hit description =Putative uncharacterized protein
MGLNQTPYFKKRFYHVKIKSLEVASLQELGQWMDQLQCKAFRKTYGKIWDLAMIEVSVEAIASLTQYYDQPLRCFTFGDFQLVPTVEEFEGILGCLLGGRKPYLFSGLYPSMARVAKVVKISAQELDRVKQNRNGVVGIPKKHLEEKAKALADQGEWTLFNDVLALLVFRVVLFLNVDGLVDLAAIDAFLAYHHSKESSAIAILVDAYDTFNRRCKKSSARIVCCTPALYVWLVSHIFRHESRPVCPLQGHRMCAEKGKENWEQLLVGM

SEQ ID NO: 114080 - protein, 165 aa, Glycine max
  Coding DNA Sequence Number=SeqID_22395
MPISPCKSIGWSVPSRHRGRAHKTPSGTEEIQHGPGVSSSSYGPLSVLQGARTPPARSCHRDIRIAPAGHPVDPKKSNRVLGFPALITGLCQLYGVPVTPSKVIKPPTNRAFIKKYCTPMQTEGETPQQLGDGQQQVTNAPPPPPEPLSSSTKRLEYCLRHMADQ

SEQ ID NO: 114081 - protein, 66 aa, Glycine max
  Coding DNA Sequence Number=SeqID_22396
  Subcellular localization annotation: CTP_CleavageSite=22; ConfidenceScore=5.70e-01
MASPPASHPPPSPPPPSNTSALSSAVKRTRKASRLRSLSTRPPGAERPVIHVDPDTGKADGPHRKK

SEQ ID NO: 114082 - protein, 204 aa, Glycine max
  Coding DNA Sequence Number=SeqID_22397
AFLETPVVLAEGETLPAYSRYWRLPTNFREIEAALCIPGRGFILNSEGHPGKILKKDLTTLAQVWSVLSYSNLAPTSHTSNLTVDRARLIFGLVSHLDMNIGALIFGQMTSIAQSNTSRLGFPALITTLFSIRGARRVRARPAELPSTSAAPTPASTLAAPSAPAQTNSQCFESMLKIIHQGQIILLQTFQITAPPDSIPSDEQ

SEQ ID NO: 114083 - protein, 169 aa, Glycine max
  Coding DNA Sequence Number=SeqID_22398
MEAIKEQMATMMEAMMSMKKIMEVNAATIAATSAVAEVDPIPPSVLNQINHPTLDMVGQGGKELGSAGGPHFVQVQKKHAFPPYGLPPNYTPPNVAHILDENVNNSTPILIESQQPQSDQAHVSQPMGETHEIPHHNLADFKPHLGYANEGQAGWWCTPAKHLSPMKIL

SEQ ID NO: 114084 - protein, 102 aa, Glycine max
  Coding DNA Sequence Number=SeqID_22399
MVTKRSGKQKGPEKKNGAGTSSEGLCGAAVTSSSLEGLRGRRIKDGKHGVKSSIGACRPCIFFINGVICFLKIMAAEWRRKKDDWIEMPLQEKDESRRSSPP

SEQ ID NO: 114085 - protein, 246 aa, Glycine max
  Coding DNA Sequence Number=SeqID_22400
MVMGGFHQQTLLPRKENTETFSSLTSYPELRRSEFLIGGYVGARASLLSTTPPFVAMTQELVARGDTLRLSAPRHSVIPSVIDEQRPIWSSAPFPEMSAFSDGDFSSLTSYQELRRSEFLIGGYVGARALLLSAAPIIFVILTLNWSLTCTLVSSRGGGPDDTRRYLTVIRTLFCHPEAAGPMTSRDQVWSFCTLVSSRGGGPDDTRRYLTVIRTLLSSRGGGPDDKQRPSLVILHPCIIQRRRAR

SEQ ID NO: 114086 - protein, 59 aa, Glycine max
  Coding DNA Sequence Number=SeqID_22401
MYPIEWYMKVLKGYTKNQYRPKVMQSYPARALDRRLEVDWAKDAREGPRVLMSLRGSIM

SEQ ID NO: 114087 - protein, 46 aa, Glycine max
  Coding DNA Sequence Number=SeqID_22402
QFRAEVAWPEAQAGEAPPEAPGDGEEAHEDEEMADLLDFLGGSGDT

SEQ ID NO: 114088 - protein, 48 aa, Glycine max
  Coding DNA Sequence Number=SeqID_22403
MELTILENDAILPRKGPITRTMSKRLQEDWARAAEEGPRVLMNLRVDF

SEQ ID NO: 114089 - protein, 166 aa, Glycine max
  Coding DNA Sequence Number=SeqID_22404
MASITEAMLKLQKTLEDNATATASNAVREAEPVLQPAINLGRDRNPTVFGRRYSPQAYPYGLPPDFTPRAAPEDVSQAPTFEGQLPPYADYPLQEDDEGDTHLGPLLHLKDPAPHELPQPNIVLHVPSSPAPVKESVPFAGDKGKIDSLEERLRAVEGLGNYPFSD

SEQ ID NO: 114090 - protein, 213 aa, Glycine max
  Coding DNA Sequence Number=SeqID_22405
ATCLTFRGLHVLTLEDYTSSPSEDYMFPIFKGGHALTFRGLHVLAIIGLHSLAFERRHVLSFRGLHALAFRGLRVLTFRTSSFLLTVPGPPPDIGGGPTVRAQLEREAIALLLCILRQDFTRAAAKRRGSHPQETPSGPGKVQQGPGVSSSGYGPLSVLQGARTPPRQGHIIIGIAPARHPVNPKKSNRVLELSSSNYGAKHHSNIGMAGSGQ

SEQ ID NO: 114091 - protein, 60 aa, Glycine max
  Coding DNA Sequence Number=SeqID_22406
MGAKHLTRTKERSHVIKQRSPDEIRLWHVPGVGGQHCPSLEKGRQGSNVCRLPGLEPRQS

SEQ ID NO: 114092 - protein, 212 aa, Glycine max
  Coding DNA Sequence Number=SeqID_22407
MWDATVFGVFNEDFPLYIKHEDLSEIAHGGQCLSISVIQLWTLHLIETSMQAGNFDVYGFIEPQSIQRSGQSQFESKSYMKNWMQNSKWNVYLGAYMNGLDNYVKGIINMSVLFFNAFALSLLSNINILMFLVFNNALKGLNDTPQPKSKAGARWILVKCNRQKGSTECDYYVMHWMSTIILGTFRNNWETTIGSTEIEGASHPMGTVLSQS

SEQ ID NO: 114093 - protein, 66 aa, Glycine max
  Coding DNA Sequence Number=SeqID_22408
MAKGAEDDVSLCASTILFAPGWRKVRVIIRTTEGAGDDVSLCASTSSFSPWLTKGAGNHKVTPHVT

SEQ ID NO: 114094 - protein, 113 aa, Glycine max
  Coding DNA Sequence Number=SeqID_22409
MAEPSKKRKGSSSRSQRHSKAQETEIPSSISSSSLFSSEEQRIRYTNLVSSCSIIDPKFIDMDFFSNENFECIQAFQNSNLIPFMSLKFPVYSELVKVFYSNLEIQESTLISE

SEQ ID NO: 114095 - protein, 65 aa, Glycine max
  Coding DNA Sequence Number=SeqID_22410
PSAPVVNLPSPQPAVDPSTPLLEMSEDPTTPVLAMDTSPPTNPVLQLSDEEDGQAQDTQDQSQEF

SEQ ID NO: 114096 - protein, 143 aa, Glycine max
  Coding DNA Sequence Number=SeqID_22411
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=71%, E-value=1e-24, Identity=69%"; Hit description=LacZ protein
MAHQNPPYLAFCTPGQNETSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114097 - protein, 105 aa, Glycine max
  Coding DNA Sequence Number=SeqID_22412
MHFSSLNSRQKSKITRYNIKNVSNDLGRDFQIETAKGLAKKFKLKCHFQEIYSLVIDYQRITSKRILQDSGTLKRVAWGVDQYKFEFAQGCGRTSINLSLQSFFP

SEQ ID NO: 114098 - protein, 34 aa, Glycine max
  Coding DNA Sequence Number=SeqID_22413
MAENLHEITHGNVLDALRKLLGVDFLHGNDFIHW

SEQ ID NO: 114099 - protein, 80 aa, Glycine max
  Coding DNA Sequence Number=SeqID_22414
MGAKYLELVKRGSHPNNGWSPKEIRTQNDHNLSLRVVGHDRAWVARHRMTIICLCMPPDTIASGWRKSVRNDPNLSPHTS

SEQ ID NO: 114100 - protein, 103 aa, Glycine max
  Coding DNA Sequence Number=SeqID_22415
  Gene Ontology: Mol. function=aspartic-type endopeptidase activity; Biological process=RNA-dependent DNA replication
  Homolog annotation: Hit_ID=Q6WAY3; Match level="QueryCoverage=97%, HitCoverage=6%, E-value=4e-13, Identity=31%"; Hit description =Gag/pol polyprotein
MGKLDHLEERLRAIEGGEDHAFANLEELFLVPDIITPPKFKVLDFDEYKGTTCPKNHLKMQYQYNFDMVPDRMRQQNMCKKGHISFKEYAQRWRDLAAQVAPQ

SEQ ID NO: 114101 - protein, 100 aa, Glycine max
  Coding DNA Sequence Number=SeqID_22416
MNEIEEVQEQMKADMEAILSMKKIMESNAAAVATTSAAIEVDPTHPLGLNHVNPLVSDMVGQGGEALGSTGSEEPRDHALSDFEPYLGHATEGGAFGGVP

SEQ ID NO: 114102 - protein, 153 aa, Glycine max
  Coding DNA Sequence Number=SeqID_22417
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=71%, E-value=1e-24, Identity=69%"; Hit description=LacZ protein
  Subcellular localization annotation: CTP_CleavageSite=47; ConfidenceScore=5.50e-01
MTMITPSSKLTLTKGNKSWYRAPPRGTPTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114103 - protein, 54 aa, Glycine max
  Coding DNA Sequence Number=SeqID_22418
MGHATLPPLSCELGVDMRPPSARDSIEDLKWVPKCNSSLEPKLLASMQGNMTYV

SEQ ID NO: 114104 - protein, 82 aa, Glycine max
  Coding DNA Sequence Number=SeqID_22419
MDLGARQYGIILDVYEGLHLQDHETWATRCSKLPTTKCSDSPITECSGCSKGSKDCKSPGLPQVMHYMQQFMCFSDRAKEVG

SEQ ID NO: 114105 - protein, 86 aa, Glycine max
  Coding DNA Sequence Number=SeqID_22420
MAQPPPRERILREMAAPDFTYESLCIQYPNEDVPYVLKTGLIHLLPKFHGLAGLSNMERSMIDTASGGALGDMTPAEARNLIEKMA

SEQ ID NO: 114106 - protein, 230 aa, Glycine max
  Coding DNA Sequence Number=SeqID_22421
  Homolog annotation: Hit_ID=UPI00006A2D9E; Match level="QueryCoverage =81%, HitCoverage=85%, E-value=2e-08, Identity=15%"; Hit description =UPI00006A2D9E related cluster
RAAHPHLEEDYKVLAKRRGYTPSPIEGLHVLDESISYFLIRRTLGYSTLVSRGLYVLTFRGLHVLALRGLHVLTIRGLHALTSRGLHVLALRGLHALTLEDYIVLTIRGLHALTSRGLHVLALRGLLALALGLHALTFRGPHVLTFRGLHALAIRGLHVLTFRGLHALAIRGLHVLTFVGLHALTFRGLHVLANRGLHALTLRGLHVLANVGLHALTFRGLHVLAFRGLH

SEQ ID NO: 114107 - protein, 103 aa, Glycine max
  Coding DNA Sequence Number=SeqID_22422
  Homolog annotation: Hit_ID=A5BF08; Match level="QueryCoverage=99%, HitCoverage=10%, E-value=9e-17, Identity=40%"; Hit description =Putative uncharacterized protein
MEYNIMNTLQHMIMVVTAYQTSHECLEETIIDILVAGFSGQLKVKTGINGKVLTNDEDKEIPDAVNTLIFPIAQHFIGDPSLWKYKSAELLSNLKCRTLADLR

SEQ ID NO: 114108 - protein, 133 aa, Glycine max
  Coding DNA Sequence Number=SeqID_22423
MVRQAWETVQKKDKELRGSSNGPIGGYHRWLKAYAQGLDWLPNLRTTKGVEVKTPEEDEEVQALKIELEKTQTVKQKFKSATVRIQKVNAELRDVNIATTKALEQETKRARREEHGWNKFRGALWGSNSELKL

SEQ ID NO: 114109 - protein, 57 aa, Glycine max
  Coding DNA Sequence Number=SeqID_22424
ERKILQCEGYFTYLRCDIKIPNGENAWKWVSNVLFKFHDDPTVNESEIVIFLRQGYS

SEQ ID NO: 114110 - protein, 185 aa, Glycine max
  Coding DNA Sequence Number=SeqID_22425
  Subcellular localization annotation: CTP_CleavageSite=21; ConfidenceScore=5.31e-01
YPHLQRTTCPRLQRATRPRLRRATRPHLPRTTCPHLQRATRPPVLVPSVEATLLTFREDYTSSPSEGCMPSPSRGLACPRLREGYTPSAWVLVTLTVEGLHVLALRGLHVLTFRGLHALAFRGLHVLTIRGLHALTSRGLHVLAFRGLHVLTFRRLHALAFRGLRVLTFSGLHIHTLKEFKVLCP

SEQ ID NO: 114111 - protein, 291 aa, Glycine max
  Coding DNA Sequence Number=SeqID_22426
  Gene Ontology: Mol. function=motor activity; Cellular component=cell projection
  Homolog annotation: Hit_ID=UPI00016621D1; Match level="QueryCoverage =94%, HitCoverage=40%, E-value=9e-21, Identity=34%"; Hit description =UPI00016621D1 related cluster
KRTTRLRLQRTTHLNFRGLHVLTFRGLHVLAFRELHVLVFRGQHALAFRGLHVLTLRRLHALTFKGLHVLTFRWLHARAFRGLYVLTFRGLHILAFRGLHTLALRGLHVLTFRKVHTLTGRGLRVLPFRWLHALTFRGLHVLAFRGLHVLTIRGLHALTFKRQHVLPFRRLHVVAFIGLHAFPFRGLHVLTFRRLHAHAFRGLHVLAFRGLHALAFRGLHVLPFRGLRALAFSGLHVLAIRGLRVLTIRGLHVLALRALHALTFRGLHVFAFRGLHILTFGGLHVLTIRGH

SEQ ID NO: 114112 - protein, 299 aa, Glycine max
  Coding DNA Sequence Number=SeqID_22427
MVLSLTSCQNETTEVLQENTAKKESVSDLKKVLTPSSQTLPDIVQTQLNDSKKNLEQYLKNDLQITGVSVLGKLSDANGISISQNLISDKNTYVAFGNITDPASVKIGKMTNFNSGDELSVAQQSLKDVISQEVKPNTEVLEITWNHKGEQFTSLCFYNTNGIIWDNVLGGLVMMDRGSNVEASNDNQAKVLSKWYKEWWTAKWLWGSKRGEIGYKITIYYNGSTVSNTDVSDWGNISLGKAKSESKILKRTGAYGQCRYALGLCTPTGSLSFNSSNFTVSFSGLGSNIVSNGTKSLYP

SEQ ID NO: 114113 - protein, 76 aa, Glycine max
  Coding DNA Sequence Number=SeqID_22428
MEVEEPWLGLWLPLNYRVDMGSSLAYDNGIWGFVVDLGMAFVDNWAVGKEKVCYWMSKDIVGLVGNLAVQEWQSQH

SEQ ID NO: 114114 - protein, 84 aa, Glycine max
  Coding DNA Sequence Number=SeqID_22429
  Homolog annotation: Hit_ID=UPI0000ECBAF8; Match level="QueryCoverage =51%, HitCoverage=50%, E-value=1e-17, Identity=100%"; Hit description= UPI0000ECBAF8 related cluster
MDTRLRVIGDPMNGVQRSGRHRGGAPIRPIVSRITIHWPSFYNVVTGKTLALPNLIALQHIPLSPAGVIAKRPAPIALPNSCAA

SEQ ID NO: 114115 - protein, 154 aa, Glycine max
  Coding DNA Sequence Number=SeqID_22430
  Homolog annotation: Hit_ID=Q6UUU1; Match level="QueryCoverage=38%, HitCoverage=40%, E-value=1e-18, Identity=78%"; Hit description =Putative uncharacterized protein
MNGIKMLYGNRIYCAAAYQNIPQGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114116 - protein, 110 aa, Glycine max
  Coding DNA Sequence Number=SeqID_22431
  Homolog annotation: Hit_ID=A0ST23; Match level="QueryCoverage=22%, HitCoverage=51%, E-value=3e-07, Identity=100%"; Hit description =Putative reverse transcriptase
  Subcellular localization annotation: CTP_CleavageSite=13; ConfidenceScore=5.19e-01
VDKSGALAPTYPPSKRKSDLRSSSLRLDFAGGARYQLLFPLVRVNFELGVIMVIAVSFGKPVVPAALMNRPTRGERRFAYWALAECILAYYVGTDEVSVKCFMCRRKRLH

SEQ ID NO: 114117 - protein, 139 aa, Glycine max
  Coding DNA Sequence Number=SeqID_22432
MKTRQQVSRSPCRAHATPHGDQPESQGSFKSSDMPLSTRISIMVTTSLMYIHNIHHHNDIFNINNISSQCHYQHQHHLVEAKIHGESKVIQRCFDYNNDDDKGDDKKAQRSIKNSSSESRTIQEFKIRIKKNSRLKKKV

SEQ ID NO: 114118 - protein, 63 aa, Glycine max
  Coding DNA Sequence Number=SeqID_22433
MCLQARAGRNTTAARGCPAAGNRRTPITSRVHLCSSTKRFEYCVHHMADQQATKSKDKGRKIP

SEQ ID NO: 114119 - protein, 66 aa, Glycine max
  Coding DNA Sequence Number=SeqID_22434
MGYGKKIGEELATQLTQASQVASSRSNRLLEEHPGRPKWAWNFTYCATKGAKYLEAVNQRLHAIKQ

SEQ ID NO: 114120 - protein, 250 aa, Glycine max
  Coding DNA Sequence Number=SeqID_22435
  Gene Ontology: Biological process=transposition, DNA-mediated
  Homolog annotation: Hit_ID=Q6UUU1; Match level="QueryCoverage=28%, HitCoverage=46%, E-value=1e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLSVRINPRVILSLDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 114121 - protein, 116 aa, Glycine max
  Coding DNA Sequence Number=SeqID_22436
MHKKRSFAGDLIPIDLEINATCRRCNQERIRNFLQDLEAAAIPEEEPQSYDASSSFPIVENSHLDPSEDYIMAEEPRRVTMEDYSSSKVPQFFTSIAQPEVQAQTITYAPSLIQLI

SEQ ID NO: 114122 - protein, 124 aa, Glycine max
  Coding DNA Sequence Number=SeqID_22437
MEAMKEQMTTMMEATMSVKKIMEANAVAIAATSVVAKVNPMPPSGLNQMNHSTSAMVGKDLGSTGGPYYAQSQNKHAFPPHGFPPNCTPPNVAYTPSGNVNNSTPIFIESRQSQTDHAYVSTHG

SEQ ID NO: 114123 - protein, 54 aa, Glycine max
  Coding DNA Sequence Number=SeqID_22438
MEEIHGEDDEEQGTKIISSRMEKEESLLQMPLQGEDELRTSSPPEEVMDKSLKV

SEQ ID NO: 114124 - protein, 78 aa, Glycine max
  Coding DNA Sequence Number=SeqID_22439
MVIGSRTQGAPAFSGLNKGPAQQWEEARDSDRHRIRKVGEDHKWRAPNRLPMLKSQGELCVRVKADDRLVVPRVNGGR

SEQ ID NO: 114125 - protein, 76 aa, Glycine max
  Coding DNA Sequence Number=SeqID_22440
GSPSFITGLCRFYGVPVTSSKGIRPPTNRAFIKKYCVPRQAQGGIPQQPGDGRQRAIDAPPSPLEFTSAHPQKGHT

SEQ ID NO: 114126 - protein, 177 aa, Glycine max
  Coding DNA Sequence Number=SeqID_22441
  Homolog annotation: Hit_ID=UPI0000F2ADE5; Match level="QueryCoverage =42%, HitCoverage=11%, E-value=8e-08, Identity=42%"; Hit description =PREDICTED: similar to PDZ-LIM protein cypher3s isoform 1
MATTSSPLEDCTSSPLEGYMPSPSEDYTSSPLEGCMSSPSEGCTPSPLEGCTPSLSEDYASSPSEGYMPSPSEGYTFSPGLHVLAFKGQHVVAFAFVGLDALTFRGLHVFAFRGLHILTFRGLRVVIFKGLHVFTFGGVYILTFSGLHAFTFKGRHVLNFRGLRVLTFSGLHIHALK

SEQ ID NO: 114127 - protein, 136 aa, Glycine max
  Coding DNA Sequence Number=SeqID_22442
  Homolog annotation: Hit_ID=Q6UUU1; Match level="QueryCoverage=63%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIPLYGR

SEQ ID NO: 114128 - protein, 119 aa, Glycine max
  Coding DNA Sequence Number=SeqID_22443
  Homolog annotation: Hit_ID=A7UQU7; Match level="QueryCoverage=87%, HitCoverage=18%, E-value=9e-12, Identity=40%"; Hit description=IMP dehydrogenase/GMP reductase, putative
CWIYKHFSSVGSALVVEDYDERRLHACRWTSGKTLPMSMSRRRLDRLTPDMVCWITYGDHRSSREFEVISLFFGHLKWGPLTVIHRPERVVRQFGYIQTILPHPTTFAVSVEEIDDSWM

SEQ ID NO: 114129 - protein, 116 aa, Glycine max
  Coding DNA Sequence Number=SeqID_22444
MIMRNQDIYSSQDEATTSPSSSESEEVKGEESSEEIYPQEEGQPLMVKEECKEVSVSSKSDQGVPKDPKRIKIIPDWPTPPSVKGKSPEYQEPQDLRSNPFQGGGDDAILPPKGIG

SEQ ID NO: 114130 - protein, 228 aa, Glycine max
  Coding DNA Sequence Number=SeqID_22445
  Homolog annotation: Hit_ID=Q2HW90; Match level="QueryCoverage=73%, HitCoverage=33%, E-value=6e-22, Identity=38%"; Hit description =Putative uncharacterized protein
MGTNQPAEVYKSRLKARYHQHQGIRAVDGLQMQAFRKTYGKILELTITEVSIKAIASLTQYYDQPLRCFTFGDFQLVPTIEEFEEILGCPLGGRKPYLSSGCLPSLSRIATVVKDSARGLDRIKQTRNGIAGLPRKYLEDKARGMADQGDWVPFMDVLALLIFGVIFFPNVDGLVDLAAIDAFLAYYHSKESPVVAVLADLFDTFNRSKTRDIHVRSRAIARVLKREE

SEQ ID NO: 114131 - protein, 236 aa, Glycine max
  Coding DNA Sequence Number=SeqID_22446
  Homolog annotation: Hit_ID=Q84VI1; Match level="QueryCoverage=100%, HitCoverage=59%, E-value=3e-57, Identity=73%"; Hit description =Envelope-like protein
VESDEEPIANRLAPGIAERLQSRKGKTPIKRSGRIKTMAQKKSTPITPTTSRRSKVVIPSKKRKEISSSDSDDDVELDVSTSKRAKKSGKKVPGNVPDAPLDNISFHSIGNVEKWKYVYQRRLAVERELGRDALDCKETMDLIKGCWTTEDSHQIGETVMKAYVKYAILHRIGAANWVPTNHTSTVATGKAAASGAVSKDALIAELKDTCKVLEATIKATTEKKMELERLIERLTD

SEQ ID NO: 114132 - protein, 77 aa, Glycine max
  Coding DNA Sequence Number=SeqID_22447
  Homolog annotation: Hit_ID=A0ST23; Match level="QueryCoverage=35%, HitCoverage=55%, E-value=2e-08, Identity=100%"; Hit description =Putative reverse transcriptase
LGNDIHGAPKIKLIDTVDLEGGPVGKPVVPAALMNRPTRGERRFAYWALAECILAYYVGTDEGVSEVLHVAGEKRLH

SEQ ID NO: 114133 - protein, 203 aa, Glycine max
  Coding DNA Sequence Number=SeqID_22448
  Subcellular localization annotation: CTP_CleavageSite=38; ConfidenceScore=5.85e-01
MGSPPASTLPPPPPPSPPPPPPTSDASASLSTVKRTCKASRLRSLSTRPPGAERPVVHVDPATKEGRRRNLISQRLLTVGRKGSYYRQWGRDEGSLNQTSRGNGPLQPIRTVSRTLFVTNTTSARKSGPSFARLIETLLGRMCASRHRPSRSRILPPTFSLVGVMIIWSRSSWLRRPRRRCRKLHSPETLMASSTLHPQSDAT

SEQ ID NO: 114134 - protein, 108 aa, Glycine max
  Coding DNA Sequence Number=SeqID_22449
  Pfam annotation: Domain name=G-patch; Domain location=2-45; Score =12.8; E_value=0.0053; Accession=PF01585.14; Description=G-patch domain
MAMMVGWVMLGNGYEPGMGLGKNNSGKTSLVSTRGNHGKFGLGYKPTQADIRKSVAGRKSRSQGSQLGRQVEGGPPCHISRSFISAGLGHEGQVVAICEDDSPSGSDL

SEQ ID NO: 114135 - protein, 104 aa, Glycine max
  Coding DNA Sequence Number=SeqID_22450
  Subcellular localization annotation: CTP_CleavageSite=64; ConfidenceScore=5.43e-01
MFANSPFSTFIRRPMNSLPSAVHVSSTIESGAPRIDCLALFANSPFSNLIWRPMNSLPSAVHVSSVIKRGGSENKRRSRDESRHHGKGRTDEISVLSLLSSYLR

SEQ ID NO: 114136 - protein, 116 aa, Glycine max
  Coding DNA Sequence Number=SeqID_22451
MDDQEEIQEQMKADMSALKEQMASMMYAMLRMRQLMENNVATAAAVKRSTLGHISNPHLGYNRVAYPYGLPPNYTPPVMRDDAGHVPSPILEREPPQQSDDVHEDRREYAQGDIDF

SEQ ID NO: 114137 - protein, 199 aa, Glycine max
  Coding DNA Sequence Number=SeqID_22452
  Homolog annotation: Hit_ID=UPI00006A17C9; Match level="QueryCoverage =53%, HitCoverage=58%, E-value=5e-08, Identity=30%"; Hit description =UPI00006A17C9 related cluster
VPSARLSSRLALSPISLTRAKHEGGNQWERTTSGQGWTFSPWVKVYGKLGFWLKACRTTGHDICQGVGLANVVILVRMIRTRLFAAARVKSCPGMHSSCVIATSSSCALTVGPPPASGGVDVEPTESEDAKPSKGEGACSTLKSRTCSPLKARACTPLMARACGPLKARVCGPLKARACSPLKARVCGPLKARACSPLK

SEQ ID NO: 114138 - protein, 135 aa, Glycine max
  Coding DNA Sequence Number=SeqID_22453
MVGYAPSSFADLVFADERIEVGLKRGKFNHPAWTTEKTRANEEGEDEGETHAVTAIPIRPSFPPTQQCHYSSNNNPSPYLAPSYPQRSYLNQPQNPPSTQPMLNTTFSTNQSTNQEMNFAAKKPVGFTPNSGVIC

SEQ ID NO: 114139 - protein, 169 aa, Glycine max
  Coding DNA Sequence Number=SeqID_22454
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=3e-23, Identity=98%"; Hit description=LacZ protein
MESARHMDTPMSTGCYLDKDESNQSIDMKQYRGSNPTPSNSCSPGDPLVLERPPPRWSSNSPYSESYYNSLAVVLQRRDWENPGVTQLNRLAAHPPFASWRNSEEARTDSPSQQLRSLNGEWDAPCSGALSAAGVVVTRSVTATLASADVRRCFCRYAPPRQYLNRMDS

SEQ ID NO: 114140 - protein, 111 aa, Glycine max
  Coding DNA Sequence Number=SeqID_22455
  Homolog annotation: Hit_ID=A2Q4R4; Match level="QueryCoverage=36%, HitCoverage=31%, E-value=2e-08, Identity=70%"; Hit description =Putative uncharacterized protein
  Subcellular localization annotation: CTP_CleavageSite=60; ConfidenceScore=5.04e-01
MEAMLSSLFGSSSASNCLPSLHLVYSPHYRVYRSSLYMPKPPKSIFHHLLYNRRYSNPLSNSSVSNFILSSLTTHPPQHPHLRYTYFSLMLALDRPTFLFRTKSPVLPQVG

SEQ ID NO: 114141 - protein, 238 aa, Glycine max
  Coding DNA Sequence Number=SeqID_22456
  Gene Ontology: Mol. function=amino acid transmembrane transporter activity; Cellular component=integral to membrane; Biological process=amino acid transport
  Homolog annotation: Hit_ID=A2ZV89; Match level="QueryCoverage=19%, HitCoverage=6%, E-value=1e-11, Identity=76%"; Hit description =Putative uncharacterized protein
MKLIVPLQGLVLGRRGLLLGTLVPCTLFYFLQQHSRLHDEEGIGRRRDCVFEKESVTVLFFRKEERGIALGRRGRRHALGRGKRHWKEKSPKRGDRGIQIQNCIIVIGPTLPLHQTDFLGTIDFCRRTVSTIWHTMEVATMMSIFYFAVDDGDGGGSDVKRGHQEEHKELAATICHPSLEQFFGMRPHVIDSNSLIEETKDADRNGPKGIISAVRISIVVGWGYILGITFAVTDIVYQ

SEQ ID NO: 114142 - protein, 128 aa, Glycine max
  Coding DNA Sequence Number=SeqID_22457
  Gene Ontology: Mol. function=nucleotidyltransferase activity; Cellular component=cytoplasm; Biological process=biosynthetic process
  Homolog annotation: Hit_ID=A6MUT4; Match level="QueryCoverage=76%, HitCoverage=33%, E-value=7e-44, Identity=82%"; Hit description=GDP -mannose pyrophosphorylase
MMVDCRLVQYRYVDWAELRRKGFKGTRFRPLSFNVPKPLFPLAGQPMVHHPISACKKIPNLAQIYHLGFYEEREFALYVSSISNELEIPVRYLKEDRPHGSAGGLYHFRDLIMEEDPIFIYTYDFVHA

SEQ ID NO: 114143 - protein, 162 aa, Glycine max
  Coding DNA Sequence Number=SeqID_22458
  Homolog annotation: Hit_ID=Q6WAY4; Match level="QueryCoverage=75%, HitCoverage=26%, E-value=1e-08, Identity=29%"; Hit description =Putative uncharacterized protein
MEPIASLSQYYDQPLRCFTFEDFQLVPTVKELEEILGCQLGGRKPYLFFGFYPSTTRVAKVVKISAQELERLKQNRNGVVGVPRKFVLFPNMEGLVDLAAIDAFLAFHHGKESPVVAILAMYDTFDRGCERAAQELFVVHWLSMCGWFHTFFLQEVGPSIAT

SEQ ID NO: 114144 - protein, 120 aa, Glycine max
  Coding DNA Sequence Number=SeqID_22459
  Homolog annotation: Hit_ID=A2Q4P8; Match level="QueryCoverage=77%, HitCoverage=36%, E-value=2e-13, Identity=43%"; Hit description=IMP dehydrogenase/GMP reductase, related
  Pfam annotation: Domain name=DUF1723; Domain location=24-73; Score =49.1; E_value=1.5e-11; Accession=PF08330.1; Description=Protein of unknown function (DUF1723)
MVIDYQRVKTLLCFHTLITCSVDTGARGVISAFVERWHKETSSFHLPIGELTITLDDVASLLHLPIIGVFNSFEPLHVDEAVLMLVELLEVSGEEARAETTQCHGAYIRLSWLRDFYQRR

SEQ ID NO: 114145 - protein, 82 aa, Glycine max
  Coding DNA Sequence Number=SeqID_22460
MTEIVYAEDDVNLRVSMGLLAAIDKGCRRRRDHLFGGMRPSLERFEGVQIAIKPTWAFQDVPTEGGAFWCKQPSSPGQAELA

SEQ ID NO: 114146 - protein, 144 aa, Glycine max
  Coding DNA Sequence Number=SeqID_22461
DARDNLAPKVEESIGEETEVPKESEEVQALKAELKRTRMVKEKAKDGSHQGQQQQAQASKGQKGRVEGGEYDYKEKLSLAISHGQRLEDEHVKVSTLQVEREARERVIESFHEEAVKWMDRFALTLNGSQEIPRLLARANAMAD

SEQ ID NO: 114147 - protein, 268 aa, Glycine max
  Coding DNA Sequence Number=SeqID_22462
  Homolog annotation: Hit_ID=Q84VH5; Match level="QueryCoverage=100%, HitCoverage=41%, E-value=2e-84, Identity=64%"; Hit description =Envelope-like protein
  Subcellular localization annotation: CTP_CleavageSite=65; ConfidenceScore=5.15e-01
MATSPKETSAPGSPSVPSSPSSTKAPSNQEQPEFHIQPIQMIPGQAPGVKISENPSLATSPREVDTEMDKKIRSIVSNILKNASVPDADEDVPTSSTPDVTVPEKDVPTSSTPNTEVLSSPSKEESTEEEDQATQETPAPRAPEPAPGDLIDLEEVESDEEPIANKLALGIAERLQSRKGKTPIKRSGRIKTMAQKKSTPITPTSSRRSKVAIPSKKRKEISSSDSDDDVELDVSTSKRAKTSGKKVPGNVPDAPLDNISFHSIGNAE

SEQ ID NO: 114148 - protein, 42 aa, Glycine max
  Coding DNA Sequence Number=SeqID_22463
MSSFALEIASGISKMFAQKKVMLSPGRHKIVILDEADSKEAE

SEQ ID NO: 114149 - protein, 240 aa, Glycine max
  Coding DNA Sequence Number=SeqID_22464
  Gene Ontology: Mol. function=transporter activity; Cellular component= outer membrane-bounded periplasmic space; Biological process=transport
  Homolog annotation: Hit_ID=A6T6V0; Match level="QueryCoverage=100%, HitCoverage=64%, E-value=1e-130, Identity=94%"; Hit description =Periplasmic putrescine-binding protein; permease protein
MPYLWATTGIGYNVDKVKAALGPDVKLDSWDVVLKPENLEKLKSCGVSFLDAPEEIFATVLNYLGKDPNSNKADDYTGPATDLLLKLRPNIRYFHSSQYINDLANGDICVAIGWAGDVWQAANRAKEAKNGVNVSYFIPKEGALAFFDVFAMPADAKNKDEAYQFLNYLMRPDVIAHISDHVYYANGNKASVPLVSEAIRSNPAIYPPADVFAKLFTLKVQDPKIDRVRTRAWTKVKSGK

SEQ ID NO: 114150 - protein, 178 aa, Glycine max
  Coding DNA Sequence Number=SeqID_22465
MASRKRKSIGTRPTSLYDTRRFSSLDAWTRYTDNVLGRNILPERKVELYHTELNDFKAELERRNFHKRLTNLADGSIDLALVKEFYANLYSSEDRQPKQSRVRGHLVTIDADSLNAFLETPVVLAEGETLPAYSRYWRLPTNFREIEAALCIPGRGFILNSEGHPGKILKKDLTTLAQ

SEQ ID NO: 114151 - protein, 97 aa, Glycine max
  Coding DNA Sequence Number=SeqID_22466
MEGPGSTSGTPMMEREMITMIVDTLPVFYYKKMAGYMPSSFTDLVFASERIEVGLRRRKFNYVAPANTSNRRFGASRATKKEGDTHAVTSSPTWPKP

SEQ ID NO: 114152 - protein, 177 aa, Glycine max
  Coding DNA Sequence Number=SeqID_22467
MVEKEMITMMVDTLPVFYYEKLVGYMPSNFADLVFAGERIEVGLKRGKFDYVSSKGTNARWIGATGAKRKEGDTHVVTSAPAWIKPPQISHSTHQYAQHHPSFSARTGDSSNSALVQTRAPAPIQREPPQAPAPTLIRPASNAHFGIGSNATRKFSSRPTPGFTPIPMTYEDLLGIL

SEQ ID NO: 114153 - protein, 80 aa, Glycine max
  Coding DNA Sequence Number=SeqID_22468
MVNPEEGAGLALVQMTQAEKKTCPTLQWKALAQVEWALRPLECRPPGTAEASRLQRPHTLPKEKARLLARPTYAETHPCS

SEQ ID NO: 114154 - protein, 49 aa, Glycine max
  Coding DNA Sequence Number=SeqID_22469
MRKTLDEASLLSSESETQHDNRSTSTPYGSHRLRVDKGVALAPTYPQVQ

SEQ ID NO: 114155 - protein, 92 aa, Glycine max
  Coding DNA Sequence Number=SeqID_22470
PTRPWGFQLWLRASVSSTGCPFPQQGIVPARHPVDPKKSNKVLELPALITGLCRFYGVLVAPSKPGDGRQRATDAPPPPLEFTNRQPSPKPK

SEQ ID NO: 114156 - protein, 48 aa, Glycine max
  Coding DNA Sequence Number=SeqID_22471
MLMHNPPIWALQKIPPEGGCFWRKQPCSPGRAELAWASWAATTSPILL

SEQ ID NO: 114157 - protein, 215 aa, Glycine max
  Coding DNA Sequence Number=SeqID_22472
  Homolog annotation: Hit_ID=A0ST23; Match level="QueryCoverage=12%, HitCoverage=53%, E-value=2e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSMRGRSTSRTVIPIDLEIEATWCNNAARRQREQDIDTSPPPSPNHVQMDEGPAHRVTLSSLSIPSTSRGGPVPAFVPFSEVGKPVVPAALMNRPTRGERRFAYWALAECILAYYVGTDEGVSEVLHVAGEKRLH

SEQ ID NO: 114158 - protein, 111 aa, Glycine max
  Coding DNA Sequence Number=SeqID_22473
MGEVEEVQEKMKADMEAMKEQMATMMEAIMIMKKAKIWEVRAAPMMCKFKMSTPSCHMACLSTTRHPMWCTLPIRMSITPLLYPLRANNPKLIMHMSLKPWGRHMKFPTTI

SEQ ID NO: 114159 - protein, 251 aa, Glycine max
  Coding DNA Sequence Number=SeqID_22474
  Homolog annotation: Hit_ID=A7UQU7; Match level="QueryCoverage=49%, HitCoverage=21%, E-value=1e-13, Identity=36%"; Hit description=IMP dehydrogenase/GMP reductase, putative
VDSRGSPKDLAQAGGFAWGAAALVHMYDHLNDASQASTRQLGGYITLLQCWIYEHFSTMHTSVVDDAYDEGSPRACRWLTGKAHITGIKGAPYQRRLDALSVTNVCWMPYGEHWRVRAFDLISSYTGQLRWGQIVVYVRPERVAPDYMEWFFWISHPFVTRTEETVAPRHPPPPHHEEFVEPPIPEVSVATDLPTHSVDLGAIAEDLERVINLGMVIEGTDLHDIMTRCLRRARGDAADGSLRPRQRRRID

SEQ ID NO: 114160 - protein, 268 aa, Glycine max
  Coding DNA Sequence Number=SeqID_22475
  Gene Ontology: Mol. function=endodeoxyribonuclease activity, producing 5'-phosphomonoesters; Cellular component=nucleus; Biological process=metabolic process
  Homolog annotation: Hit_ID=Q1H006; Match level="QueryCoverage=79%, HitCoverage=77%, E-value=9e-54, Identity=52%"; Hit description=TatD -related deoxyribonuclease
  Pfam annotation: Domain name=TatD_DNase; Domain location=54-268; Score=133.8; E_value=4.9e-37; Accession=PF01026.12; Description=TatD related DNase
MGVRTLHAPDVLGQVDLSVLMRTLVTVPCNEILVEAGATLNGAFLQSGFVDELLFEFAADRDQIWQEAQAQGVRALVIPAVMQSTFQPIMDWCARHPQTGFALGWHPLFVDQAPDDALQQMHETVTTVLAGPQAQQLLAIGEIGLDFYVTRENEAKQIALFEGQLQIAKQFDLPVILHVRAAVDSVLKYLRKHHIHRGIAHAFNGSLQQATIFAELGFKLGFGGAMTWPRALKIRKLAAEVPLEHVVLETDSPDIPPVWLGHQGRNSP

SEQ ID NO: 114161 - protein, 54 aa, Glycine max
  Coding DNA Sequence Number=SeqID_22476
MVLSGRQRRRGEGRHHPLGNKPWKKEFHHQECALDKKLEEDALMEEKKERRERA

SEQ ID NO: 114162 - protein, 52 aa, Glycine max
  Coding DNA Sequence Number=SeqID_22477
MRTLRRFAIADCGSLGGFTMREGMCSDAVVSLVFMEEKEKEENSKKRSEKEG

SEQ ID NO: 114163 - protein, 207 aa, Glycine max
  Coding DNA Sequence Number=SeqID_22478
  Homolog annotation: Hit_ID=UPI00016621D1; Match level="QueryCoverage =97%, HitCoverage=39%, E-value=5e-20, Identity=36%"; Hit description =UPI00016621D1 related cluster
  Subcellular localization annotation: CTP_CleavageSite=27; ConfidenceScore=5.03e-01
GLRALAFVGLHALTFRGLHVLTFRGLRALAFVGLHALTFRGLHVLTFRGLRALAFVGLHALTFRGLHVLTFRGLHALGSEDYTGLRALAFVGLHALTFRGLHVLTFRGLRALAFVGLHALTFRGLHVLTFRGLRALAFLTFRGLHVLAFRGQHVLALTFRGLLVLTFRGLHILAFRGLHVLTFSGLHALAFKGLHALTIRGLRVLTL

SEQ ID NO: 114164 - protein, 71 aa, Glycine max
  Coding DNA Sequence Number=SeqID_22479
MLWNFTDCTLTLPFNFRHVRELHGLCYNAFLLASGISQNFTNCLMMGAKYLEVVKRGSHPYNAWSPDEIRV

SEQ ID NO: 114165 - protein, 63 aa, Glycine max
  Coding DNA Sequence Number=SeqID_22480
MTIICFRMSSGSPPLDDKKAQNDHNLSLRAIRHDRFRMAKRVSMTEIVGAADKSDALAPTYPQ

SEQ ID NO: 114166 - protein, 189 aa, Glycine max
  Coding DNA Sequence Number=SeqID_22481
  Homolog annotation: Hit_ID=Q6WAY6; Match level="QueryCoverage=97%, HitCoverage=33%, E-value=4e-09, Identity=25%"; Hit description =Putative uncharacterized protein
MGTRGCISYNPVLSIRQLGYPMRGAPLEEELTPIIARGFNKTNMEALQKVHKAWEMVQKKEKELKGSNNGPIGGYRRWLKAHMQDLDWLPRLRTTKGVEVEAPEEDEEVQALRAELEQAQSVKERFKSAALKIQKENAELRDVNKATTKALERETKRASREEYGWNKFRGALWGSNSELKLRREERDQS

SEQ ID NO: 114167 - protein, 61 aa, Glycine max
  Coding DNA Sequence Number=SeqID_22482
VQMTTLVSACYWTLSLTDNKRVCAGYRIGRLRVPTDSQVTIVKGGAVDKSGAFAPTYPQSR

SEQ ID NO: 114168 - protein, 75 aa, Glycine max
  Coding DNA Sequence Number=SeqID_22483
MSILALEKTQRRRKFPNPRRGEDTKKRRKEKFPIKEWEKQKRKENSRSRIGRKQKKHPERSLDQTISEQYRIVTK

SEQ ID NO: 114169 - protein, 124 aa, Glycine max
  Coding DNA Sequence Number=SeqID_22484
DTSFVVQVEGTSTWVVVTENKKGYISCGSVLVEGTSTRLFKENKGGYIPCGSFFVKEFTRLKRNLKDHRSLGDWMYARVVVELVRLPKRKTRGSRHQCLFEENLRKIQKRSANFEKKGSGVVYA

SEQ ID NO: 114170 - protein, 87 aa, Glycine max
  Coding DNA Sequence Number=SeqID_22485
  Subcellular localization annotation: CTP_CleavageSite=80; ConfidenceScore=5.24e-01
MSSAKSMHLGAISWICSVRTSRIKIGTNVLLLHSSGMRFDLIISLKSSVSHSRPLSPRVFHTSIGMLSGPTALPLLILFNASVTSCF

SEQ ID NO: 114171 - protein, 106 aa, Glycine max
  Coding DNA Sequence Number=SeqID_22486
MELKRPSKAMREEPARTLQRTVEWILPTPTPYRLVEPVQVIEVTSSEEDPEELPPEPAVDALDFLEGDEDPLPEVDSPEDVMSVSEADSTEERGPGEMATSGGYSS

SEQ ID NO: 114172 - protein, 42 aa, Glycine max
  Coding DNA Sequence Number=SeqID_22487
MKIQKKKIKCNFNNIKKSYEPVWKIIDERWDHQLHRPLHATA

SEQ ID NO: 114173 - protein, 101 aa, Glycine max
  Coding DNA Sequence Number=SeqID_22488
MSHAVKDHRGKWAPNYEGPFVVKRAFSGGALGQDHFGLPSGVKTKHEWQKPVKVLKDERKRGWGHDRPIVAPSLCETSRNVAARQPRILCHLQLSFTICLF

SEQ ID NO: 114174 - protein, 113 aa, Glycine max
  Coding DNA Sequence Number=SeqID_22489
MAPRHRPAECMTRGNPSDLQPFDPEIDRTFHRLVRHHLVPFEHPEHPVIGDFEHYYFEQSDFEHSENMAQSPPRERTLREMAAPDFTYESLCIQYPDKDVPYVLKTGLIHLLP

SEQ ID NO: 114175 - protein, 189 aa, Glycine max
  Coding DNA Sequence Number=SeqID_22490
  Homolog annotation: Hit_ID=Q84VH5; Match level="QueryCoverage=73%, HitCoverage=23%, E-value=2e-46, Identity=63%"; Hit description =Envelope-like protein
MAQKKSTPITPTTSRRSKVAIPSKKRKEISSSDSDDDVELDVPDIKRAKTSGKKVPGNVPDAPLDNISFHSIGNVERWKFVYQRRLALEREPGRAALDCNEIRTSSRLTGQPAENWFTKLGDCYERKCVRFSPAVINKYLGRPTEGVVDIAEEEDQATEETPAPRAPEPAPGDLIDLEEVESDEEPIAN

SEQ ID NO: 114176 - protein, 73 aa, Glycine max
  Coding DNA Sequence Number=SeqID_22491
MRVQHLTMGPKKGRIIRIRTKIGYDTNFEVLLSLKIAGDRTHEERMKNVEERLKPLRDSSRKTLRKRFGSASA

SEQ ID NO: 114177 - protein, 92 aa, Glycine max
  Coding DNA Sequence Number=SeqID_22492
MGLNKFQGALWGSDNELKLRRAKRDQLRVEGMVLEDKLKDCQRSKRSLSKQSSKTEENTWAIIDQYKEKLSLAVAHEQRLEDEYAKVSILQA

SEQ ID NO: 114178 - protein, 59 aa, Glycine max
  Coding DNA Sequence Number=SeqID_22493
MRAEDAEGHGVASEEADGERPYEKPMDVEECEWGRADGDAAENHGWRSEGNDGALRDDW

SEQ ID NO: 114179 - protein, 26 aa, Glycine max
  Coding DNA Sequence Number=SeqID_22494
MEENWKVKEIWKRGNYADNVDEADGY

SEQ ID NO: 114180 - protein, 270 aa, Glycine max
  Coding DNA Sequence Number=SeqID_22495
  Gene Ontology: Mol. function=peptidyl-prolyl cis-trans isomerase activity; Cellular component=chloroplast; Biological process=protein folding
  Homolog annotation: Hit_ID=A5B9P8; Match level="QueryCoverage=94%, HitCoverage=97%, E-value=1e-55, Identity=48%"; Hit description =Peptidyl-prolyl cis-trans isomerase
  Pfam annotation: Domain name=Pro_isomerase; Domain location=107-266; Score=189.1; E_value=1.1e-53; Accession=PF00160.12; Description =Cyclophilin type peptidyl-prolyl cis-tr
  Subcellular localization annotation: CTP_CleavageSite=79; ConfidenceScore=5.59e-01
MASSLSAQLVQCQNSLPPLQANFSQDVSKVQRSHVVCCGTKSPIGYGKTLASRSHNALRFSVTQQSVARSIRYRRMTCVNAADSKLVVNLWAGLFWAYLERLFLKQFKISVLCIQIKLNSLCTDEKGYGYKGSSFHRIIKDFMIQGGDFTEGNVSSVIVVCMPAYMELVELVSMVLVLKMRVLPFQHFLAVKHVGPGILSMANAGPNNNGSQFFIFTVKTLWLDNWHVVFGHIIDGMDVVKTLESQETSRSDVPRKPCRIVNCGELPIEG

SEQ ID NO: 114181 - protein, 91 aa, Glycine max
  Coding DNA Sequence Number=SeqID_22496
  Homolog annotation: Hit_ID=A5CBM1; Match level="QueryCoverage=100%, HitCoverage=6%, E-value=2e-18, Identity=57%"; Hit description =Putative uncharacterized protein
MTLEEGKVKIEKFDGRDFSLWKMQIEDYIYQKKLYQLYQPLSGDKPDDMRQEEWNLLDRQAHGTLSDMYEKPSVANKVYLMHRLFILKMGE

SEQ ID NO: 114182 - protein, 163 aa, Glycine max
  Coding DNA Sequence Number=SeqID_22497
MGAIGIHIQSCMQTKLSLSNAEERNANKSNQMEAEIGVMGMVRIGSKQEVGRRKRGIFIDGKHKGVILHSVPVLLYEGFSDLLLSGFGGSVLRCFFCFVLPTLRERLRCVFIRRILLFQMPLKRDNAKKRSISLDEVVPACSTNYLSPRLPKLSCLDNHLLYH

SEQ ID NO: 114183 - protein, 103 aa, Glycine max
  Coding DNA Sequence Number=SeqID_22498
MSYKDGSKNRNENGITMNNEKYVRYMPKQVEALESNSFASALFSPTLSPNKSSSGSKIEDTYPKGRRSWMAWWWRWMMVVVVSVEEGEEGKWKEGDDVALRCQ

SEQ ID NO: 114184 - protein, 53 aa, Glycine max
  Coding DNA Sequence Number=SeqID_22499
MSWVWLSGEKERGNKEGGMNQRSDWEGMLLLCWWYLVESNARKKKGGLVRKTP

SEQ ID NO: 114185 - protein, 226 aa, Glycine max
  Coding DNA Sequence Number=SeqID_22500
MVGPIATFGKGNRMKHLEKKENEVKEEGIIEHRSLTAPASKVTSKTVKMNVMVAVTVGYQAYFLKLKDMANPPPVRPWFRLASIRSSPPPPPPPAPAPAQEPRLPAFRTASAPSSPQIQPTQPAPQPQEHPSSQHNRFSSSSLPTSPENKNITRVPLPSPSHSPNTSPPPSPLALTPSQSRSETMIPDQPEPKTVLVQKTIDPRPKPWHNARHGQHDTVKESDPRR

SEQ ID NO: 114186 - protein, 784 aa, Glycine max
  Coding DNA Sequence Number=SeqID_22501
  Gene Ontology: Mol. function=phosphotransferase activity, alcohol group as acceptor; Cellular component=cytoplasm; Biological process =metabolic process
  Homolog annotation: Hit_ID=UPI0000162BDC; Match level="QueryCoverage =99%, HitCoverage=70%, E-value=0.0, Identity=60%"; Hit description =GHMP kinase-related
  Pfam annotation: Domain name=Fucokinase; Domain location=1-228; Score= 88.2; E_value=2.6e-23; Accession=PF07959.3; Description=L-fucokinase
  Pfam annotation: Domain name=GHMP_kinases_C; Domain location=690-770; Score=34.7; E_value=3.3e-07; Accession=PF08544.4; Description=GHMP kinases C terminal
  Pfam annotation: Domain name=GHMP_kinases_N; Domain location=547-614; Score=47.5; E_value=4.7e-11; Accession=PF00288.17; Description=GHMP kinases N terminal domain
  Pfam module annotation: Pfam domain module=Fucokinase::GHMP_kinases _C::GHMP_kinases_N; Domain location=1-228::690-770::547-614
MEMSLYEDLIAAWVPAKHEWLRKRPLGEELVNKLGKRKMFSYRAYDLLFLHFGTSNEVLDHLSGVGSELVGRRHLCSIPATTASDITASAIIISSKIAPGVSIGEDSLIYDSSICGGIHIGSLCIVVGVNISLDNFLSVEKSIKFMLPDRHCLWEVPLIGNRERVLVYCGLHDNPKSSLSKDGTFCGKPWKKILHDLGIQESDLWGSSGPDEKYLWNSKIFPILPYAQMIEVAMWLMGLANEKSESMLPLWKYSQRISLEELHRSIDFSTICIDSSNHQADLAAGIAKACISYGMLGRNLSQLCEEILQKKGPGVEICKEFLAMCPIVRKQNSNILPQSRAYQVEVDLLRACNDEGTACKLEHKVWAAVADETASAVRYGFKDSYESTSRLVEALTSLRRLSILITLMVEHLSESPGSLSCQEFQNNQHDNCTHLPFHPRRVEVELPVRVDFVGGWSDTPPWSIERAGCVLNMAISLEGFQPIGTIIETTKTEGILFTDDAENQLFVEDYTSICAPFDGDDPFRLVKSALHVTGIIHDNILVDMGMHIKTWANVPRGSGLGTSSILAAAVVKGLLQVIDGDDSTENVARLVLVLEQLMGTGGGWQDQIGGLYPGIKCTSSFPGIPLRLQVVPLLASPQLISKLQQRLLVVFTGQVRLAHKVLQKVVVRYLRRDNLLVSSIKRLVELAKIGREALMNCDVDELGEIMLEAWRLHQELDPYCSNEFVDRLFSFATPYCCGYKLVGAGGGGFALLLAKDAQLAKELRQRLEDDKHFEVKVYDWQIFL

SEQ ID NO: 114187 - protein, 79 aa, Glycine max
  Coding DNA Sequence Number=SeqID_22502
MAAKDLKGGFVGVCLDLDGATIGIVVAEGGGKGEELGFGVLGGEGGGGGEEMPRIQYLQTWIRRELCMPPLLFHHMLVI

SEQ ID NO: 114188 - protein, 73 aa, Glycine max
  Coding DNA Sequence Number=SeqID_22503
  Subcellular localization annotation: CTP_CleavageSite=46; ConfidenceScore=5.37e-01
MEFESSEYMPPCQKSKASSTMVHTKERWMWNSTSFCRGTPTLIATSSSSSAPLTSSTSSTLTPDYMLSNFAPL

SEQ ID NO: 114189 - protein, 258 aa, Glycine max
  Coding DNA Sequence Number=SeqID_22504
  Homolog annotation: Hit_ID=A2XCV9; Match level="QueryCoverage=52%, HitCoverage=65%, E-value=3e-10, Identity=28%"; Hit description =Putative uncharacterized protein
  Pfam annotation: Domain name=FAR1; Domain location=90-170; Score= -9.5; E_value=0.00069; Accession=PF03101.6; Description=FAR1 family
MSCSIGLFGVIKHLIVTQVVCHSLFKECSFSTSFLKGCCAIPITDTSEELNETRDEFEEIEDCGEEDDDCGCSKSESKDDTLLVDNLEGNFCEESGEPIPIIINGLVEITFVCSRQGVHKDRRLTAKTRKHEPRNDIRCKCLAKFVHVKKNHGRRGVKEFTNDHKHELLEKDYCSLVPSHKKMTPGDVLKIKNLRKTDIMTPQIFGSLANISGGYDTQFIDTMKGKALVFIITDGDLAMKNAIEVVFLVQIISYAHGS

SEQ ID NO: 114190 - protein, 315 aa, Glycine max
  Coding DNA Sequence Number=SeqID_22505
  Gene Ontology: Mol. function=binding
  Homolog annotation: Hit_ID=A7PZX6; Match level="QueryCoverage=97%, HitCoverage=18%, E-value=8e-63, Identity=41%"; Hit description =Chromosome chr15 scaffold_40, whole genome shotgun sequence
MIDAVEDPVDSHKLKIDTSNSDCFESPNHTNAIMQEGEELRVSLSPSSQGDSQGIPYKKLSASAAPFNPSPGIARAAPFAMNTTLPSAAGAVSPIGPWPVNMNVHHGPATMLPAVIPMCSSPHHTYPSPPPTPNMMIQPLPYMYPPYTQPQSIPTNNFPVTSSGFHVNQFSWQCNMNPAVSSFGPNAVWPGCHPGEFPLPAPSIKPIPDPILEPQKQCHDINNVSENKKDVQALESETSDDEVGRVNAESVKENGNPNFHGFENAANKPNRNIGLNNISRNEKNIDGFIYNRVVRGSDVPKSISLSSRRDCTATA

SEQ ID NO: 114191 - protein, 455 aa, Glycine max
  Coding DNA Sequence Number=SeqID_22506
  Gene Ontology: Biological process=protein modification process
  Homolog annotation: Hit_ID=Q9SV28; Match level="QueryCoverage=98%, HitCoverage=99%, E-value=6e-63, Identity=37%"; Hit description =Putative uncharacterized protein AT4g01000
MEQKRSSSKMYNLFVKHLDGKTLTLLFPSPILYASSIRDRLFQLTGIPAHHQRLVTGCRHLNDDKSAIQCLPEDGNMFPSVRLLLRLKGGKGGFGSLLRGAATKAGQKKTNNFDACRDMSGRRLRHVNAEKRLEEWKAGEQERKLEKVAEEFLKKQMKKGKGKGEGEGGAQKYVAKYREESERCVAEVALSVKEALTAKRKSPSQPHHDAKKLKIWMGKRKLNESDSDDSDEEVEIEKSDLLNGPNESGSNKAEGSLGSVNGGGGSSGAGSCESGSEEEKEAAVEGNVGSVAMLGGESIQAAAEPVINDEATEMPKESVVAGINAEDNGYQDCYVGVPDKFDGAVNQASTVMGSETVASAGESNYMEIDGSLEHKAAVNEESSPSTSVPVLEEPLNFDAFNSAAELEVLGLERLKSELQSRGLKCGGTLKERAARLFLLKSTPLDELPKKLLAKK

SEQ ID NO: 114192 - protein, 306 aa, Glycine max
  Coding DNA Sequence Number=SeqID_22507
  Gene Ontology: Mol. function=chitinase activity; Cellular component =extracellular region; Biological process=carbohydrate metabolic process
  Homolog annotation: Hit_ID=A7PZU1; Match level="QueryCoverage=94%, HitCoverage=60%, E-value=1e-106, Identity=68%"; Hit description =Chromosome chr15 scaffold_40, whole genome shotgun sequence
MYKKLDGSFNVKLSYRLILPRVVLEASPAVLLGKEKQRNKAINLIVTECKEMGYDGIVLESWSRWAAYGILHDPSMRNLVTVKTMNSISENSTNLSQALQFVKQLGDALHSISSEKISGQQLQLVYVIGSPSEKLQEHDFGPKDLETLSEAVDGFSLMTYDFSNPHNPGPNAPLKWIQIVLQLLLGTSGNRAQSLAPKILLGINFYGNDFSLSRVKVKNADADAGGGAIIGRDYLALLEKHWPELQWDKNSGEHFFFYTDDKDIRHVVFYPSLKSISLRLEEARSWGCGISIWEIGQGLDYFFDLL

SEQ ID NO: 114193 - protein, 91 aa, Glycine max
  Coding DNA Sequence Number=SeqID_22508
  Homolog annotation: Hit_ID=Q58H56; Match level="QueryCoverage=54%, HitCoverage=11%, E-value=2e-13, Identity=62%"; Hit description =Putative uncharacterized protein
MWTMMRSLMRLSWLTTSLILIIDLFSFRLKDAEKCDLFVGDWVAEPNGPMDTNENSRVIEDHQNCMRNGRPDSGYLCWRWNPRAFIGDSFT

SEQ ID NO: 114194 - protein, 142 aa, Glycine max
  Coding DNA Sequence Number=SeqID_22509
MLGFLETTTTATLEREGSKVVMSLNNNAFVQKVKAIHSYARRERERAIFSLFLLQLQLLLLLLGFLSIFLRIQTPKTRKNKKKGEGAYWSYGNEEKQPNNCVQKPKVKRRRSEVILATCALGMMEVVELRLLAKIIIKVKSG

SEQ ID NO: 114195 - protein, 68 aa, Glycine max
  Coding DNA Sequence Number=SeqID_22510
MEEKSSEFIWVKIEYLGENLGLCKECVVLDPGEVEFVIVIIGLGASWRVREKEKKMVVRVTWHFGAAG

SEQ ID NO: 114196 - protein, 418 aa, Glycine max
  Coding DNA Sequence Number=SeqID_22511
  Gene Ontology: Mol. function=transporter activity; Cellular component= mitochondrial inner membrane; Biological process=transport
  Homolog annotation: Hit_ID=A7PZS6; Match level="QueryCoverage=99%, HitCoverage=96%, E-value=2e-91, Identity=55%"; Hit description =Chromosome chr15 scaffold_40, whole genome shotgun sequence
  Pfam annotation: Domain name=Mito_carr; Domain location=133-222; Score=82.9; E_value=1.1e-21; Accession=PF00153.18; Description =Mitochondrial carrier protein
  Pfam annotation: Domain name=Mito_carr; Domain location=30-121; Score= 127.3; E_value=4.5e-35; Accession=PF00153.18; Description =Mitochondrial carrier protein
  Pfam annotation: Domain name=Mito_carr; Domain location=309-414; Score=121.4; E_value=2.6e-33; Accession=PF00153.18; Description =Mitochondrial carrier protein
  Pfam module annotation: Pfam domain module=Mito_carr::Mito_carr::Mito_ carr; Domain location=133-222::30-121::309-414
MASETKVVNLAEEAKLAREGVTTPSYAFTTICKSLVAGGVAGGVSRTAVAPLERLKILLQVQNPHSIKYNGTIQGLKYIWRTEGFRGLFKGNGTNCARIVPNSAVKFFSYEQASKGILHLYRKQTGNEDAQLTPLLRLGAGACAGIIAMSATYPMDMVRGRITVQTEKSPYQYRGMFHALSTVLREEGPRALYKGWLPSVIGVIMLSLLAFWEIHIASGSNNVGPVGCSWGRGRTYTALKISNLSSARQCLPSLGDNLIGLLSKAAYRCGIDSVYSIPYVGLNFAVYESLKDWLIKSNPLGLVQDSELSVTTRLACGAAAGTIGQTVAYPLDVIRRRMQMVGWNHAASVVAGDGRGKVPLEYTGMVDAFRKTVRYEGFGALYKGLVPNSVKVVPSIAIAFVTYEVVKDILGVEIRISD

SEQ ID NO: 114197 - protein, 294 aa, Glycine max
  Coding DNA Sequence Number=SeqID_22512
  Gene Ontology: Mol. function=transcription factor activity; Cellular component=cytoplasm; Biological process=embryonic development ending in seed dormancy
  Homolog annotation: Hit_ID=A7PZR7; Match level="QueryCoverage=91%, HitCoverage=86%, E-value=3e-35, Identity=37%"; Hit description =Chromosome chr15 scaffold_40, whole genome shotgun sequence
  Pfam annotation: Domain name=AP2; Domain location=99-150; Score=77.3; E_value=5.1e-20; Accession=PF00847.11; Description=AP2 domain
MEARFSERKVVTYKHVKPGDILNAAPKVVRISVMDPYATDDEDEDEGLVIHPRMKKFVNEIRIVEKSSTNCESAGVNRTSNVSLRQHYKGKTGDSLEKKRLRGVRQRPWGRWAAEIRDPVKRIRVWLGTYDTAEEAAMVYDKAAIAFRGSKALTNFIKPPTREDLCDCGPNETEASVAVSGENDSSEESHLSSPTSVLGLQSVELMLDEVSETDLPSKEESSSQDSFLFLDSHSPSIDCYFNFETLPPVFLHETSITQQPDFHDKFSDISHLVNEDFQSWNWDIDSYFSDPLLI

SEQ ID NO: 114198 - protein, 942 aa, Glycine max
  Coding DNA Sequence Number=SeqID_22513
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q93YA9; Match level="QueryCoverage=95%, HitCoverage=100%, E-value=0.0, Identity=75%"; Hit description =Lipoxygenase
  Pfam annotation: Domain name=Lipoxygenase; Domain location=260-926; Score=1094.1; E_value=0; Accession=PF00305.10; Description =Lipoxygenase
  Pfam annotation: Domain name=PLAT; Domain location=153-253; Score =74.2; E_value=4.3e-19; Accession=PF01477.14; Description=PLATLH2 domain
  Pfam module annotation: Pfam domain module=Lipoxygenase::PLAT; Domain location=260-926::153-253
MSVSHRRGVILPKAGFDLVADSVLIKYEAAHPDPFHCKKQNMALSKELMGFSSFFSASSKVFLHNKHGTFWVNPILLPSENPRVMRLRKGAKFPVAAISEDLIKTTLTVQAEKPVQFKVRAVVTVRNKIKEDFKETMLKHFDAINDRIGTRNVVLELISTEIDPKTKSPKKSSKATLKDWSKKSNVKAERVNYTTEFIVDSNFGVPGAITVTNKHQREFFLESITIEGFASGAVHFPCKSWVQGERIFFSNQTYLPGDTPAGLRVLREKELINLRGDGKGVRKLSDRIYDFDTYNDLGNPDEGVELTRPTLGGSQNHPYPRRCRTGRAPTDTDMHAESRVEMPLPMYVPRDEQFNESKLNTFVIKRLKAVLHNLIPGLKASLSANNHDFNRFSDIDDLYSDEILNKIPLPQVLTKIQDCGRGLLKYDTPKIISKDKFAWLRDDEFARQAIAGVNPVNIEGLKVFPPVSKLDPEIYGHQESALKEEHILGQLNGMTVQQAIVENKLFMINYHDVYVPFLDEINALDGRKSYATRTIFFLTPLGTLKPIAIELSLGPSSGWKRVVTPPVDATTNWKWQLAKAHVCANDAGVHQLVNHWLRTHACMEPFILSAHRQLSAMHPVFKLLDPHMRYTLDINALARQKLINADGIIESCFTPGRYCMEISCAAYKNLWRFDMEGLPADLIRRGMAVPDPTQPNGVKLLIEDYPYATDGLLIWSAIENWVRTYVNHYYHHSNSSLICNDKELQAWYSESINVGHADLRHERWWPTLNNSEDLVSILTTLIWTVSAQHAAINFGQYPYGGYVPNRPPLMRRLIPEAEVESTSTEYANFLADPQKFFLNALPSVLQATKYMAIVDILSTHSSDEEYLGERRHSSIWSGDAEIIQAFYSFSTEIRRIENEIEKRNRDPTLRNRCGAGVLPYELLAPTSQPGVTCRGIPNSVST

SEQ ID NO: 114199 - protein, 504 aa, Glycine max
  Coding DNA Sequence Number=SeqID_22514
  Gene Ontology: Mol. function=hydrolase activity, hydrolyzing O -glycosyl compounds; Cellular component=vacuole; Biological process =carbohydrate metabolic process
  Homolog annotation: Hit_ID=A6ZJJ1; Match level="QueryCoverage=54%, HitCoverage=100%, E-value=1e-106, Identity=69%"; Hit description =Endochitinase and N-acetylglucosamine-binding hemagglutinin
  Pfam annotation: Domain name=Glyco_hydro_18; Domain location=227-491; Score=188.5; E_value=1.7e-53; Accession=PF00704.19; Description =Glycosyl hydrolases family 18
HKNPEADIANPLFPANSLNPFQSFNAAVVLGDDEDDAVQDSPSPSSVQKFSQDSLDSISSSFGFSSGAAGAVHHHGADVHDPVEPPRRAPDLEGAEAGRGVVGVGGEHVADEEAHGADKVVAEGADGVDGDADAGGVAGEKVLCDAEEELVVPGRVVAAELVDACSELGGGVDPRDGVGLEPPPWRRRRLHALRRDQVDLQYLKESTVVTPVEERGVKQKQKASNGGDIVVYWGQDESEGTLSETCNSGLYKIVNIGFLAKFGGGREPEINLAGHCDPASNGCKSLSKDIKNCQKRGIKVILSIGGGETGYSLSSANDATKVADYIWNNFLGGKSSKTRPLGDAVLDGVDFDIEVGGGESFYAVLARRLSQHSKGGGRKVYLTAAPQCPFPDEHQNGALSTGLFDFVWVQFYNNGPCQFESSDPTKFQKSWNQWISSIRARKIYVGLPASPSPATAGSGFVPTRTLITQVLPFVKRSPKYGGVMLWDRAADKQTGYSTNIKPSV

SEQ ID NO: 114200 - protein, 1746 aa, Glycine max
  Coding DNA Sequence Number=SeqID_22515
  Gene Ontology: Mol. function=binding; Cellular component=cytoplasm; Biological process=regulation of translation
  Homolog annotation: Hit_ID=A7PZ14; Match level="QueryCoverage=97%, HitCoverage=80%, E-value=0.0, Identity=56%"; Hit description =Chromosome chr4 scaffold_39, whole genome shotgun sequence
  Pfam annotation: Domain name=HEAT; Domain location=1024-1055; Score =5.7; E_value=3.9; Accession=PF02985.13; Description=HEAT repeat
  Pfam annotation: Domain name=HEAT; Domain location=1189-1225; Score =3.1; E_value=9.3; Accession=PF02985.13; Description=HEAT repeat
  Pfam annotation: Domain name=HEAT; Domain location=1310-1345; Score =12.0; E_value=0.43; Accession=PF02985.13; Description=HEAT repeat
  Pfam annotation: Domain name=HEAT; Domain location=1376-1413; Score =10.2; E_value=0.81; Accession=PF02985.13; Description=HEAT repeat
  Pfam annotation: Domain name=HEAT; Domain location=1418-1454; Score =21.2; E_value=0.0039; Accession=PF02985.13; Description=HEAT repeat
  Pfam annotation: Domain name=HEAT; Domain location=1456-1492; Score =3.4; E_value=8.3; Accession=PF02985.13; Description=HEAT repeat
  Pfam annotation: Domain name=HEAT; Domain location=1495-1531; Score =5.0; E_value=4.9; Accession=PF02985.13; Description=HEAT repeat
  Pfam annotation: Domain name=HEAT; Domain location=1538-1574; Score =23.4; E_value=0.00084; Accession=PF02985.13; Description=HEAT repeat
  Pfam annotation: Domain name=HEAT; Domain location=1576-1613; Score =0.6; E_value=22; Accession=PF02985.13; Description=HEAT repeat
  Pfam annotation: Domain name=HEAT; Domain location=1615-1651; Score =5.4; E_value=4.2; Accession=PF02985.13; Description=HEAT repeat
  Pfam annotation: Domain name=HEAT; Domain location=1656-1692; Score =33.1; E_value=1e-06; Accession=PF02985.13; Description=HEAT repeat
  Pfam annotation: Domain name=HEAT; Domain location=1694-1730; Score =19.8; E_value=0.01; Accession=PF02985.13; Description=HEAT repeat
  Pfam annotation: Domain name=HEAT; Domain location=222-258; Score =4.7; E_value=5.5; Accession=PF02985.13; Description=HEAT repeat
  Pfam annotation: Domain name=HEAT; Domain location=470-506; Score =0.5; E_value=23; Accession=PF02985.13; Description=HEAT repeat
  Pfam annotation: Domain name=HEAT; Domain location=613-651; Score =0.7; E_value=21; Accession=PF02985.13; Description=HEAT repeat
  Pfam module annotation: Pfam domain module=HEAT::HEAT::HEAT::HEAT::HEA T::HEAT::HEAT::HEAT::HEAT::HEAT::HEAT::HEAT::HEAT::HEAT::HEAT; Domain location=1024-1055::1189-1225::1310-1345::1376-1413::1418-1454::1456 -1492::...
  Pfam module annotation: Domain location=1495-1531::1538-1574::1576 -1613::1615-1651::1656-1692::1694-1730::222-258::470-506::613-651
  Subcellular localization annotation: CTP_CleavageSite=33; ConfidenceScore=5.14e-01
MAAESLQSLVSLSELVSTSSTNHRVRIFRREIPAFLNSSTSEMSTELASLLTDIIFRTVAIYDDLRSRKAVDDVIVKALGGTVFMKTFAGALVQNMEKQSKFQSHLPDIYKVYMEELRNGRIPFKDSPELLMLLLEFSSRSPSLFGEFKPAFLDIYVNAILSAKEKPGKSLTEAFHPLYLQMSHEDFQSIVIPSSVKMLKRNPEIVLESVGILLKSVNLDLSKYAAEILSVVLAQARHADEGRRDGALAIVQSLSQKSSNPDALDTMFNAIKAVIKGRLAFPYQRVGMVNAIQELSYAPDGKYLISLSRTICDFLLSYYKDDAIASWAVRSTDIIQESLVSFLASGLKEKETLRKGFLRSLHAICKNEDAVLKMLPLIGTLMQLVKTGFTKAVQRLDGIYALLLVAKIAAVDIKAEETLVKEKIWALISQNEPSVVPISMASKLSIEDNMTCVDLLEVLLVEHLQCTLSNFSVRLMLQLMIFFMCHPRWDIRRMAYDVARKIIPSAPQLSKDLLLEFSKYLTLIGEKHLALKTSDSDISLDPQVPFIPSVEVLVKALLIMSPAALKHAPESFFRIILCSHHPCVVGGAKIDAVWKRLSKCLQTQGFVVIDVISANVGNFLQVLLGPMGLKSANPLEQQAAILSLCNLMSIIPGDTYIEFEKNLLNLPERFAHDTLLENDIQIFLTPEGMLSTEQGVYVAESVTAKNTKQAKGRFRMYDDEDGEDHTRSNHSVRRDQPSREAAGAGKKDTGKAAKKAGNSPKLLFTYDVIVIHLDKGKTAKEEARELLLKEEASVRDRVREIQKNLSLMLRTLGDMAIANSVFAHSRLPSMVKFVEPLMRSPIVSDEAFETMVKLARCTAPPLCDWALDISTALRLIVTDEVHLLLDLVPSVTEEEFNERPHGLFERILDGLSISCKSGALPVLYHVLGVVPAYQASIGPALNELSLGLQPAEVASALYGVYAKDVHVRMACLNAVKCIPAVANRSLPENVEVATSIWIALHDPEKSVAQVAEDIWDHYGFDFGTDFSGLYKALSHINYNVRVAAAEALAAALDEHPDSIQESLSTLFSLYILDMGVGDDNVDAGWLGRQGIALALHAAADILRTKDLPVVMTFLISRALADLNADVRGRMINAGILIIDKNGKDNVSLLFPIFENYLNKTAPDEEKYDLVREGVVIFTGALAKHLAKDDPKVHAVVDKLLDVLNTPSEAVQRAVSACLSPLMQSKQDDAAALFNRLMDQMMKSEKYGERRGAAFGLAGLVKGFGISCLKKYRIVITLQESLAERNSAKSREGALLGFECLCETLGRIFEPYVIQMLPLLLVSFSDQVNAVREAAECAARAMMSQLSAQGVKLVLPSLLKENLCLLPTYRIIIYYASISMNYFIANLFAQGLEDKAWRTKQSSVQLLGAMAYCAPQQLSQCLPKIVPKLTEVLTDTHPKVQSAGQMALQQVGSVIKNPEISALVPTLLKGLSDPNEHTKYSLDILLQTTFVNSIDAPSLALLVPIVHRGLRERSADTKKRAAQIVGNMCSLVTEPKDMIPYIGLLLPEVKKVLVDPIPEVRSVAARAIGSLIGGMGEENFPDLVPWLFDTLKSDNSNVERSGAAQGLSEVLAALGIDFFEHVLPDIIRHCSHQKASVRDGYLTLFKYLPRSLGVQFQNYLPQVLPAILDGLADENESVRDAALGAGHVLVEHYATTSLPLLLPAVEDGIFNDSWRIRQSSVELLGDLLFKVAGTSGKALLEGGSDDE

SEQ ID NO: 114201 - protein, 358 aa, Glycine max
  Coding DNA Sequence Number=SeqID_22516
  Gene Ontology: Mol. function=protein binding; Cellular component=SCAR complex; Biological process=cortical actin cytoskeleton organization and biogenesis
  Homolog annotation: Hit_ID=A7PZ47; Match level="QueryCoverage=97%, HitCoverage=97%, E-value=1e-178, Identity=91%"; Hit description =Chromosome chr4 scaffold_39, whole genome shotgun sequence
MAVPVEEAIAALSTFSLEDEQPEVQGPGVWVSTERGATESPIEYSDVSAYRLSLSEDTKALNQLNALTQEGKEMASVLYTYRSCVKALPQLPDSMKQSQADLYLETYQVLDLEMSRLREIQRWQASASSKLAADMQRFSRPERRINGPTISHLWSMLKLLDVLVQLDHLKNAKASIPNDFSWYKRTFTQVSGQWQDTDSMREELDDLQIFLSTRWAILLNLHVEMFRVNNVEDILQVLIVFVVESLELDFALLFPERHILLRVLPVLVVLVTSSEKDSESLYKRVKINRLINIFKNEAVIPAFPDLHLSPAAILKELSTYFPKFSSQTRLLTLPAPHELPPREAQEYPPNCFMFLPIN

SEQ ID NO: 114202 - protein, 478 aa, Glycine max
  Coding DNA Sequence Number=SeqID_22517
  Gene Ontology: Mol. function=binding; Cellular component=chloroplast; Biological process=transport
  Homolog annotation: Hit_ID=A7QW26; Match level="QueryCoverage=90%, HitCoverage=91%, E-value=1e-167, Identity=66%"; Hit description =Chromosome undetermined scaffold_197, whole genome shotgun sequence
  Pfam annotation: Domain name=VDE; Domain location=195-392; Score =549.1; E_value=4.7e-162; Accession=PF07137.2; Description =Violaxanthin de-epoxidase (VDE)
MAMWGGHSMLLTNGEGTGTPNVRIKAGLTVRGDLRFHRTAGFKYGPSVVVLKVFSTAKRPTRLRLIRPYCSLRGQHNQGKGYSSLTSTQKPRQLMLKFEADRMLVFLKDWSNIRITAVAAILVSILMIIPPADAVDALKTCACLLKDCRIELAKCLSNPSCAANIACLQTCNNRPDETECQIKCGDLFENSVVDEFNECAVSRKKCVPKKSDVGEFPAPNPDVLVNSFNIADFSGKWFITSGLNPTFDTFDCQLHEFHTESNKLVGNLSWRIRTPDAGFITRSAEQRFVQDPSYPGILYNHDNEYLHYQDDWYILSSKIENKPDDYVFVYYRGRNDAWDGYGGAVIYTRSAVLPESIVPELEKAAKSVGRDFSTFIRTDNTCGPEPSLVERLEKKVEEGEETIVREVEQLEEEVEKVGKTEATLFQKLAEGFKVFQEDEENFLRGLSKEEMEILDGLKMEAGEVEKLFGRALPIRKLR

SEQ ID NO: 114203 - protein, 244 aa, Glycine max
  Coding DNA Sequence Number=SeqID_22518
  Gene Ontology: Cellular component=endosome membrane; Biological process=protein transport
  Homolog annotation: Hit_ID=A7P2R4; Match level="QueryCoverage=58%, HitCoverage=20%, E-value=1e-62, Identity=85%"; Hit description =Chromosome chr1 scaffold_5, whole genome shotgun sequence
MADVAGATVSPSIGETNDAQKNVFDLGAFVGDLTLEDDPSSDDISLEGLEQELEECKNNDVVANILSKGTKLRDYTKGVENDLRKVELDSIQDYIKESDNLVSLHDQIHDCDSILSQMETLLSGFQAEIGSISSDIKILQEKSMDMSLRLKNRKNTITPISGHTGIPITKSIYGLIPPLYKNPDLILSKCLSHVQQKKIASSINFCPLNSSFENTILFLRFQMHHVRATHQIHHLFWTIPIALQ

SEQ ID NO: 114204 - protein, 354 aa, Glycine max
  Coding DNA Sequence Number=SeqID_22519
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=77%, HitCoverage=43%, E-value=1e-93, Identity=57%"; Hit description =Chromosome undetermined scaffold_127, whole genome shotgun sequence
  Pfam annotation: Domain name=Response_reg; Domain location=153-269; Score=98.5; E_value=2.1e-26; Accession=PF00072.15; Description =Response regulator receiver domain
MEIAANDNGSFQLEMKPFHLHSMMREASCTAKCLCIYKGFGLEVDVDKSLPDLVIGDEARTFQINGISSQSDESVSTRNYTGRRHYNNEPKEGLSFSMCKTLVQMMQGNIWISTNSLGLAQGMTLLLKFQIGSSHGRFTLAPTDFSNSQFRGLKVVLADDDDVNRTVTKKLLEKLGCQVTAVSSGFECLGAISGSGNSFKIILLDLHMPEMDGFEVARRIRKFQSHNWPLIIAFTASAEEHIKERCLQVGMNGLIRKPILLREIADELGTVLQRAVVSGLLLLAPPERLQRLNNPNRPGPLREPHSFIVTEIYASTWLYNVLVANLLPRKSKVRSRVSKSSGACPGKWGGRQWR

SEQ ID NO: 114205 - protein, 504 aa, Glycine max
  Coding DNA Sequence Number=SeqID_22520
  Gene Ontology: Mol. function=calcium ion binding; Cellular component =mitochondrion; Biological process=protein amino acid dephosphorylatio n
  Homolog annotation: Hit_ID=A7Q1Q6; Match level="QueryCoverage=99%, HitCoverage=98%, E-value=1e-177, Identity=62%"; Hit description =Chromosome chr7 scaffold_44, whole genome shotgun sequence
  Pfam annotation: Domain name=efhand; Domain location=360-388; Score =20.9; E_value=0.0048; Accession=PF00036.23; Description=EF hand
MEVISDTASLEVDLLQLPEVSSLALKSNLTFVETLFEQWLSLPESNRLVTSLVNEAKSGAPLNVPGNCSSPNAASNSLPSMFPAGTAPPLSPRSTSGSPRIVKQRVGPSNLGSPLKVVSEPVKEVIPQILCGSLVVLGVKPEVTVAECYFSSIGQAYAPIMVPYIVCPRDSLWDDFKPVLCELLATHPGLEFLQSTPEFQERYGLSSILVITLHLGACTCSSMLELLFVDAETVIYRIYYYINRSGNGRLTLRELKRGNIIDAMLHADEEEDINKVLRYFSYEHFYVIYCKFWELDTDHDFLIDKENLIRYGNHALTYRIVDRIFSQVPRRFTSKVEGKMGYEDFVYFILSEEDKSSEPSLEYWFKCIDLDGNGVLTRNELQFFYEEQLHRMECMAQEPVLFEDILCQIIDMIGPEEESYITLRDLKGGKLSGSVFNILFNLNKFMAFETRDPFLIRQERENPTLTEWDRFAHREYIRLSMEEDVEDASNGSAEVWDESLEAPF

SEQ ID NO: 114206 - protein, 400 aa, Glycine max
  Coding DNA Sequence Number=SeqID_22521
  Gene Ontology: Mol. function=receptor activity; Cellular component =cytoplasm; Biological process=protein transport
  Homolog annotation: Hit_ID=A7QMV8; Match level="QueryCoverage=88%, HitCoverage=31%, E-value=1e-133, Identity=67%"; Hit description =Chromosome chr14 scaffold_128, whole genome shotgun sequence
MGSRGVLCSPSLEHHMDSSLGDIDFQTQGPCLHDVSVNVLDSFIRNSWRELATVFSTEKTLLLLDTAHQRSLAQTLVRSASGIRNSEASSQYVRNLMGPIATYIVEISSKSNFKSIAQQPDILLSVSCMLERLRGAASASEPRTQKAIYDLGFSVMNHILVFLEVYKHESAVVYLLLKFVVDWIDGQITYLEAQETAAVVNFCMRLLQLYSSHNIGKISLSLSSSLLSEAKTDKYRDLRALLQLLSSLCSKDMIDFSSDSIEAQGTNISQVVYFGLHMVTPLISMDLLKYPKLCHDYFSLLSHMLEVYPETFAQLNSEAFAHILGTLDFGLHHQDADVVSKCLRALQALASYHYKETGSGNIGLGAHTVGHKDSSGNVQEGLLNRFLRSLLQLLLFEDYR

SEQ ID NO: 114207 - protein, 184 aa, Glycine max
  Coding DNA Sequence Number=SeqID_22522
  Homolog annotation: Hit_ID=A7QMV1; Match level="QueryCoverage=72%, HitCoverage=68%, E-value=1e-52, Identity=75%"; Hit description =Chromosome chr14 scaffold_128, whole genome shotgun sequence
  Pfam annotation: Domain name=DUF640; Domain location=12-144; Score =290.9; E_value=2.6e-84; Accession=PF04852.3; Description=Protein of unknown function (DUF640)
  Subcellular localization annotation: CTP_CleavageSite=53; ConfidenceScore=5.48e-01
MESVASPIVTCSSNNNGSGSNNSTTTTPSRYENQKRRDWNTFCQYLRNQRPPLSMAVCGGAHVLEFLQYLDQFGKTKVHNPTCPFFGLPNPPAPCPCPLRQAWGSLDALIGRLRAAYEENGGRAETNPFGARAVRFYLHDVRDFQAKARGVSYEKKRKRPKQQNIANAAATSVTTSPNATATAT

SEQ ID NO: 114208 - protein, 533 aa, Glycine max
  Coding DNA Sequence Number=SeqID_22523
  Gene Ontology: Mol. function=binding; Cellular component=nucleolar preribosome, small subunit precursor; Biological process=carboxylic acid metabolic process
  Homolog annotation: Hit_ID=A7P6A5; Match level="QueryCoverage=82%, HitCoverage=55%, E-value=1e-150, Identity=61%"; Hit description =Chromosome chr9 scaffold_7, whole genome shotgun sequence
  Pfam annotation: Domain name=PUF; Domain location=220-254; Score=7.0; E_value=1.8; Accession=PF00806.10; Description=Pumilio-family RNA binding repeat
  Pfam annotation: Domain name=PUF; Domain location=300-335; Score=3.8; E_value=4.4; Accession=PF00806.10; Description=Pumilio-family RNA binding repeat
  Pfam annotation: Domain name=PUF; Domain location=394-426; Score =26.8; E_value=7.8e-05; Accession=PF00806.10; Description=Pumilio -family RNA binding repeat
  Pfam module annotation: Pfam domain module=PUF::PUF::PUF; Domain location=220-254::300-335::394-426
MSEESKKKQAWVRERRGDSGETVGEKQPQPESKVLQSLMVSIGSKTLVSRSSMGEHDYEPLKQGKTKRRKHKKGGSTHAFDSNSFTSPPQLSRVRKQLDPETTQYFSEISNLFESDGVELEDRSLICANALEETKGKEFEIATDYILSHTLETILQGCDVHHLCDFLHTSANHFPYIAMDRSGSHVAETSIKSLAVHLQDDDDVVRPLVEEALTMICKVVIAANSVDVMCNCYGSHVLRTLLCLCRGVPLDKSGYYLSKSTTVLADRLNSKEFSSKKYDATNFQPGFPNLLKSLVSDMLKHAKKCIKILQVDQFSSLVFQTVLRVLAGDDEELLHVIPILLGCKDKNNAEDNFIGTRVVAELKNLLKESKFSHLMEVVLEVSPEALFNELFTKVFRNSLFELSSHQHGNFVVQALISYASNQDLIFSQMELIWEELGPNLEGLFKMGRSGVVASLVAASERLHINEHKCCQVLAEAVCPVDESPKWIVPRLLFLDSCFTSEDKSNWSWQSGSKMHVMGSLILQTVFRFRSVQI

SEQ ID NO: 114209 - protein, 504 aa, Glycine max
  Coding DNA Sequence Number=SeqID_22524
  Gene Ontology: Mol. function=potassium ion transmembrane transporter activity; Cellular component=membrane; Biological process=potassium ion transport
  Homolog annotation: Hit_ID=Q5MWW0; Match level="QueryCoverage=99%, HitCoverage=71%, E-value=1e-83, Identity=57%"; Hit description=High -affinity K+ transporter
  Pfam annotation: Domain name=K_trans; Domain location=68-504; Score =397.7; E_value=1.8e-116; Accession=PF02705.7; Description=K+ potassium transporter
MSGEADRTSIEEEVDTGKETAEKNLMKPKDPKVPWAKLRRVDSLNLEAGRVSMVAHDPYQMDWRTTLSLAFQSIGVVYGDIGTSPLYVYASTFTKKINNTDDILGVLSLIIYSIVLIPLLKYVFIVLWANDNGNGGAIALYSLIFRHIKMSLIPNQQPEDRELSNYKLETPSTEFKRAQKLKQKLEDSHVARIVLLLLAIMGTSMVIGEGILTPSISVLSAVSGISTSLGQDAAVGITIAILAVLFYVQRFGTDKISFSCITCPAIVVAYIGQAAFLRKFPEKVANTFYDSVPDPLYWPTFVVAFAAAIIASQAMISGAFSIISQAISLGCFPRVRVVHTSVKHQGQVYIPEVNYMFMIACIVVCAAFKTTEKICHAYGMAVIGDMMITTTLASLIMLVLWKKSRWRVGVFFLGFGFIEIVYFSSQLTKFTAGGYLPIVSAMFLTAVMGIWHYVHKERYMFELKNKVSSAYLNEVANNPDVRRVPGIGLLYELILGHSNILFNH

SEQ ID NO: 114210 - protein, 312 aa, Glycine max
  Coding DNA Sequence Number=SeqID_22525
  Homolog annotation: Hit_ID=A7P6G3; Match level="QueryCoverage=83%, HitCoverage=88%, E-value=1e-69, Identity=59%"; Hit description =Chromosome chr9 scaffold_7, whole genome shotgun sequence
MSFMFYYKVYYRCEWGEGGNTLKGKVRRKEWRDGDWKGREVFLSWMQNKIGGKQDIRKPNTYTATNDAKLVRREELSDWPDGLLAIGTFGNNNEVKEKTEKNILREDPSSSEEIADFTPEEIGKLKKELTKLLRQKPNIVEKEIAELPLDRFLNCPSSLEVDRRISNVLGSDSEDKDKDEEKEEEREKEEEEEDIEKTLSVILGKFKEICANNSKKAIGKKSISFLLKKMFVCRSGFAPAPSLRDTLQLQESRMEKLLRTILHKKINSQHSSRALSLKKRLEDRKMPKEDEAENDDGCKWVKTDSEYIVLEI

SEQ ID NO: 114211 - protein, 327 aa, Glycine max
  Coding DNA Sequence Number=SeqID_22526
  Gene Ontology: Mol. function=heat shock protein binding
  Homolog annotation: Hit_ID=A7QMU2; Match level="QueryCoverage=81%, HitCoverage=96%, E-value=3e-77, Identity=56%"; Hit description =Chromosome chr14 scaffold_128, whole genome shotgun sequence
  Subcellular localization annotation: CTP_CleavageSite=46; ConfidenceScore=5.32e-01
MALGISNILHCPKLSFSHNNFLPKVPTSISLRFPQTAAWSDRKIICAAASAAGSSNPDGEFNPYEVLGVSPIEKFDMVKAAYAKKKKEAEMNGDEATASRVVCDVIADMKTSFPSFKWVRLIVCNHVWKLKLEKAYDKLMMAQLSNRKKGVTFGSFKVSKEIKYADKLPVIPWGPRLTKSSQNDMRINLAISAVFTAWILVKRSAEYKPLQFLAFAFVYRLFEKLKASESPVTPKYNEEGEDTGEGLRMGKRLLRSLALVFGCVAISSLAYTFILNIIEFAGGFIPTLLYNSQFMWCEGVENQLKYILVYQSPVTNNTAENHPTTKN

SEQ ID NO: 114212 - protein, 585 aa, Glycine max
  Coding DNA Sequence Number=SeqID_22527
  Gene Ontology: Mol. function=histone-lysine N-methyltransferase activity; Cellular component=nucleus; Biological process=chromatin modification
  Homolog annotation: Hit_ID=A2XZC4; Match level="QueryCoverage=99%, HitCoverage=88%, E-value=1e-115, Identity=37%"; Hit description =Putative uncharacterized protein
  Pfam annotation: Domain name=Pre-SET; Domain location=337-485; Score =18.3; E_value=1e-05; Accession=PF05033.7; Description=Pre-SET motif
  Pfam annotation: Domain name=SET; Domain location=487-585; Score =26.2; E_value=8.8e-06; Accession=PF00856.19; Description=SET domain
  Pfam module annotation: Pfam domain module=Pre-SET::SET; Domain location=337-485::487-585
MAPNPRVNKAFSFMKALGISDKDVKPVLIKLFRVYEGNWELIEDDNYHTLVDAYFDFEKHKGVEGERKANDSCHGGEKPKRGPLLVDDDDDDKDLQTMDSSSQMLSAEDNKISPKTFEQKIIEPSQTFMKDIKPKTSSQASHTMLSEVEKISNLPRVAAKDRKSYPENASSAVEKVLVKPRTKKLKMQLASTNHIGLPDASDEKLCLKPLSTQDQDMESKDDVISACDRNTPAYNGNITIASSSRLGEVKISLNCDSALGQPNFSIPNLDIVMKFMDKKYIRSCNTVEPQFSMAKLLDDLCRIYLKLGYRKGSNSKRANLQQYVNQGERNPFRFISDITKGSEKVKISLIDETGSEDLPKFNYIPCNITYQSANVNISLARISDEGCCSDCSGNCLSSPLPCACAQETGGEFAYTPHGLLKEEFLTACVSMKNEPQDHHYVYCQECPLEKSKNEYMPERCKGHMVRKFIKECWRKCGCDMQCGNRIVQRGIACKLQVFSTREGKGWGLRTLEDLPKGTFVCEYVGEILTNMELYERIMQDTGNERHTYPVTLDADWGSEQGLKDEEALCLDATKNGNVGRFINHR

SEQ ID NO: 114213 - protein, 863 aa, Glycine max
  Coding DNA Sequence Number=SeqID_22528
  Homolog annotation: Hit_ID=A7QVM9; Match level="QueryCoverage=52%, HitCoverage=99%, E-value=1e-100, Identity=47%"; Hit description =Chromosome chr14 scaffold_190, whole genome shotgun sequence
  Pfam annotation: Domain name=DUF593; Domain location=528-621; Score =164.7; E_value=2.4e-46; Accession=PF04576.6; Description=Protein of unknown function, DUF593
MANTKISSSEWRKLSPSVTTALASAFLEWLLILFLFIDAVFSYVITKFAGYCKLQIPCLLCSRLDHVLGKEKGGYYWDLICSGHKTEISYLVLCCAHDKLVNVQGMCESCLFSFATINKSNAETYRLLVGKLGEGSETRFDQDPLLGENSKCCSCCNEQLVLKGYDQRLVITKSIGSGSADFDGSNVVGNKFHKKRRVKPFVSSRAAHLRNKHADPLSHVGYTELKITSDTESEPDVSLFDDDGTSIPVQGTDDTKEDIEVSCEHMEPHIPDSNENLAFEKLGTSASGLQPSLSESGMRLENIDVHGTKSTATTESRDGLAKLDSQQHVERNDVCPSPRELISFNEVPASSNKIGVPVEVSKENYDLTTDEVGIKSKQRITTDCGGIIESVDKPTTSEVGLESTPFSSDIGQQNPNLLDLGDAYKLAVSNSRGRPGMLVEHWLGKDSTRISEDLKILLSQFSATRGTDLSVNDISPRLSINSDEVKTCDVSNSAGIQILQKMISLERNESGLSLDGSLVSEIEGESAVDRLKRQVDHDRKLMNALYKELEEERNASAVAANQALAMITRLQEEKATLHMEALQYLRMMDEESEYETEALQKANDLLVEKEKEIEELEAKLEFYRKKFPDESVLENMVDTNSEMKVKDIGLDHCIEKDESILGKSVTENTNISDKAEVLSTSLEKQNVQSIKNSPLEFQDERLYISQCLKKLEKQVYFFLNIHQSQDNWLNSENDEKESLENCENLDNNILIQESVSSPKLNLDNMGDDSSSKEPPVCKKIGELGYNGHSSLALGGNNDLSSTGSLVSDFIGRLQVLEADLSFLKHSINLSSNGEEGLKLLQEIAGHLQQLRQIGIRELDQPVA

SEQ ID NO: 114214 - protein, 1039 aa, Glycine max
  Coding DNA Sequence Number=SeqID_22529
  Gene Ontology: Mol. function=protein serine/threonine kinase activity; Cellular component=myosin complex; Biological process =protein amino acid phosphorylation
  Homolog annotation: Hit_ID=A7QVN7; Match level="QueryCoverage=100%, HitCoverage=72%, E-value=0.0, Identity=78%"; Hit description =Chromosome chr14 scaffold_190, whole genome shotgun sequence
  Pfam annotation: Domain name=DIL; Domain location=876-964; Score =131.6; E_value=2.2e-36; Accession=PF01843.10; Description=DIL domain
  Pfam annotation: Domain name=IQ; Domain location=268-288; Score=24.2; E_value=0.00047; Accession=PF00612.18; Description=IQ calmodulin -binding motif
  Pfam annotation: Domain name=IQ; Domain location=291-311; Score=17.2; E_value=0.064; Accession=PF00612.18; Description=IQ calmodulin -binding motif
  Pfam annotation: Domain name=IQ; Domain location=316-336; Score=24.8; E_value=0.00033; Accession=PF00612.18; Description=IQ calmodulin -binding motif
  Pfam annotation: Domain name=IQ; Domain location=339-359; Score=5.6; E_value=11; Accession=PF00612.18; Description=IQ calmodulin-binding motif
  Pfam annotation: Domain name=IQ; Domain location=364-384; Score=22.8; E_value=0.0013; Accession=PF00612.18; Description=IQ calmodulin -binding motif
  Pfam annotation: Domain name=IQ; Domain location=387-407; Score=17.4; E_value=0.053; Accession=PF00612.18; Description=IQ calmodulin -binding motif
  Pfam annotation: Domain name=Myosin_head; Domain location=1-252; Score=-206.5; E_value=4.5e-08; Accession=PF00063.12; Description =Myosin head (motor domain)
  Pfam module annotation: Pfam domain module=DIL::IQ::IQ::IQ::IQ::IQ::IQ ::Myosin_head; Domain location=876-964::268-288::291-311::316 -336::339-359::364-384::387-407::1-252
MEQEEYKKEQIDWSYIEFVDNQDVLDLIEKKPGGIIALLDEACMFPKSTHETFSNKLYQTFKNNKRFIKPKLSRTDFTISHYAGEVQYRSDQFLDKNKDYVVPEHQDLLGASKCPFVAGLFPPLPEETSKSSKFSSIGSRFKLQLQQLMEILSSTEPHYIRCVKPNNLLKPAIFENANIIQQLRCGGVLEAIRISCAGYPTRRAFFEFVNRFSLLAPDVTEAHHDEKIVCQKILEKAGLKGYQIGKTKVFLRAGQMAELDAQRAKKLSNAAKTIQRRIRTHQARKHYLELRNKTIYMQSVCRGRLAFKLYQHKRREAAAVKIQKNIRRYEARNTYIKLQASVLTLQTALRAIASLKEFRFRKQTKASIIIQARWRCHKAASYYKKLKKGSIVTQCRWRGRMGRKELRKMKMAARETGALKDAKDKLEKRVEDITWRLQLEKSLRTNLEESKSQEIAKLKNALQEMQNKVDESNALLIKERENAKKAIEEAPPVVKEIQVIVEDTQKIESLTLEVESLKTSLESEKQKADEKYNEAQACSEERGKKLEDTEKKVRQLQESLARLEEKITNLESENQVLRQQALSMAPNKFLSGRSRSIIRRTDSGHLGVEAKTTLDMHSTSMNHRESSEVEDKPQKSLNEKQLENQDLLIKFIPKQIGFAGNRPIAACIIYKCLLHWRSFEVDRTSVFDRIIQTIGHSIETQDNNDVLAYWLSNTSTLVLLLQRTLKASGAAGMAPQRRRSSSGTVFGRMTHSFRGTPAGVNLSLINGSMSGGIDASRQVEAKYPALLFKQQLTAYVEKIYGMIRDNLKKEISPLLGLCIQAPRTSRASFVKGSSRSAATTEAQKALIGHWQEIVKSLGNFLNTLKANHVPPFLVRKVFTQIFSFINVQLFNSLLLRRECCSFSNGEYVKSGLAELENWCNNATDEVIHQKPRKTLNEITHELCPVLSIQQLYRISTMYWDDKYGTHSVSPDVISNMRVLMTEDSNNAVSNSFLLDDDSSIPFSVDDISKSKEPIDISDIEPPPVIRDNTGFSFLLPHPD

SEQ ID NO: 114215 - protein, 359 aa, Glycine max
  Coding DNA Sequence Number=SeqID_22530
  Gene Ontology: Mol. function=oxidoreductase activity; Cellular component=cytosol; Biological process=auxin mediated signaling pathway
  Homolog annotation: Hit_ID=A9NNQ6; Match level="QueryCoverage=96%, HitCoverage=97%, E-value=1e-127, Identity=65%"; Hit description =Putative uncharacterized protein
  Pfam annotation: Domain name=Aldo_ket_red; Domain location=12-327; Score=211.0; E_value=2.8e-60; Accession=PF00248.12; Description =Aldoketo reductase family
MGATKSGRVKLGTQGLEVVSKLGFGCLGLTGAYNEPLPEQDGISIIKYAFSKGITFFDTADVYGAGANEILLGKALKQLPREKIQLATKFGIARLDFSNMLIKGSPEYVRSCCETSLKRLDVEYIDLYYQHRVDTSVPIEETVKDFFLSMILIIVGELKKLVEEGKVRYIGLSEASSDTIRRAHAVHPITAVQIEWSIWTRDIEDQIVTICRELGIGIVSYSPLGRGFFGGKGILENVSASSSLKVHPRFQAENMDKNKNIYERIESLAKMHRITPAQLALAWLLQQGEDVVPIPGTTKIKNLDQNIGALAVKLSEKDLREISEAVPIGDVAGGIHYYGLEHITWKYANTPPKDSSIST

SEQ ID NO: 114216 - protein, 174 aa, Glycine max
  Coding DNA Sequence Number=SeqID_22531
  Gene Ontology: Mol. function=protein dimerization activity; Cellular component=nucleus; Biological process=regulation of transcription, DNA-dependent
  Homolog annotation: Hit_ID=A7QVQ0; Match level="QueryCoverage=91%, HitCoverage=63%, E-value=5e-71, Identity=84%"; Hit description =Chromosome chr14 scaffold_190, whole genome shotgun sequence
  Pfam annotation: Domain name=AUX_IAA; Domain location=1-166; Score =287.2; E_value=3.3e-83; Accession=PF02309.7; Description=AUXIAA family
  Subcellular localization annotation: CTP_CleavageSite=60; ConfidenceScore=5.44e-01
MCPTQAIIISQNNHPKAQVVGWPPVRSFRKNIVQRSNNNEGEKAATSSSNNVNTGAAFVKVSMDGAPYLRKVDLKLYKSYQELLDALAKMFSSFTIDKCGSQGMKDFMNESKLIDLLNGSDYVPTYEDKDADWMLVGDVPWEMFVESCKRLRIMKGSEAIGLAPRAVEKCKNRS

SEQ ID NO: 114217 - protein, 394 aa, Glycine max
  Coding DNA Sequence Number=SeqID_22532
  Gene Ontology: Mol. function=protein serine/threonine kinase activity; Biological process=protein amino acid phosphorylation
  Homolog annotation: Hit_ID=A5C5B1; Match level="QueryCoverage=93%, HitCoverage=62%, E-value=2e-96, Identity=52%"; Hit description =Putative uncharacterized protein
MNHELGTIFVSSMTDLAFKRCLAAELLGHHHLQPYVLKVHLKINSPRRSTLPESNYMKKTRFLKSEDDHVSLSGNKWHSFSYDRTLNPSVSGAEQDSLCSTLEIDCTPDNLNQRFAELSVGDNPDVKSLHKPAVSRTSINAKTPRLAASKASATPKKSMVFSKNHKTLPVSYNTKEPVHTTRRASLPFPRSCAIQQPPRRPSIGLLDHVNSPNISVNSPRIDRIAEFPLASYEDQLFPINRSSPNSAQGSAGSPCGNDSTLIDKCTIKVCDTSYVRPGCTDAWQGIKRSRFKKNDEDKSGSSDQNATTGASSHNSSDLRRRQFDTSSFRQRAEALEGLLEFSARLLQQERYGELGVLLKPFGPGKASPRETAIWLSKSLKENTFSAGNNSPKLL

SEQ ID NO: 114218 - protein, 308 aa, Glycine max
  Coding DNA Sequence Number=SeqID_22533
  Gene Ontology: Mol. function=tRNA-pseudouridine synthase activity; Cellular component=nucleus; Biological process=tRNA pseudouridine synthesis
  Homolog annotation: Hit_ID=A7Q5Y2; Match level="QueryCoverage=99%, HitCoverage=44%, E-value=1e-115, Identity=68%"; Hit description =Chromosome chr14 scaffold_54, whole genome shotgun sequence
MAMKTAEEHEVGISCFISDLPGFRGILKQRYSDFIVNEVDRDGTVVQLSSLDAPQEEPESSQENGTNTSDNVVSYASQIESFKSLAGDSDAVLLEEFINKINAGGEDGVSPIVLSPDSDKSHRKAMHNFFKENFKFLVTDVVDGPDASSKCIRVRLNSAEPNNKGKNSKKRKERGDKPFDSRGSENWPKNVGKFLRFHLYKENKDTHEALGVIGNMLSVQPKSFGFAGTKDKRAVTTQRVTVYKQRASRLASLNKRLFGIKLGDFCFIFVSIALTYFLRGIVADSEDIIKASADALGRHGFINYFGLQ

SEQ ID NO: 114219 - protein, 84 aa, Glycine max
  Coding DNA Sequence Number=SeqID_22534
  Homolog annotation: Hit_ID=A7Q5W5; Match level="QueryCoverage=83%, HitCoverage=24%, E-value=2e-28, Identity=90%"; Hit description =Chromosome chr14 scaffold_54, whole genome shotgun sequence
  Pfam annotation: Domain name=DUF1517; Domain location=2-84; Score= -160.4; E_value=0.0056; Accession=PF07466.2; Description=Protein of unknown function (DUF1517)
MEGTDNLFLVDFIILYITILAAAEGDHKLPSINGSGDLKQALQKLGSIPSSRLLAVEVLWTPQNENDTLSERELLEDYPLLRPL

SEQ ID NO: 114220 - protein, 452 aa, Glycine max
  Coding DNA Sequence Number=SeqID_22535
  Gene Ontology: Mol. function=transferase activity; Biological process= paclitaxel biosynthetic process
  Homolog annotation: Hit_ID=A4F1S1; Match level="QueryCoverage=95%, HitCoverage=93%, E-value=1e-159, Identity=63%"; Hit description =Putative acyltransferase
  Pfam annotation: Domain name=Transferase; Domain location=14-444; Score=471.8; E_value=8.9e-139; Accession=PF02458.6; Description =Transferase family
MASSSPSPSPSPMFTVRRLQPELVAPAIPTPHELKPLSDIDDQEGLRFHIPMIQVYRNQPSMAEKDPVQVIRKALAKTLVFYYPFAGRLRERPDHKLMVDCTGEGVLFIEADADVTLDQLGDALQPPFPCFEQLLYNVPDSEEITDTPLLLIQVTRLKCGGFIQALRLNHTMSDAAGLVQFLNAWAEMAGGAKSPSIAPVWRRELLMARDPPRITCKHHEYMEFVDTEIEEGSLTLHDDDMVLRSFFFGPSQIASLRRLVPHYCATFDLITACLWRCHTKALKIDADKDVRMMVAVNARAKFNPPLPVGYYGNAIAYPAAVTTAGKLCGNPFGYAVELINKVKGKATQEYMHSVADLLAIKGRYIPRMVRSLTVSDLRGFDPRQIDFGWGHALYAGPAQGGLGPFPGVTFITPFKNAKGEDGLVLPIWLPTEAMNRFSKELDGMFGFICSSL

SEQ ID NO: 114221 - protein, 688 aa, Glycine max
  Coding DNA Sequence Number=SeqID_22536
  Gene Ontology: Mol. function=protein kinase activity; Cellular component=lysosome; Biological process=protein amino acid phosphorylation
  Homolog annotation: Hit_ID=A7Q5S9; Match level="QueryCoverage=93%, HitCoverage=89%, E-value=0.0, Identity=68%"; Hit description =Chromosome chr14 scaffold_54, whole genome shotgun sequence
  Pfam annotation: Domain name=WD40; Domain location=163-201; Score =26.5; E_value=9.5e-05; Accession=PF00400.23; Description=WD domain, G-beta repeat
  Pfam annotation: Domain name=WD40; Domain location=205-243; Score =39.6; E_value=1.1e-08; Accession=PF00400.23; Description=WD domain, G-beta repeat
  Pfam annotation: Domain name=WD40; Domain location=247-285; Score =22.0; E_value=0.0022; Accession=PF00400.23; Description=WD domain, G- beta repeat
  Pfam annotation: Domain name=WD40; Domain location=288-324; Score =1.4; E_value=22; Accession=PF00400.23; Description=WD domain, G-beta repeat
  Pfam annotation: Domain name=WD40; Domain location=30-66; Score=5.3; E_value=7; Accession=PF00400.23; Description=WD domain, G-beta repeat
  Pfam annotation: Domain name=WD40; Domain location=71-110; Score =34.4; E_value=4.2e-07; Accession=PF00400.23; Description=WD domain, G-beta repeat
  Pfam module annotation: Pfam domain module=WD40::WD40::WD40::WD40::WD4 0::WD40; Domain location=163-201::205-243::247-285::288-324::30 -66::71-110
MEHCAGINCLALLTSAASDGSDYLFTGSRDGSLMSLTLIEKVNDAVVVGDSTLVSCSSDTTLKTWNALSFGTCTRTLRQHSDYVTCLAAAGKNSNIVASGGLGGEVFIWDIEAALTPVSKCNDATVDESSNGINGSGNVLPLTSLRPINSSNNMSMHTTQTQGYIPIAAKGHKDSVYALAMNESGTILVSGGTEKVVRVWDARSGSKTLKLRGHTDNIRALLLDSSGRYCLSGSSDSMIRLWDIGQQRCVHSYAVHTDSVWALASTPTFSHVYSGGRDFSLYLTDLQTRESSLLCTGEHPILQLALHDDSIWIASTDSSVHRWPAEGYDPQKIFQRGNSFLAGNLSFSRARVSIEGSTPVPVYKEPILTILGTPAIVQHEVLNNKRHVLTKDASGSVKLWEITKGVVIEDYGKVLFEEKKEELFEMVSIPAWFTVDTRLGSLSVHLDTPQCFSAEMYSADLNVVGKPEDDKINLARETLKGLLAHWLRKRKQRMGSPAPANGELLSGKDISSRSLAHSRIEVDGSSENDAMVYPPFEFSVTSPPSIITEGTHGVALSHMVVVERSKPCLCSFYLQPCEGSSVQILTQGKLSAPRILRVHKVINYVIEKMVLDKPLDSLSGDGSFAPGLTGSQSQLQAVGDGSFRSGFKPWQKLRPSIEILCNNQASSLLSTCLICNLMTVHIAWFSRC

SEQ ID NO: 114222 - protein, 1243 aa, Glycine max
  Coding DNA Sequence Number=SeqID_22537
  Gene Ontology: Mol. function=acyltransferase activity; Cellular component=plastoglobule; Biological process=metabolic process
  Homolog annotation: Hit_ID=A7Q5S8; Match level="QueryCoverage=48%, HitCoverage=70%, E-value=1e-134, Identity=69%"; Hit description =Chromosome chr14 scaffold_54, whole genome shotgun sequence
  Pfam annotation: Domain name=DAGAT; Domain location=551-723; Score= -200.5; E_value=0.061; Accession=PF03982.4; Description =Diacylglycerol acyltransferase
  Pfam annotation: Domain name=Thioesterase; Domain location=125-352; Score=-49.0; E_value=0.099; Accession=PF00975.11; Description =Thioesterase domain
  Pfam annotation: Domain name=dsrm; Domain location=685-751; Score =69.2; E_value=1.4e-17; Accession=PF00035.16; Description=Double -stranded RNA binding motif
  Pfam annotation: Domain name=dsrm; Domain location=771-836; Score =75.5; E_value=1.7e-19; Accession=PF00035.16; Description=Double -stranded RNA binding motif
  Pfam module annotation: Pfam domain module=DAGAT::Thioesterase::dsrm:: dsrm; Domain location=551-723::125-352::685-751::771-836
MALVTGFLASHVGAVRHHRFEVGIGVRAVSSSESETVAAVNGSSSRNGSLLLKEEKKVPFLRVEEKKNKRGEEEEEGLAALWDDGYGRRSVEDYFAAAKEMCKSDGGPPRWFCPLECGPPFKDSPTLLFLPGMDGTGLGLTLHHQALGKAFEVRCLHIPVHDRTPFEGLVKLVGEAVKLECALSPNKPIYLVGDSFGGSLALAVAARNPTVDLVLILANPATSFGQSQLQPLFPFMEALPDELHVAVPFLLSFIMGDPVKMASVNIDNKLPPAKKIEQLSYNLTALLPCLPELADIIPRDTLLWKLKLLKSAAAYANSRIHAVKAEVLDNMLPSINEAQRLMGLLQNCKVRVFKDSGHTLLLEDGIGLLTIIKGTCMYRRSRRHDLVRDFIPPSMTEFRYAMDQVVGMLQPYEISIGLKEHSNPVTPKAYTPKSPSGPLPPDSDSSGFLRERKRLQCEGCFSQFRHDIKIPNGENARNSVSNMILKFHDDPTVNGFEIVIFLRLLVFPKFKADMLLMYGRSFRSVTGSVFFSTLEDGKITKGLSGVPDEGPVLYVGYHMLLGLELISLTDGFLSEKGIVLRGIAHPELFRPKVESWSSEFSMIDWVKIFGGVPVSASNIFKLLSTKSHVLLYPGGAREALHYKGEAYKLTWPDHPEFVRMAARFGATIVPFGAVGEDDLAEVDMYKNRLQELAQRSCFNLPAYSCIREGPDHAPRFKATVNFNGETFESPTFCSTLRQAEHAAAEVALNTLAKRGPSRALAARVLDETGVYKNLLQETAHRAGLNLPVYTTIRSGPGHGPNFSCTVEIAGMHFTGDPSRTKKQAQKNAAMAAWSALRKCEHFASVDLTTYNLFVLNFILVSEHHLSSSTSSSFSLESKGNEEQEQVIIARVLASLHPSGSKNFSKSDIQLGWQKSTTTSLVSTQPTTDLYPMHCQHFGISSFSPEVALYQIWQQQQIMQQQNRLLALTIQPIIPSTSQIYPLMQSVFQPDHCLYFPARELASVPVGPKLSIPSSSPSFYSSNQIGPELNTGRSTLTIKEIQEEKIEDPPVCSFSNETRVLTPATEDESQRHGGSGSRSINAELGGEHCEKSECDSHWGTGSVHRPVNPELQNPSSIDSSVLRAHSQASSNRSFRPPAASSSSIVRTMCPTSFVGSRPQHVAPRLRTGTPRSPGIPIYERFGMIRAPTPLFMAPAVRIRSVVPVCSAPPRRSMAEVSQSKEKEDLKPEDKEVPRTSSELGHLRI

SEQ ID NO: 114223 - protein, 578 aa, Glycine max
  Coding DNA Sequence Number=SeqID_22538
  Gene Ontology: Mol. function=protein binding; Cellular component =nuclear pore; Biological process=protein import into nucleus, docking
  Homolog annotation: Hit_ID=A7Q5S1; Match level="QueryCoverage=97%, HitCoverage=46%, E-value=0.0, Identity=71%"; Hit description =Chromosome chr14 scaffold_54, whole genome shotgun sequence
MHLQGLAYGAILLVGIADTMGCLQREGRLLQGEHNLLGEAFLVMASSAGIQQQQDVLRWLLEPLSIQWTQSEWQDKYLSGPHGLVQLCSDAPVMWSIFHTLTFFERALKRSGLKKANWNSENSSTPNSTPLNPMASHISWMVTPLLKLLRCIHSLWSPSVSQALPGEVRAAMVMGDVERFSLLGEGNSKLPKGVTDGSKVDMNKEGYAEPNESDIRNWFKGIRDSGYNVLGLSTTVGDSFFKYLDVHSVAVALMENIQSMEFRHIRQLVHSTLIPLVKNCPLDMWEIWLEKLLHPLFVHAQQALSCSWSSLLQDGRAKVPDVHDILSGSDLKVEVMEETILRDLTREMCSLLSVIASPPLNTGIPSLEQSGHVSRLDMSSLKNLDTVASCSMVGFLLKHEGLALPTLRMCLEAFTWTDGEAVTKISSYCSALVVLAIVTNHAELIEYVSRDLFTSIIKGLALESNAIISADLVGICREIFVYLCDRHPAPRQVLMSLPNITTHDLVAFEESLTKTFSPKEQKQLTRSLFQLATGNKLKALAAQKTVNIITNVSTRPRPANAPESKVDDGDVVGLAAIM

SEQ ID NO: 114224 - protein, 737 aa, Glycine max
  Coding DNA Sequence Number=SeqID_22539
  Gene Ontology: Mol. function=translation initiation factor activity; Cellular component=eukaryotic translation initiation factor 2B complex; Biological process=regulation of translational initiation
  Homolog annotation: Hit_ID=A7QDQ9; Match level="QueryCoverage=92%, HitCoverage=99%, E-value=0.0, Identity=69%"; Hit description =Chromosome chr15 scaffold_82, whole genome shotgun sequence
  Pfam annotation: Domain name=Hexapep; Domain location=346-363; Score =18.1; E_value=0.032; Accession=PF00132.15; Description=Bacterial transferase hexapeptide (three rep
  Pfam annotation: Domain name=Hexapep; Domain location=369-386; Score =21.2; E_value=0.004; Accession=PF00132.15; Description=Bacterial transferase hexapeptide (three rep
  Pfam annotation: Domain name=Hexapep; Domain location=409-426; Score =6.2; E_value=26; Accession=PF00132.15; Description=Bacterial transferase hexapeptide (three rep
  Pfam annotation: Domain name=NTP_transferase; Domain location=24-223; Score=-79.5; E_value=0.012; Accession=PF00483.14; Description =Nucleotidyl transferase
  Pfam annotation: Domain name=W2; Domain location=654-736; Score=95.9; E_value=1.3e-25; Accession=PF02020.9; Description=eIF4-gammaeIF5eIF2 -epsilon
  Pfam module annotation: Pfam domain module=Hexapep::Hexapep::Hexapep:: NTP_transferase::W2; Domain location=346-363::369-386::409-426::24 -223::654-736
MGAQKKSGARVSEDPDELVRVPLQAVLLADSFTTKFRPITLERPKVLLPLVNVPMINYTLTWLESAGVEEVFVFCCSHSKQVISYLEKSEWLSQPNFTVTTVESQNSVSAGDALRVIYERNVIHGDFVLISGDTVSNMSLTQALLEHKERKKKDSNAVMTMVIKRSKPNPAIHQSRLGTDELFMAIDPNTKQLLYYEDRADQSKGTLHLDKSLLADNPSLSLHHDKQDCYIDICSPEVLSLFTDNFDYQHLRRHFVKGLLLDDIMGYKIFVHEIHSDYAARIDNFRSYDTVSKDIIHRWTYPLVPDVMNFGDTATKLERQGIYRASGMDENFVVYIGNAEISQSQSAVIGPFTVIGSGTKIGHNTKILNSVIGEGCKIGSNVIIEGCYIWDNISIEDGCKLQHAIVCDGVIIKSGAVLEPGVILSFKVVVGPEFVVPPYSNVSLLQQPIEEDSDEELEYADSTSVIGSQVDKSDVEIASKVLETHFSPASELGMGGAGHVWSTCEGSHEEEWRHSVAPIPKDKVMEAIKTMKDDLENDDSFLPPSGELKPNSNYSDDDDHEDSRDDSYYFEKEVEATFLRAVHENIQESHLILEINSLKLSYNKLAADCAGAVFSAMMKYALDTPHSSADVLLQNVQAVFTKWKKALTSYLTDIDEQIEVILKFEEICEESAKEFAPLFTRILHYLYNEDVVEEDAILSWEAELKDADEADKVFVKQAQKLIQWLKEAPEEDDDDEE

SEQ ID NO: 114225 - protein, 451 aa, Glycine max
  Coding DNA Sequence Number=SeqID_22540
  Homolog annotation: Hit_ID=Q5JK43; Match level="QueryCoverage=89%, HitCoverage=82%, E-value=3e-71, Identity=36%"; Hit description =Putative uncharacterized protein OSJNBa0052O12.5
  Subcellular localization annotation: CTP_CleavageSite=16; ConfidenceScore=5.47e-01
MGQEPPQSVRGMPSVRSSASSNALAEQPPPRTPTLTNNAEQQPPSARLTPGNRTLELSPSARTIIITRSPQPSSANNDQPPSARSTSGRPSGLSKVVPMVPPSVPITLRPVSSVGVPPSEPLLDIRKDRRHAAATVRENANQQQRPTSELEDELRLAEEKCEEAESRVRQLEQQAALRNASKNHGGFQTALQADAETAREETASAFEKLRLMTQRMILTPEEMEEVVLKRCWLARYWGLCVRHGIHADIAEAKYKYWSMFAPNPIEVVLAAAKKAKEEKDLDVEDTEGQLDLKELSGEGNIENMLFVEQGLRQLASLKVEEALAVALAQHRRPNMLKAGFSDDLKLPIEGQCDAFELSQEEAEDVSFKQAWLAYIWKRAKRHEIEPDIANERFQHWINHNSMTPTSQDAVDVERGLVEIKRLDIETQLWDESRRELEQEIGNSNIPGRSDF

SEQ ID NO: 114226 - protein, 531 aa, Glycine max
  Coding DNA Sequence Number=SeqID_22541
  Gene Ontology: Mol. function=protein serine/threonine kinase activity; Cellular component=cytoplasm; Biological process=vesicle -mediated transport
  Homolog annotation: Hit_ID=A2Q3G1; Match level="QueryCoverage=99%, HitCoverage=88%, E-value=0.0, Identity=76%"; Hit description=C2; von Willebrand factor, type A; Copine
  Pfam annotation: Domain name=C2; Domain location=123-211; Score=27.6; E_value=4.6e-05; Accession=PF00168.21; Description=C2 domain
  Pfam annotation: Domain name=C2; Domain location=2-77; Score=3.2; E _value=0.064; Accession=PF00168.21; Description=C2 domain
  Pfam annotation: Domain name=Copine; Domain location=300-447; Score =283.4; E_value=4.5e-82; Accession=PF07002.7; Description=Copine
  Pfam module annotation: Pfam domain module=C2::C2::Copine; Domain location=123-211::2-77::300-447
MVVVYAKKRDGKMEEIGRTEVILNCLNPEWIEKISVAFHFEIVQPLEFHVYDVDTKYHSVPTTTLKLGDQDFLGMASCTLSEIVTKPSRSLSLRLKNKSRHDVLRNLGEITVHAEETVASRSAVEMVLRCTHLDNKDFFSKSDPFLRISRMVETGGYVPICKTEVIDDNLNPKWKPLCLSVQKFGNKDNPLLIECFDFNSSGNHFKDAKRIDVKFIAISKMQKSVADLEKLYKERTGANFVIPSTRHRQEKVLKGQLFVDQYCVKEQISFIDYISSGFELNFMVAIDLTASNGNPHHSDSLHYIDAYGRLNSYQKAVMEVGEVIQFYDSDRQFPAWGFGGKLPGGTVSHCFNLNGNPGASEVVGVEGIMDAYASALRSVTLSGPTLFGPVINMAAQMAVQSITSHNNTKYYVLLIITDGVVTDLQETINAVVKASDLPLSILIVGVGNADFKSMEVLDADNGRRLESPTGRVATRDIVQFIPMREVQSGQISVVQALLEELPDQFLSFMRSRDVKPLPCSDFPQASSSTVK

SEQ ID NO: 114227 - protein, 244 aa, Glycine max
  Coding DNA Sequence Number=SeqID_22542
  Gene Ontology: Mol. function=protein serine/threonine kinase activity; Cellular component=cytoplasm; Biological process=protein amino acid phosphorylation
  Homolog annotation: Hit_ID=A2Q3I2; Match level="QueryCoverage=75%, HitCoverage=80%, E-value=1e-54, Identity=61%"; Hit description =Protein kinase
  Pfam annotation: Domain name=Pkinase_Tyr; Domain location=141-244; Score=-143.0; E_value=0.0012; Accession=PF07714.8; Description =Protein tyrosine kinase
MVPIDPAFNDKHKKRGIVYTCPASVSAQDLGEFDLEKEKSVVTLKELLEDCIRDTDNSQQLSELAVSCPSLRTQFYWSKFLKLWKRRSFKHLPSFPPSCVPNITKTKNRTIQEISVVCNSYCSRTLMNFSLDNLRNATNNFSNENMIGRGGFADVYKGSLQDGQLIAVKRLNKGTPENRTSSFLSELGILAHVDHPNTAKLIGCGVEGGMHLVFELSPLGNLGSLLHGVHLVPSIPLFSYVKAF

SEQ ID NO: 114228 - protein, 78 aa, Glycine max
  Coding DNA Sequence Number=SeqID_22543
MAFRRRLHDFYLINPRIQQPCATLEGATVIFTYVKGARGQGSECTLEIIKKAKAEDAKDPLAIPVHDLGYEENCKSGG

SEQ ID NO: 114229 - protein, 254 aa, Glycine max
  Coding DNA Sequence Number=SeqID_22544
  Homolog annotation: Hit_ID=Q2HTN8; Match level="QueryCoverage=87%, HitCoverage=96%, E-value=2e-57, Identity=57%"; Hit description =Putative uncharacterized protein
MVLCSVWPSSLFLSELILSHPELFSNKSCFEIGSGVGLVSPCECFQVEFSQLEVLATVYQQFNLELNHLNVEDDNDMPQRNKNPNTVKCLYLPWESASESQLQDIMPDVVLGADVIYDPVCLPHLVRVLAMVLMNQTNLGSCRQHASCKGHSPNIEHENGEHNHEDAINKSDGGCKAIYNDGSNSLSKEAPVAYIAYVIRNIETFNYFLSLGIQANLDIGDLTDSLKPVNLLCCMKSYNQATVRLLRITSSNIQ

SEQ ID NO: 114230 - protein, 468 aa, Glycine max
  Coding DNA Sequence Number=SeqID_22545
  Gene Ontology: Mol. function=metal ion binding; Biological process =metal ion transport
  Homolog annotation: Hit_ID=A7PSD7; Match level="QueryCoverage=100%, HitCoverage=100%, E-value=3e-52, Identity=34%"; Hit description =Chromosome chr14 scaffold_27, whole genome shotgun sequence
  Pfam annotation: Domain name=HMA; Domain location=14-74; Score=49.3; E_value=1.3e-11; Accession=PF00403.17; Description=Heavy-metal -associated domain
MSKQDLLKVQQSCVLKVNIHCDGCEQKVKKLLQKIDGVYSVRVDADEGKVVVAGDVDPAKLVKKLKRGGKHAEICQNQKGEMMCNQIQNYPINPQFQNMQLGIGGKDNNNNHKGQKEKGTAAAAGQLAHFPILKGVQDLKVPAKEQKSVKFNLPEEDEFDASDDGYDEDGLGHGHPMQNKIMPMMINHNHKDNSGGSRNINGSVKKADVIDQAMLFKGKGGNFDEAEADNDGGKKGSSSQKDEIKKGDLDKPKAVGEVDFHKKKNGKSENGLLGRFLGFGKKSKKGELEETTYTNKSKNQNSGAENKKGKEGKLEDHGNNDFDFHDYDDTPPHPKNGKSGKGSNNVKEGQMGPGPIMGNNLPMRHQMENIQAVQGLPAMNGDGGYYQGVQMQHAPYNNLQQHYMGMMMNQHQHQQANMNNNMYPTPMMYGRPHPSMNYMPPPPMPSHPIADPITHTFSDENVESCSIM

SEQ ID NO: 114231 - protein, 267 aa, Glycine max
  Coding DNA Sequence Number=SeqID_22546
  Homolog annotation: Hit_ID=A7Q2X0; Match level="QueryCoverage=76%, HitCoverage=69%, E-value=2e-50, Identity=54%"; Hit description =Chromosome chr12 scaffold_47, whole genome shotgun sequence
  Pfam annotation: Domain name=Rrp15p; Domain location=140-264; Score =93.4; E_value=7.3e-25; Accession=PF07890.3; Description=Rrp15p
MVEPGRGKRKFFKTQGHKKSSKKAKVMPPQHGQKKVKIDKKMKKLFRKRAREYNSDDEEDDEATVPATLEPKSLASITNKRNDKDGIESEDRSEDEGAAGPQKTWNKNATDMNYHSSDDEGEDDDEIQPGITKFTEGCRAFKMAFRNLMKKSVPDDMLGPILSGQRKLVVDKLAEEEAERKVKGEAKKEKQMLAEKGHVKPATYLDSHEKFLISVATKGVVKLFNAVNKAQTAQRGLDPSRTKDAKVLQLGMEMSQAACQEPMARPI

SEQ ID NO: 114232 - protein, 975 aa, Glycine max
  Coding DNA Sequence Number=SeqID_22547
  Gene Ontology: Mol. function=hydrolase activity, hydrolyzing O -glycosyl compounds; Cellular component=lysosome; Biological process =carbohydrate metabolic process
  Homolog annotation: Hit_ID=Q84XI2; Match level="QueryCoverage=99%, HitCoverage=99%, E-value=0.0, Identity=73%"; Hit description =Glycosyl hydrolase
  Pfam annotation: Domain name=Glyco_hydro_2; Domain location=213-333; Score=-3.5; E_value=0.0017; Accession=PF00703.12; Description =Glycosyl hydrolases family 2, immunoglobulin-like beta-sandwich domain
  Pfam annotation: Domain name=Glyco_hydro_2_C; Domain location=342 -650; Score=-147.8; E_value=0.065; Accession=PF02836.8; Description =Glycosyl hydrolases family 2, TIM barrel domain
  Pfam annotation: Domain name=Glyco_hydro_2_N; Domain location=4-166; Score=-35.5; E_value=0.0011; Accession=PF02837.9; Description =Glycosyl hydrolases family 2, sugar binding domain
  Pfam module annotation: Pfam domain module=Glyco_hydro_2::Glyco_hydro_ 2_C::Glyco_hydro_2_N; Domain location=213-333::342-650::4-166
MAEQLRKTTLDSGWVAARSTEVQFTGTQLTTTHSPTGPTSPWMEALVPGTVLATLVKNKAVPDPFYGLQNEHIIDIADSGRDYYTFWDTTNYLTFLHLQSSNEHCDLNFRGINYSADVYLNGHEIILPKGMFRRHSLDVTNILHPDGTNLLAVLVHPPDHPGRIPPEGGQGGDHEIGKDVTTQYVEGWDWMAPIRDRNTGIWDEVSISVTGPVKIIDPLLVSTFSDDYKKAYLHTTTELENRSSLTAECSLSVLVTTELEDSICLVEHHLQTQDLTIPANSRVQYTFPELFFSNPNLWWPNGMGKQSLYNVVISIDVKGFGESDSWSHHFGFRKIESHIDDATGGRLFKVNGEPIFIRGGNWILSDGLLRLSKKRYNTDIKFHADMNFNMIRCWGGGLAERPEFYHYCDCYGLLVWQEFWITGDVDGRGVPVSNPNGPLDHDLFLFSARDTVKLLRNHPSLALWVGGNEQVPPDDINAALKNDLRLHPYFESEDENSKPVGDWFPMSTDFSQYLDGTRIYIQGSMWDGFADGKGNFTDGPYEIQNPEDFFKDHFYNYGFNPEVGSVGMPVAATIRATMPSEGWQIPVFKKLPNSYVEEVPNPIWEYHKYIPYSKPTKVHDQIQLYGDAKDLDDFCLKAQLVNYIQYRALLEGWTSRMWSKYTGVLIWKTQNPWTGLRGQFYDHLLDQTAGFYGCRCAAEPVHVQLNLATYLIEVVNTTSEELSNVAIEASVWDLDGTCPYYRVHENFSLLPKKVAPIVKMKYPESKDPKQVYFLLLKLYNMADNRVISRNFYWLHLSGGDYKLLEPYREKKIPLKITSKVSVEESIYNIQVLVTNTSTRSDSTSSTGRLSDGFYGTHSLETLDCGVGIEQETGGSKRIHKCFSGKSDGLKVTEINGPDVGVAFFLHFSVHTSKRDYEEGKDTRILPVHYSDNYFSLVPGETLPINISFDVPQGVTPRVILHGWNYDGGEIICEVV

SEQ ID NO: 114233 - protein, 797 aa, Glycine max
  Coding DNA Sequence Number=SeqID_22548
  Gene Ontology: Mol. function=zinc ion binding; Cellular component =intracellular
  Homolog annotation: Hit_ID=A7PS75; Match level="QueryCoverage=72%, HitCoverage=72%, E-value=0.0, Identity=58%"; Hit description =Chromosome chr14 scaffold_27, whole genome shotgun sequence
  Pfam annotation: Domain name=zf-RanBP; Domain location=336-365; Score= 45.9; E_value=1.4e-10; Accession=PF00641.9; Description=Zn-finger in Ran binding protein and others
  Pfam annotation: Domain name=zf-RanBP; Domain location=369-398; Score= 30.1; E_value=8.1e-06; Accession=PF00641.9; Description=Zn-finger in Ran binding protein and others
  Pfam module annotation: Pfam domain module=zf-RanBP::zf-RanBP; Domain location=336-365::369-398
  Subcellular localization annotation: CTP_CleavageSite=19; ConfidenceScore=5.36e-01
MGYGYGPFSLLLNRRLHLSSSLNPKPSFPLLHLLTKPFSTAPPDPNPNPKPSSLSARLSFVFDQIDAIEKQRSQKHETLQRIRAWRESKNAPPEPALSVSADDESPPEPPPKKAVELVHPWPEWIQLMEMLVHQNYFDHKRRDEDKMVHDLGFNAPEVAEGFDFTKDFKSVHMACLSFGRDRFDILRSLSRKDIQVLVGYGCPTVDRKVVFSAKLLRKHVHLDEGDVCSSCSLRSNCERGYLLTNKEDEARTLDVMRLLLTFGFDPVDGSVINKSLLKQKSVKTVVRKLLHEVVKLSSVPIDPNLPPPVIKKPPPKVKQPPPPPKRRVGRDDVEMKRGDWLCPKCEFMNFAKNTVCLQCDAKRPKRQLLPGEWECPKCNFLNYRRNMVCFHCECKRPPDEFLENKMQDRIQNSKPKLDKKGSRQEVSNAWNFDFDDNESDGADVAAFEYADTHAIDENSDNHAQRGNDRGWEDDFEKNNRVQGSPDGEYANPGLYRSRTGFDDFEDEDDIDSYELETAQNSSKRVEESKYNFSEGENFSESEDIEGTDDKMHARHKTASGRSVQSRSIRKNTSFSGSKDDELDFGTDEQLSVVSNFKYGHVSASDRKRKGRGPSKKLSFGSESEEDMGGGLYSDEDDKIRGIDTILEEGTLPKTGSQDLLVVAEQICSVMILMDHPSSLIGTVGGLREMTVIGRVLKILMDRLGNHMVMAEGPEETTVMDHPGSLMGMVGGLEEMTAIGRDLKILMDHLNDHIVMVEGPVEATAMDHPGSLMGMIEDLKEMTVDGRDLKTGRIAQDG

SEQ ID NO: 114234 - protein, 422 aa, Glycine max
  Coding DNA Sequence Number=SeqID_22549
  Gene Ontology: Mol. function=phosphotransferase activity, alcohol group as acceptor; Cellular component=cytoplasm; Biological process =isoprenoid biosynthetic process
  Homolog annotation: Hit_ID=Q2HTL9; Match level="QueryCoverage=86%, HitCoverage=89%, E-value=1e-145, Identity=74%"; Hit description =Mevalonate and galactokinase
  Pfam annotation: Domain name=GHMP_kinases_C; Domain location=303-383; Score=20.6; E_value=0.0057; Accession=PF08544.4; Description=GHMP kinases C terminal
  Pfam annotation: Domain name=GHMP_kinases_N; Domain location=149-230; Score=73.7; E_value=6.2e-19; Accession=PF00288.17; Description=GHMP kinases N terminal domain
  Pfam module annotation: Pfam domain module=GHMP_kinases_C::GHMP _kinases_N; Domain location=303-383::149-230
MEVKSRAPGKIILTGEHAVVHGSTAVASSIDLYTYVSLHFSTPSDNEDSLKLKLQETALEFSWPITRIRAAFPESTAQLSSTPNSCSVENAKAIAALVEELNIPEAKLGLASGVSAFLWLYSSIQGSEIYQLSIHFSSISSFKSFSPATVVVTSELPLGSGLGSSASFCVALAAALLAYTDSVSLDLKHQGWLSFGEKDLELVNKWAFEGEKIIHGKPSGIDNTVSAYGNIISFKSGNLTHMKSSVPLKMLITNTKVGRNTKALVAGVGERMLRHPDIMAFVFSAVDSISNELTSILKSPTPDELSVTEKEEKIEELMEMNQGMLQSMGVSHATIETVLRTTLKYKLASKLTGAGGGGCVLTLLPTSHFRNFKHFPSPSNPLNIGGETKILGKGFLLPYFPSNKTLCQKGCPESSDIYVLPG

SEQ ID NO: 114235 - protein, 600 aa, Glycine max
  Coding DNA Sequence Number=SeqID_22550
  Gene Ontology: Mol. function=DNA binding; Cellular component=nucleus; Biological process=negative regulation of cell cycle
  Homolog annotation: Hit_ID=Q10G93; Match level="QueryCoverage=95%, HitCoverage=49%, E-value=3e-99, Identity=38%"; Hit description=DIRP family protein, expressed
  Pfam annotation: Domain name=DIRP; Domain location=114-215; Score =196.6; E_value=6.2e-56; Accession=PF06584.4; Description=DIRP
MAHKKDEKSVLPEGKSTRQNRDKIKLQGLKQKVDHAVPGVGSSTKHRSRRKTILQRPFTPKEKSSEKILKSKQNKNLTPVHGGALNILVGTYQEKLSGCLSSYMVRRWCMFEWFYSAIDYPWFSKREFMEYLNHVDLGRIPRLTRVEWSVIRSSLGKPRRFSERFLHGERQKLEQYRESVRKYYDELRTGIRDGLPTDLSKPLCVGQRVIAFHSKKTREIHDGSVLTVDHDNYRVQFDRPELGVDSVMDIDCMPLNPLDTMPETLRQQISASNVPRISKKPHKKGNSRFGGNMTYNSSGPVEKAPTSSSTLALAKPKKALSPGKLLLELKNANSEIVGNQNDADCFNDRRLSRSITPHVIQLKEASGQACGFRGLLFCYYSLSIVFNALCYSRKHNTEHIRNSPPPQMNPKASFDNHDSLPNTMDGSLVQELGSAVEIIKGSKLRAHAMVDAAFQALSSTKEGEDALTRIEQALDCADNQQLATNSRLPVIRSQGQISGSFDYHNRSISHPSKPLLNNASGRKLHNDSDKVNTQILLDLITSCVATGITIQTCANQQCPPADVTPIFDTAVTILHPRRYAEIEVSGHLYHGQQGQALELV

SEQ ID NO: 114236 - protein, 126 aa, Glycine max
  Coding DNA Sequence Number=SeqID_22551
MANSYTWLFLAISATLLLLLSSSPTAERGSAGHGNDMDTLHAHGRGVPAGQRDQPAHLSHDQVHQLRCAAEEHCPLLSPRSLLLQLPAWRSGQPLQPWLQCHHQVFLKIDENTNTEDTKLGGGVNE

SEQ ID NO: 114237 - protein, 311 aa, Glycine max
  Coding DNA Sequence Number=SeqID_22552
  Gene Ontology: Mol. function=metal ion binding
  Homolog annotation: Hit_ID=A7PS19; Match level="QueryCoverage=69%, HitCoverage=99%, E-value=2e-72, Identity=64%"; Hit description =Chromosome chr14 scaffold_27, whole genome shotgun sequence
MEDWGEQVFGNNGVWKCCAGWLAGNAYHDMLGQQAIFAEHTAVSSASHPCPYIAYFGPIHPSTSNSGLTVSEASNFNHWNGPPVPGDMPTSYTFPAVDLHYHSWEHNSSHFSSANSRLGTSEQTSVSPGSQRPARGGSDVPRSGSFMHPFLVGHSSAARAGNSVASSMIPPYPGSNARARDRVQALQAYYQPQLPHNSATIRTPVASSTRRSSSHSGSVQLAPVASSPDRSAGFVYIPSGSSGHNFQEETHLPSRFHAREREHLPSLPLNHVGRESSWRAYHQTASVSDPSIRSSSFRLRHESDRMPSQNR

SEQ ID NO: 114238 - protein, 107 aa, Glycine max
  Coding DNA Sequence Number=SeqID_22553
MHLHLSNPNQSLDPLSPEIEGIRYRDPIVSPSWDWAPLGLRLAQRTPPSSLEKFSIKVEVESFGMDGSGNVYHCQSLLTNGKYVYVIGTKGLESSSGDPNVYTFVLL

SEQ ID NO: 114239 - protein, 655 aa, Glycine max
  Coding DNA Sequence Number=SeqID_22554
  Gene Ontology: Mol. function=enzyme inhibitor activity; Cellular component=cell wall; Biological process=cell wall modification
  Homolog annotation: Hit_ID=A7PRY8; Match level="QueryCoverage=80%, HitCoverage=88%, E-value=1e-161, Identity=52%"; Hit description =Chromosome chr14 scaffold_27, whole genome shotgun sequence
  Pfam annotation: Domain name=PMEI; Domain location=126-279; Score =124.0; E_value=4.2e-34; Accession=PF04043.6; Description=Plant invertasepectin methylesterase inhibitor
  Pfam annotation: Domain name=Pectinesterase; Domain location=337-636; Score=624.7; E_value=8.3e-185; Accession=PF01095.10; Description =Pectinesterase
  Pfam module annotation: Pfam domain module=PMEI::Pectinesterase; Domain location=126-279::337-636
MKIKEAKPVSSSRFRRKKSQVNEGHQPRERKRIAFDSKPHIFATDIANFGNDLSSKYTHIFQIITIAPTRSPEGFVGGFLRLNESSPCVLGWCSIKKNGGRCTEEENCHNWRVYLLAGGHGGGSDTSSIKAVKTLCAPTDYKKECEDSLIEHSNNITDPRELIKIAFHVTISKIGEGLEKTELMHQVENDPRTKEALDTCKQLMNLSIGEFTRSLDRFTKFDLNNLDNILTSLKVWLSGAITYQETCLDAFENTTTDASLKMQRLLQSAMHMSSNGLSIITELSKTLSEMHIGKPGRRRLLNNNVLGHDYFDLPEWVDDQVGVRKLLHMTGRKRMAHVVVAKDGSGNFTTINEALKHVPKKNLRPFVIYVKEGVYNEYVEVSKNMTHVVMIGDGGKKSRITGNKNFVDGVGTFRTASAAILGDFFVGIGMGFENSAGAEKHQAVALRVQADRSIFYKCRMDGYQDTLYAHTMRQFYRDCIISGTIDFVFGDAVAVLQNCTFVVRKPLENQQCIVTAQGRKEMNQPSGLIIQGGSIVADPMYYPVRFDNKAYLARPWKNFSRTIFMDSYIGDLITPDGYMPWQTLEGLRGMDTCFYSEFNNRGPGSDKAKRVKWEGIKALDSDGISNFLPAKFFHGDDWIRVTRVPYYSGQPSPTH

SEQ ID NO: 114240 - protein, 75 aa, Glycine max
  Coding DNA Sequence Number=SeqID_22555
MAQYNEVTNRDAQLTVIGKEHDDDGREHDDTITLVRITWNLRGGKAKFGQTKKKIKCKYKKKKDLYWRFRQKPGV

SEQ ID NO: 114241 - protein, 217 aa, Glycine max
  Coding DNA Sequence Number=SeqID_22556
  Gene Ontology: Mol. function=structural constituent of ribosome; Cellular component=ribonucleoprotein complex; Biological process =translation
  Homolog annotation: Hit_ID=A7Q8E9; Match level="QueryCoverage=64%, HitCoverage=61%, E-value=1e-65, Identity=88%"; Hit description =Chromosome chr5 scaffold_64, whole genome shotgun sequence
  Pfam annotation: Domain name=Ribosomal_L18e; Domain location=54-215; Score=366.9; E_value=3.2e-107; Accession=PF00828.10; Description =Eukaryotic ribosomal protein L18
MFQAWRSEENKLWTTEEDKVSMAILKNWEVQEAKRGAGSKRPRNGYMFWAYLFTSESILRLGLYRFLVRRTGSNFNAVILKRLFMSKVNKPPISLSRLIKYTKGKEDKIAVIVGTVTDDIRVYEVPALKITALKFTERARARIEKAGGECLTFDELALRAPLGQNTVLLRGPKNAREAVKHFGPAPGVPHSHTKPYVRAKGRFERARGRRNSRGFRV

SEQ ID NO: 114242 - protein, 74 aa, Glycine max
  Coding DNA Sequence Number=SeqID_22557
  Homolog annotation: Hit_ID=A7PRZ2; Match level="QueryCoverage=97%, HitCoverage=26%, E-value=2e-10, Identity=51%"; Hit description =Chromosome chr14 scaffold_27, whole genome shotgun sequence
MADSDAVWEKFLPLNHQEIVSRLVPPSLLCSSKKELFVKLCKPRPIDDGNKDLNSHFLRKLVEKQKITFGMENL

SEQ ID NO: 114243 - protein, 814 aa, Glycine max
  Coding DNA Sequence Number=SeqID_22558
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=95%, HitCoverage=94%, E-value=1e-153, Identity=36%"; Hit description =Putative Na/H antiporter
  Pfam annotation: Domain name=Na_H_Exchanger; Domain location=34-426; Score=163.8; E_value=4.5e-46; Accession=PF00999.12; Description =Sodiumhydrogen exchanger family
  Pfam annotation: Domain name=YibE_F; Domain location=162-366; Score= -145.5; E_value=0.042; Accession=PF07907.2; Description=YibEF-like protein
  Pfam module annotation: Pfam domain module=Na_H_Exchanger::YibE_F; Domain location=34-426::162-366
MANTMPACYEVYITNPSRIWQTDKVLKTELPIIAFQIAFVVVLSRIFFIIYKPLHQTRLISQISVGFLLTPPLLGRYTPIFEFIFPVNGVLNVEVLSHLGLIFYAFLSGLEMNLDTILRVKKKAASIAVAGIVFPMVMGPCLYALYRKIYGSHGVFPLEESTVNAYLLWTLILTVTGFPVIAHTLSELKLIYTGLGKAALTAAMISDTYSWILFTLLVPFAINGQGAIYTVLSTLVFIVVCIFVVRPIILRFMDNKVDNDEWDDNELLFVVMGVLACSLITDILGAHGIVGAFVYGLILPHGKFADMMMSISDDFTGGFLAPLFFTGNGMRLILSSVFQGNWPLTLLIILLLCSLKILSTLFASFFFGVHTKDGLAMGLLLNTKGAMALIMLNIAWDRAIFSVPTYAVMASAVLLMTVVVSPVINAVYRPRKRFEQNKLKTIQKLRVDAELRILACVHNTRQATSMISIIETFNATRLTPIHVFAMYLIELTGRAAALVAAHIEKPSSQPGEQNLTKSQAELENIANAFDAFGEAYDAARIETLNVVSSYATIHEDIYNSANEKHTSLIVLPFHKQLNSEGALEVTNVVYRDINQNVMQHAPCSVGIFVDRDFGSIPKTNLRILMLFVGGPDDREALAVAWRMAGHPGIKLSVIRILLCDEAAEVDSSIHAEARGILSSVMDSEKQKELDDDYINSFRYTAVNNKDYISYSEIDVHTGEDIPAILNELEKNGCDLYVVGQGNCRSSKVFSNLLEWCECLELGVIGDILASNNSGSRSSLLVVQQYGYGGMAFGNNLHQKGTNNDGFESLVVKTE

SEQ ID NO: 114244 - protein, 101 aa, Glycine max
  Coding DNA Sequence Number=SeqID_22559
  Homolog annotation: Hit_ID=A9NSM9; Match level="QueryCoverage=59%, HitCoverage=41%, E-value=4e-08, Identity=45%"; Hit description =Putative uncharacterized protein
MTDDSEVSFNNLCVAFHRLHEYSIETGLATIIDGDDILKVSTKHLRDLTFQVGSVYQFISELLIQAVMRRGVLQTTVLIMVMASKIVRYELGLAGMLHGGI

SEQ ID NO: 114245 - protein, 607 aa, Glycine max
  Coding DNA Sequence Number=SeqID_22560
  Gene Ontology: Mol. function=protein transporter activity; Cellular component=nuclear pore; Biological process=intracellular protein transport
  Homolog annotation: Hit_ID=Q2PEZ3; Match level="QueryCoverage=89%, HitCoverage=98%, E-value=0.0, Identity=83%"; Hit description =Putative importin alpha
  Pfam annotation: Domain name=Arm; Domain location=106-147; Score =51.1; E_value=3.9e-12; Accession=PF00514.14; Description =Armadillobeta-catenin-like repeat
  Pfam annotation: Domain name=Arm; Domain location=149-189; Score =57.4; E_value=4.9e-14; Accession=PF00514.14; Description =Armadillobeta-catenin-like repeat
  Pfam annotation: Domain name=Arm; Domain location=191-232; Score =38.1; E_value=3.2e-08; Accession=PF00514.14; Description =Armadillobeta-catenin-like repeat
  Pfam annotation: Domain name=Arm; Domain location=252-291; Score =34.3; E_value=4.4e-07; Accession=PF00514.14; Description =Armadillobeta-catenin-like repeat
  Pfam annotation: Domain name=Arm; Domain location=293-333; Score =37.4; E_value=5.2e-08; Accession=PF00514.14; Description =Armadillobeta-catenin-like repeat
  Pfam annotation: Domain name=Arm; Domain location=335-376; Score =42.9; E_value=1.2e-09; Accession=PF00514.14; Description =Armadillobeta-catenin-like repeat
  Pfam annotation: Domain name=Arm; Domain location=378-418; Score =50.9; E_value=4.4e-12; Accession=PF00514.14; Description =Armadillobeta-catenin-like repeat
  Pfam annotation: Domain name=Arm; Domain location=421-461; Score =34.6; E_value=3.6e-07; Accession=PF00514.14; Description =Armadillobeta-catenin-like repeat
  Pfam annotation: Domain name=HEAT; Domain location=112-149; Score =4.4; E_value=6; Accession=PF02985.13; Description=HEAT repeat
  Pfam annotation: Domain name=HEAT; Domain location=155-191; Score =27.3; E_value=5.5e-05; Accession=PF02985.13; Description=HEAT repeat
  Pfam annotation: Domain name=HEAT; Domain location=258-293; Score =10.5; E_value=0.72; Accession=PF02985.13; Description=HEAT repeat
  Pfam annotation: Domain name=HEAT; Domain location=298-335; Score =5.1; E_value=4.7; Accession=PF02985.13; Description=HEAT repeat
  Pfam annotation: Domain name=HEAT; Domain location=341-378; Score =2.5; E_value=12; Accession=PF02985.13; Description=HEAT repeat
  Pfam annotation: Domain name=HEAT; Domain location=384-420; Score =9.6; E_value=0.99; Accession=PF02985.13; Description=HEAT repeat
  Pfam annotation: Domain name=HEAT; Domain location=427-463; Score =0.4; E_value=23; Accession=PF02985.13; Description=HEAT repeat
  Pfam annotation: Domain name=IBB; Domain location=6-97; Score=120.3; E_value=5.8e-33; Accession=PF01749.11; Description=Importin beta binding domain
  Pfam module annotation: Pfam domain module=Arm::Arm::Arm::Arm::Arm::Ar m::Arm::Arm::HEAT::HEAT::HEAT::HEAT::HEAT::HEAT::HEAT::IBB; Domain location=106-147::149-189::191-232::252-291::293-333::335-376::378 -418::421-461::...
  Pfam module annotation: Domain location=112-149::155-191::258 -293::298-335::341-378::384-420::427-463::6-97
MSYRPSANARTEVRRNRYKVAVDADEGRRRREDTMVEIRKSRREESLQKKRREGLQSQQIPSSLHSTVIEKKLEHLPAMVTGVFTDDNNMQLEATTQFRKLLSIERSPPIEEVIQAGVVPRFVDFLMREDFPQLQFEAAWALTNIASGTSENTKVIIDHGAVPIFVKLLGSPSDDVREQAVWALGNVAGDSPRCRDLVLGHGALLPLLAQLNEHAKLSMLRNATWTLSNFCRGKPQPAFDQKLTKTSGEGRREGGERSQVKPALPALASLIQSNDEEVLTDACWALSYLSDGTNDKIQGVIEAGVCSRLVDLLLHPSPSVLIPALRTVGNIVTGDDLQTQVIINHQALPRLLNILTNNYKKSIKKEACWTISNITAGNKKQIQDVIEASIIAPLVHLLQNAEFDIKKEAAWAISNATSGGSHEQIKFLVSQGCIRPLCDLLICPDPRIVTVCLEGLENILKVGEAEKNVSNTDGVNLYAQMIDDAEGLEKIENLQSHDNTEIYEKAVKILETYWMEEDDETMPPGDASQSGFNFGGTQPPAVPSGVLTGLSVKSSSLTVQQFGVKSMSFDCPWLLQGSALFSLNNNLLLTTKPRVSVDSSSIVDMTH

SEQ ID NO: 114246 - protein, 179 aa, Glycine max
  Coding DNA Sequence Number=SeqID_22561
  Gene Ontology: Mol. function=nucleotide binding; Cellular component =endoplasmic reticulum; Biological process=small GTPase mediated signal transduction
  Homolog annotation: Hit_ID=Q01474; Match level="QueryCoverage=87%, HitCoverage=81%, E-value=1e-70, Identity=84%"; Hit description=GTP -binding protein SAR1B
  Pfam annotation: Domain name=Arf; Domain location=6-178; Score=266.8; E_value=4.4e-77; Accession=PF00025.12; Description=ADP-ribosylation factor family
  Pfam annotation: Domain name=MMR_HSR1; Domain location=21-132; Score =22.3; E_value=9.7e-06; Accession=PF01926.14; Description=GTPase of unknown function
  Pfam annotation: Domain name=Miro; Domain location=22-132; Score =18.8; E_value=0.00017; Accession=PF08477.4; Description=Miro-like protein
  Pfam annotation: Domain name=Ras; Domain location=22-179; Score= -100.4; E_value=0.087; Accession=PF00071.13; Description=Ras family
  Pfam annotation: Domain name=SRPRB; Domain location=18-178; Score= -69.3; E_value=0.016; Accession=PF09439.1; Description=Signal recognition particle receptor beta su
  Pfam module annotation: Pfam domain module=Arf::MMR_HSR1::Miro::Ras::S RPRB; Domain location=6-178::21-132::22-132::22-179::18-178
MFLWDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEEELRYHLGLTNFTTGKGKYCEENGLWGWFQMGFPVHQIVR

SEQ ID NO: 114247 - protein, 143 aa, Glycine max
  Coding DNA Sequence Number=SeqID_22562
MEEVEPRNYNRHCLWLEEIFNLVGVLDTTAQFVSVCKPFDETQVQERFEVLKKRKDVGSFTEQGKALDKRSPHQDPPLGVANSPIPVDLDERILKQQQEEEERKRLRREKKKEKKEKAVEEPEIDPDVAAMMGFGGFRSSNKK

SEQ ID NO: 114248 - protein, 109 aa, Glycine max
  Coding DNA Sequence Number=SeqID_22563
  Homolog annotation: Hit_ID=A5BCR2; Match level="QueryCoverage=92%, HitCoverage=38%, E-value=3e-10, Identity=34%"; Hit description =Putative uncharacterized protein
MEDLIPILFQYVRSREKPGGDVLFVAHNARCFDVPFIIRTTLSSSSLAALRDLYGIKVDGSAHRAMVDVNTLSLILSRLTSDLKLTLSDLVDKSFTESDIINSKKKKKN

SEQ ID NO: 114249 - protein, 77 aa, Glycine max
  Coding DNA Sequence Number=SeqID_22564
  Subcellular localization annotation: CTP_CleavageSite=43; ConfidenceScore=5.81e-01
MSSDFSSTVTAPPHHFTHSKHFNSVSVVQLNVSRGSRHVTRTRGSAATVFYKTRRAFRSLSRIDRVNNIGNDGSECE

SEQ ID NO: 114250 - protein, 235 aa, Glycine max
  Coding DNA Sequence Number=SeqID_22565
  Gene Ontology: Mol. function=translation release factor activity, codon specific; Cellular component=cytoplasm; Biological process =translational termination
  Homolog annotation: Hit_ID=Q9C7X9; Match level="QueryCoverage=91%, HitCoverage=61%, E-value=5e-82, Identity=63%"; Hit description =Peptide chain release factor 2, putative
  Pfam annotation: Domain name=PCRF; Domain location=27-116; Score =42.0; E_value=2e-09; Accession=PF03462.9; Description=PCRF domain
  Pfam annotation: Domain name=RF-1; Domain location=147-232; Score =67.6; E_value=4.2e-17; Accession=PF00472.11; Description=Peptidyl -tRNA hydrolase domain
  Pfam module annotation: Pfam domain module=PCRF::RF-1; Domain location=27-116::147-232
MLDMLSFHLSKEDLWNDPVRVGKISREHGSLLGKMKEESLKALLNMRRNAKEKELEALLSGEQDSCSCYIEMYKLWAQRRGYKVTVVDEMPGEITGIKRATIKVDGEFAFGYAKAEIGVHRLVNISPFDSNKHRHTSFAAVAVIPIPGDGSTHVQINESDLRIERFRAGGQHVNTTESAVRIVHIPTGVTATCQNERPQHQNKASAMAVLLQSKIRPTGDCTPGTVECTTYTISY

SEQ ID NO: 114251 - protein, 143 aa, Glycine max
  Coding DNA Sequence Number=SeqID_22566
  Gene Ontology: Mol. function=DNA binding
  Homolog annotation: Hit_ID=A5C1L4; Match level="QueryCoverage=55%, HitCoverage=28%, E-value=8e-13, Identity=46%"; Hit description =Putative uncharacterized protein
  Subcellular localization annotation: CTP_CleavageSite=30; ConfidenceScore=5.04e-01
MVNPSTITPPSSEVHTFHNAIESSSHQIPPSSNKSRGRPLGSKNKPKIPLVINQDSDLALKPIFIQVPKNSDVIEAVVQFARQCQVSITVQSASGSILEATLCQTLPDTSTFVNFENHKAGIKGAGEERDSSKKPYACHLDDK

SEQ ID NO: 114252 - protein, 522 aa, Glycine max
  Coding DNA Sequence Number=SeqID_22567
  Gene Ontology: Mol. function=acyl-CoA binding; Cellular component =endosome membrane; Biological process=lipid transport
  Homolog annotation: Hit_ID=A7PRQ5; Match level="QueryCoverage=99%, HitCoverage=99%, E-value=1e-144, Identity=59%"; Hit description =Chromosome chr14 scaffold_27, whole genome shotgun sequence
  Pfam annotation: Domain name=Kelch_1; Domain location=128-175; Score =11.8; E_value=0.12; Accession=PF01344.16; Description=Kelch motif
  Pfam annotation: Domain name=Kelch_1; Domain location=180-225; Score =30.8; E_value=4.9e-06; Accession=PF01344.16; Description=Kelch motif
  Pfam annotation: Domain name=Kelch_1; Domain location=27-72; Score =34.4; E_value=4.1e-07; Accession=PF01344.16; Description=Kelch motif
  Pfam annotation: Domain name=Kelch_1; Domain location=77-122; Score =30.5; E_value=6.3e-06; Accession=PF01344.16; Description=Kelch motif
  Pfam annotation: Domain name=Kelch_2; Domain location=127-175; Score =32.2; E_value=1.8e-06; Accession=PF07646.6; Description=Kelch motif
  Pfam annotation: Domain name=Kelch_2; Domain location=180-225; Score =21.8; E_value=0.0026; Accession=PF07646.6; Description=Kelch motif
  Pfam annotation: Domain name=Kelch_2; Domain location=27-72; Score =29.6; E_value=1.2e-05; Accession=PF07646.6; Description=Kelch motif
  Pfam annotation: Domain name=Kelch_2; Domain location=276-327; Score =6.0; E_value=8.5; Accession=PF07646.6; Description=Kelch motif
  Pfam annotation: Domain name=Kelch_2; Domain location=77-122; Score =28.9; E_value=1.8e-05; Accession=PF07646.6; Description=Kelch motif
  Pfam module annotation: Pfam domain module=Kelch_1::Kelch_1::Kelch _1::Kelch_1::Kelch_2::Kelch_2::Kelch_2::Kelch_2::Kelch_2; Domain location=128-175::180-225::27-72::77-122::127-175::180-225::27 -72::276-327::77-122
MSSSLPQVAKNKAMWLHPKVLGFNPPERWGHSACFSNGLMYVFGGCCGGLHFCDVLTLDLNKMVWSKLTTTGEKPGPRDSHSAVFVGHKMIVFGGTNGFKKMNHIHVLDLVTKEWVRPECKGTPPSPRESHTATLVGDERIVIFGGSGEGHANYLNDLHILDLRTMSWTSSELKGDFPVPRDSHSTLAIGNKLIVYGGDSGDQYHGNVHMLDMTTMTWSKLSIQGSPPGVRAGHAAVNIGTKARVGDKRYYNDVWIFDICNFTWTQLDIDFHQPQGRFSHTAVAAGMDIAIYGGCGEDERPLNELLVLQLGAEHPNGRYYIPMCKPFGTYWNQEKKIIPGEADTHSVQKFMNNVETFGQGAYEVASEKSPPYHFDSGGLSFMPYLDKVLSRVDEPFDSVSLSPAAVNGRIFRGVIFSPGAGVVSKVANVKPNCSLTSSFPSSSQAFLNSNHVGNSRASQQAPIRLRAEPCHGSRQTPVALPFPIMRGTSNVVSKEHKINSDLQGGLVLTLGGPASAHPQVKH

SEQ ID NO: 114253 - protein, 361 aa, Glycine max
  Coding DNA Sequence Number=SeqID_22568
  Gene Ontology: Mol. function=molecular_function; Cellular component =membrane; Biological process=auxin mediated signaling pathway
  Homolog annotation: Hit_ID=Q84TV1; Match level="QueryCoverage=96%, HitCoverage=97%, E-value=2e-60, Identity=59%"; Hit description =Nodulin-like protein
  Pfam annotation: Domain name=DUF6; Domain location=188-317; Score =79.7; E_value=9.2e-21; Accession=PF00892.11; Description=Integral membrane protein DUF6
  Pfam annotation: Domain name=TPT; Domain location=179-317; Score= -27.0; E_value=0.022; Accession=PF03151.7; Description=Triose -phosphate Transporter family
  Pfam module annotation: Pfam domain module=DUF6::TPT; Domain location= 188-317::179-317
MGAGLVAFLLMVLVQLVYAVMNITSKLAIESGMSPLVLVAYRQLFATVSIAPFAYWLECFIYGLSRTSSKNNLGGNCQEYASQDHKTSYASDIIFVPDRSYRKSDALFCGAEIFIRYNCMCTDQFAPSFHFYPCSSLQTREFGNQEEGWASKGQSSIHWRYAEKMEGTSSSGKGNMFLGPLVVILSTLVWAAWFIIQKDISKTFSAPYTSTGLMCFMASFQCIIIAVCVDHTASAWSLHNAMRLSSALYAGIFCTGLAYCLMSWTIERKGPLYVSVFTPLQLVLTAILSWALLREKLYVGTAVGSLLIVLGLYSVLWGKSEEVNKEDGIEDAFKEAVKDPKNDMELQSYVSSNVNNRCAIA

SEQ ID NO: 114254 - protein, 421 aa, Glycine max
  Coding DNA Sequence Number=SeqID_22569
  Gene Ontology: Mol. function=glucose-6-phosphate dehydrogenase activity; Cellular component=chloroplast; Biological process =carbohydrate metabolic process
  Homolog annotation: Hit_ID=Q93ZW0; Match level="QueryCoverage=93%, HitCoverage=62%, E-value=1e-118, Identity=55%"; Hit description =Glucose-6-phosphate 1-dehydrogenase 4, chloroplast precursor
  Pfam annotation: Domain name=G6PD_N; Domain location=143-341; Score =198.8; E_value=1.3e-56; Accession=PF00479.13; Description=Glucose-6 -phosphate dehydrogenase, NAD bindi
  Subcellular localization annotation: CTP_CleavageSite=57; ConfidenceScore=5.72e-01
MSVSFSSTSVSFSESSFAFQRPAPAHLCSNSLTVASNNFHSATGGGRLVLNVGGTCLCRKFRGLKLWLLERLSFQFQPPKQPKNRNHHFRNNLENEKGSVSDSSSNLRVPDDKVTPVESLSLLQTGLSGTPVDVGRKPSLCIAVIGATGELAKRKIFPALFALYYSGFLPELEDLWHTFLMPKTEHLECENVGIFGYSRKDITDEDLRSIIASTLTCRVDHQENCDNKLDAFLSKTYYINGGYDNKYGMSMLNSRMEQIEGGSKTNRIFYLSVPQEALLDVASCLASSAQTQNGWNRIIFEKPFGFDARSSDRLTQYILSNFQEKQIFRIDHLLGRNLIENLTVLRFSNLVFEPLWSRTYIDNVQVILSEDLGVHPGRYFSGYGIIRDIVHCHVLQTIALLAMEPPISLDGEDIRNEKLLG

SEQ ID NO: 114255 - protein, 179 aa, Glycine max
  Coding DNA Sequence Number=SeqID_22570
  Gene Ontology: Mol. function=catalytic activity; Cellular component =extracellular region; Biological process=carbohydrate metabolic process
  Homolog annotation: Hit_ID=Q0PKY2; Match level="QueryCoverage=100%, HitCoverage=43%, E-value=2e-65, Identity=67%"; Hit description=Endo -1,4-beta-mannanase
MAAYVKSIDSNHLLQIGLEGFYGESMPERKQFNPGYQIGTDFISNNQVPEIDFTTIHLYPQWMSRFNETAQDVFINNWVQVHIQDANDVLRKPILLSEFGLSSKISGYGVEKRNSLFEKLYNLIYKSASNRGSCAGGLFWQLLAKGMDDFRDGYEVVFEETPSTTNIITKQSKKMSSLA

SEQ ID NO: 114256 - protein, 110 aa, Glycine max
  Coding DNA Sequence Number=SeqID_22571
  Gene Ontology: Mol. function=zinc ion binding; Cellular component =endoplasmic reticulum; Biological process=ER to Golgi vesicle -mediated transport
  Homolog annotation: Hit_ID=A7P1U7; Match level="QueryCoverage=99%, HitCoverage=20%, E-value=1e-33, Identity=68%"; Hit description =Chromosome chr19 scaffold_4, whole genome shotgun sequence
  Pfam annotation: Domain name=Sec23_helical; Domain location=18-110; Score=22.4; E_value=2.3e-05; Accession=PF04815.6; Description =Sec23Sec24 helical domain
MAVPVVTELADIYRLADTGAIVSLLSRLGSSFIIAAIEKTLSQKLEDARSAVQLRVVKALREYRNLYSVQHRLANRMIYPESLKFLMLYGLALCRSTALRGGYGDVPLDE

SEQ ID NO: 114257 - protein, 35 aa, Glycine max
  Coding DNA Sequence Number=SeqID_22572
MEKKKKKRVEGVAMWHLKEGGEQSVLGLVLLPISG

SEQ ID NO: 114258 - protein, 574 aa, Glycine max
  Coding DNA Sequence Number=SeqID_22573
  Gene Ontology: Mol. function=protein binding; Cellular component =Golgi transport complex; Biological process=protein transport
  Homolog annotation: Hit_ID=Q2HTC4; Match level="QueryCoverage=95%, HitCoverage=71%, E-value=0.0, Identity=79%"; Hit description =Conserved oligomeric Golgi complex component 4, related
  Pfam annotation: Domain name=COG4; Domain location=183-502; Score =341.2; E_value=1.8e-99; Accession=PF08318.3; Description=COG4 transport protein
MGAIPEANGNVADEENGSSVGGSIDFGTAEAVQYVRSLTDVGAMTRLLHECIAHQRAVDVELDELLSQRTDLDRHLLQLQRSSDVLDIVNSDADYMLSNVASTSDLADQVSRKVRELDLAQSRVRNTLLRIDAIVERANSLEGVHRALEAEDYESAACYVQTFLQIDAQYKDSGSDQLQRDRLLAAKKQLEGIVRKKLSAAVDQRDHPAILRVKKACATMLNLDPSFFRFIRLFTPLGVEEEGLQVYVGYLKKVIAMRSRMEFEQLVEMMDQQNVNFVGCLTNLFKDIVLAIEENSEILSGLCGEDGIVYAICELQEECDSRGSVILNKYMEYRQLAKLSSEINAHNTNLLAVGGGPEGPDPREVELYLEEILNLMQLGEDYTEFMISKIKALTSVDPELLPRATKAFRSGSFSKVAQDLTGFYVILEGFFMVENVRKAIKIDEQVPDSLTTSMVDDVFYVLQSCLRRAISTSNISSVVAVLSGASSLLGNEYHEALQHKTREPNLGAKLFFGGVGVQKTGTEIATALNNMDVSSEYVLKLKHEIEEHKYGCRTVSLCMVCLGSHYKDVCNSEL

SEQ ID NO: 114259 - protein, 183 aa, Glycine max
  Coding DNA Sequence Number=SeqID_22574
  Gene Ontology: Mol. function=protein kinase activity; Cellular component=nucleus; Biological process=protein amino acid phosphorylation
  Homolog annotation: Hit_ID=A7PRJ2; Match level="QueryCoverage=55%, HitCoverage=16%, E-value=2e-41, Identity=77%"; Hit description =Chromosome chr14 scaffold_27, whole genome shotgun sequence
MLSAPSGKGSEDIEAAVKKLSLVSTSSSMDDDQINPFSVLLSICGQSAPSVLQDIFSRYWIVPYFQVTCCLGLSDKGDSILYLDLSSDPDLFKGPKGDKQSETYRRMKEVTEDCWEGSCPKTNVLWLIYLVDILLMKKSFERTTKHERDLRSLKKRLDKYDSAKEAVLDPFFTDLFIESDPKA

SEQ ID NO: 114260 - protein, 813 aa, Glycine max
  Coding DNA Sequence Number=SeqID_22575
  Gene Ontology: Mol. function=catalytic activity; Cellular component =nucleus; Biological process=metabolic process
  Homolog annotation: Hit_ID=A7PRH4; Match level="QueryCoverage=97%, HitCoverage=94%, E-value=1e-173, Identity=39%"; Hit description =Chromosome chr14 scaffold_27, whole genome shotgun sequence
  Pfam annotation: Domain name=PPR; Domain location=106-140; Score =44.6; E_value=3.5e-10; Accession=PF01535.11; Description=PPR repeat
  Pfam annotation: Domain name=PPR; Domain location=207-241; Score =36.9; E_value=7.4e-08; Accession=PF01535.11; Description=PPR repeat
  Pfam annotation: Domain name=PPR; Domain location=242-276; Score =10.8; E_value=0.41; Accession=PF01535.11; Description=PPR repeat
  Pfam annotation: Domain name=PPR; Domain location=278-312; Score=6.4; E_value=1.4; Accession=PF01535.11; Description=PPR repeat
  Pfam annotation: Domain name=PPR; Domain location=344-378; Score=9.5; E_value=0.58; Accession=PF01535.11; Description=PPR repeat
  Pfam annotation: Domain name=PPR; Domain location=490-524; Score =40.9; E_value=4.6e-09; Accession=PF01535.11; Description=PPR repeat
  Pfam annotation: Domain name=PPR; Domain location=591-625; Score =34.6; E_value=3.5e-07; Accession=PF01535.11; Description=PPR repeat
  Pfam annotation: Domain name=PPR; Domain location=626-660; Score=8.0; E_value=0.87; Accession=PF01535.11; Description=PPR repeat
  Pfam annotation: Domain name=PPR; Domain location=662-696; Score=6.1; E_value=1.5; Accession=PF01535.11; Description=PPR repeat
  Pfam annotation: Domain name=PPR; Domain location=7-41; Score=21.3; E_ value=0.0037; Accession=PF01535.11; Description=PPR repeat
  Pfam annotation: Domain name=PPR; Domain location=728-762; Score =15.9; E_value=0.1; Accession=PF01535.11; Description=PPR repeat
  Pfam annotation: Domain name=TPR_4; Domain location=277-302; Score =10.1; E_value=2.4; Accession=PF07721.5; Description=Tetratricopeptide repeat
  Pfam annotation: Domain name=TPR_4; Domain location=661-686; Score =8.3; E_value=4; Accession=PF07721.5; Description=Tetratricopeptide repeat
  Pfam module annotation: Pfam domain module=PPR::PPR::PPR::PPR::PPR::PP R::PPR::PPR::PPR::PPR::PPR::TPR_4::TPR_4; Domain location=106 -140::207-241::242-276::278-312::344-378::490-524::591-625::626 -660::662-696::7-41::728-762::277-302::661-686
MPHRNLVSWNSMIVGFVKNKLYGRAIGVFREVLSLGPDQVSISSVLSACAGLVELDFGKQVHGSIVKRGLVGLVYVKNSLVDMYCKCGLFEDATKLFCGGGDRDVVTWNVMIMGCFRCRNFEQACTYFQAMIREGVEPDEASYSSLFHASASIAALTQGTMIHSHVLKTGHVKNSRISSSLVTMYGKCGSMLDAYQVFRETKEHNVVCWTAMITVFHQHGCANEAIKLFEEMLNEGVVPEYITFVSVLSACSHTGKIDDGFKYFNSMANVHNIKPGLEHYACMVDLLGRVGRLEEACRFIESMPFEPDSLVWGALLGACGKHANVEMGREVAERLFKLEPDNPGNYMLLSNIYIRHGMLEEADEVRRLMGINGVRKESGCSWIDVKNRTFVFNANDRSHSRTQEIYGMLQKLKELIKRRGYVAETQFATNSVEGSEEQSLWCHSEKLALAFGLLVLPPGSPNSLVDVYCKCGLFEDATKLFCGGGDRNVVTWNVMIMGCFHCRNFEQACTYFQAMIREGVEPDGASYTSLFHASASIAALTQGTMIHSHVLKTGHVKDSHISSSLVTMYGKCGSMLDAYQVFRETKEHYVVCWTAMITVFHLHGCANEAIELFEEMLNEGVVPEYITFISILSVCSHTGKIDDGFKYFNSMANVHNIKPGLDHYACMVDLLGRVGRLEEACRFIESMPFEPDSLVWGALLGACGKHANVEMGREAAERLFKLEPDNPRNYMLLLNIYLRHGMLEEADEVRRLMGINGVRKESGCSWIDVNNRTFVFFANDRSLSRTQEIYGMLQKLHGFPLISTLNQSHCGVV

SEQ ID NO: 114261 - protein, 72 aa, Glycine max
  Coding DNA Sequence Number=SeqID_22576
MAEEDALSLDNIECGVCAEYTDADVYGRRNSGSNKEAFEMGERRLHLSWTHSERLQAYLETYEGRVDSGSTR

SEQ ID NO: 114262 - protein, 718 aa, Glycine max
  Coding DNA Sequence Number=SeqID_22577
  Gene Ontology: Mol. function=translation initiation factor activity; Cellular component=intracellular; Biological process=translational initiation
  Homolog annotation: Hit_ID=A2Z337; Match level="QueryCoverage=100%, HitCoverage=100%, E-value=0.0, Identity=64%"; Hit description =Translation initiation factor IF-2
  Pfam annotation: Domain name=ATP_bind_1; Domain location=204-363; Score=-74.5; E_value=0.092; Accession=PF03029.8; Description =Conserved hypothetical ATP binding protei
  Pfam annotation: Domain name=Arf; Domain location=201-361; Score= -101.3; E_value=0.076; Accession=PF00025.12; Description=ADP -ribosylation factor family
  Pfam annotation: Domain name=ArgK; Domain location=172-391; Score= -196.4; E_value=0.1; Accession=PF03308.7; Description=ArgK protein
  Pfam annotation: Domain name=DUF258; Domain location=229-481; Score= -169.8; E_value=0.016; Accession=PF03193.7; Description=Protein of unknown function, DUF258
  Pfam annotation: Domain name=GTP_EFTU; Domain location=197-363; Score= 210.3; E_value=4.5e-60; Accession=PF00009.18; Description=Elongation factor Tu GTP binding domain
  Pfam annotation: Domain name=GTP_EFTU_D2; Domain location=388-451; Score=25.9; E_value=0.00015; Accession=PF03144.16; Description =Elongation factor Tu domain 2
  Pfam annotation: Domain name=GTP_EFTU_D2; Domain location=627-695; Score=15.5; E_value=0.01; Accession=PF03144.16; Description =Elongation factor Tu domain 2
  Pfam annotation: Domain name=MMR_HSR1; Domain location=200-310; Score= 27.6; E_value=3.2e-06; Accession=PF01926.14; Description=GTPase of unknown function
  Pfam annotation: Domain name=Miro; Domain location=201-310; Score =19.4; E_value=0.00015; Accession=PF08477.4; Description=Miro-like protein
  Pfam module annotation: Pfam domain module=ATP_bind_1::Arf::ArgK::DUF2 58::GTP_EFTU::GTP_EFTU_D2::GTP_EFTU_D2::MMR_HSR1::Miro; Domain location=204-363::201-361::172-391::229-481::197-363::388-451::627 -695::200-310::201-310
  Subcellular localization annotation: CTP_CleavageSite=42; ConfidenceScore=5.37e-01
MAWRELGKKRIYMNFTRALSTTPFRHVAGSNFASIFTVQSVCASARCVPDFINLSSLGVAGFGRETKECGIRCFHASSQVWARSDGPLGLQTAKRIYVKRGGRNQLPAGAPYARRNVPATKCNPDKTIEIFEGMTLVELAKRTGRSVSSLQDILTNVGEKVQSEFELLSMDIAELVTMEAGINVKRLHSAEGAEILPRPAVVTVMGHVDHGKTSLLDALRQTSVAAKEAGGITQHIGAFVVVMPSGASITFLDTPGHAAFSAMRARGAAVTDIVVLVVAADDGVMPQTLEAMSHAKAANVPIVVAINKCDKPGANSEKVKMQLASEGLLLEEMGGDVQVVEVSATEKIGLDNLEEALLLQADMMDLKARIDGPAQAYVVEARLDKGRGPLVTTIVKAGTLVCGQHVVVGSQWGRIRAIKDMAGKLTRRATPAMPVEIEGLRGLPMAGDDVIVVHSEERARMLSSGRQRKYEENRLRNKMIQDKPTTSDDSKEVPQWVEMPVIVKADVQGTVQAVTDALKTLNSAQVFVNVVHVGAGPISQSDLDLAQACGACIVGFNVKSPPTALSQEAARAGIKIVLHRVIYHLLEDIGNLIIERAPGTSETHVAGQAEVLNIFEIKGSKSKGPDVKIAGCRVIDGSVTRSATLRLLRSGEVVFEGLCTSLKREKQDVDSVKKGTECGVVINNWCDFQIGDVIQCLEQVIRKPKFIKSESGAVRIEC

SEQ ID NO: 114263 - protein, 1220 aa, Glycine max
  Coding DNA Sequence Number=SeqID_22578
  Gene Ontology: Mol. function=protein tyrosine phosphatase activity
  Homolog annotation: Hit_ID=A2Q1S2; Match level="QueryCoverage=94%, HitCoverage=100%, E-value=0.0, Identity=74%"; Hit description=[2Fe -2S]-binding
MSQIPKEPEQVMKMRGGCVLGKKTILKSDHFPGCQNKRLSPQIDGAPNYRQASDSLHVHGVAIPTVHGIRNVLNHIGARLKVLWISLREEPLAYINGRPFVLRDVERPFSNLEYTGINRERVEQMEARLKEDILAEAARYGNKILVTDELPDGQMVDQWEPVSCDSVKTPLEVYEELQVEGYLVDYERVPITDEKSPKELDFDILVNKISQADVNTEIVFNCQMGRGRTTTGMVIATLVYLNRIGASGFPRSNSIGRIFQSMTNVADHLPNSEEAIRRGEYAVIRSLIRVLEGGVEGKRQVDKVIDKCASMQNLREAIATYRNSILRQPDEMKREASLSFFVEYLERYYFLICFAVYIHSERAALRSNTADHCSFADWMRARPELYSIIRRRDPMGALGYSSLKPSLKKIAESTDGRPSEMGVVAALRKGEVLGSQTVLKSDHCPGCQNPSLPERVDGAPNFREVPGFPVYGVANPTIDGIRSVIRRIGSSKGGRPILWHNMREEPVIYINGKPFVLREVERPYKNMLEYTGIGRDRVEKMEARLKEDILREAKQYGGAIMVIHETDDKHIFDAWEDVTSDVIQTPLEVFKSLEAEGFPIKYARMPITDGKAPKSSDFDTLANNIASAAKDTAFVFNCQMGRGRTSTGTVIACLVKLRIDYGRPIKILGGDVTHEESDCGSSSGDETGGYVNTLSSNTLQRKTDDEQNRAFGINDILLLWKITTLFDNGVECREALDAIIDRCSALQNIRQAVLQYRKVFNQQHVEPRVRRVALNRGAEYLERYFRLIAFAAYLGSEAFDGFCGQGESRMTFKVWLHQRPEVQAMKWSIRLRPGRFFTVPEDLREPQESQHGDAVMETIVKARNGSVLGKGSILKMYFFPGQRTSSHIQIHGAPHVYKVDEYPVYCMATPTISGAKEMLDYLGAKPKPSLTAQKAILTDLREEAVVYINYTPFVLRELNKPVNTLKYVGITGPVVEHMEARLKEDILAEIRQSGGRMLLHREEYNPSTNESGVVGYWENIRADDVKTPAEVYSALKDDGYDIVYQRIPLTRERHALASDIDAIQYCQDDPYPYCLETVIPQCFGGVAYAMAIICIRLDAGSKVSQPLFGPHIDAVTEEDLPSQTSNEMALSMGDYRDILNLTRVLIHGPQSKADVDIVIEREFEKFIDDDDEERGYLMDMGIKALRSYLYCTSPANTEFAAWMDARPELGHLCNNLRIDK

SEQ ID NO: 114264 - protein, 626 aa, Glycine max
  Coding DNA Sequence Number=SeqID_22579
  Gene Ontology: Mol. function=transporter activity; Cellular component= membrane; Biological process=oligopeptide transport
  Homolog annotation: Hit_ID=Q2HRU3; Match level="QueryCoverage=98%, HitCoverage=97%, E-value=0.0, Identity=75%"; Hit description=TGF -beta receptor, type I/II extracellular region
  Pfam annotation: Domain name=MFS_1; Domain location=29-533; Score =5.8; E_value=0.012; Accession=PF07690.7; Description=Major Facilitator Superfamily
  Pfam annotation: Domain name=PTR2; Domain location=91-529; Score =286.4; E_value=5.5e-83; Accession=PF00854.12; Description=POT family
  Pfam module annotation: Pfam domain module=MFS_1::PTR2; Domain location=29-533::91-529
MADHDAKEEQRPLNQWRRSKGGFMASMFIFVLSALDNMGFVANMVSIVLYFYGVMHFDLASSANTLTNFMGSTYLLSLVGGFISDTYLNRFTTCLLFGSLEVLALAMLTVQAASKHLHPEACGKSSCVKGGIAVMFYTSLCLLALGMGGVRGSMTAFGADQFDEKDPTEAKALASFFNWLLLSSTVGAITGVTGVVWVSTQKAWHWGFFIITIASSVGFVTLALGKQFYRIKTPGDSPTLRIAQVIVVSFKNRKLSLPESHGELYEISDKDATAEKIAHTNQMRSQQIGMLGFFFMYLVVGNAKHYGPTTTSARLGTAEIWGMNDYGRGKKSMQFLDKAAIIQESSKPQAWKICTVTQVEEVKILTRMLPIVASTIILNTCMAQLQTFSVQQGNVMDLKLGSLTVPAPSIPVIPLVFISVLVPLYELFFVPFARKITNHPSGITQLQRVGVGLVLSAISMAVAGIVEVKRRDQGRKDPSKPISLFWLSFQYGIFGIADMFTLVGLLEFFYRESPASMKSLSTSLTWLSTSLGYFLSTVFVNVINAVTKRITRSKQGWLHGFDLNQNNLNLFYWFLATLSCLNFFNYLYWASRYQYKREDSGPGFKPLGEMPLKRVERKQDCEVSRE

SEQ ID NO: 114265 - protein, 902 aa, Glycine max
  Coding DNA Sequence Number=SeqID_22580
  Gene Ontology: Mol. function=G-protein coupled photoreceptor activity; Cellular component=membrane; Biological process=regulation of transcription, DNA-dependent
  Homolog annotation: Hit_ID=P93673; Match level="QueryCoverage=98%, HitCoverage=94%, E-value=0.0, Identity=63%"; Hit description =Phytochrome type A
  Pfam annotation: Domain name=GAF; Domain location=176-336; Score =40.8; E_value=4.9e-09; Accession=PF01590.17; Description=GAF domain
  Pfam annotation: Domain name=HisKA; Domain location=783-846; Score =33.4; E_value=8e-07; Accession=PF00512.16; Description=His Kinase A (phosphoacceptor) domain
  Pfam annotation: Domain name=PAS; Domain location=529-646; Score =76.9; E_value=6.8e-20; Accession=PF00989.15; Description=PAS domain
  Pfam annotation: Domain name=PAS; Domain location=661-787; Score =61.8; E_value=2.3e-15; Accession=PF00989.15; Description=PAS domain
  Pfam annotation: Domain name=PAS_2; Domain location=26-142; Score =177.6; E_value=3.1e-50; Accession=PF08446.2; Description=PAS fold
  Pfam annotation: Domain name=PAS_4; Domain location=535-651; Score =7.2; E_value=0.041; Accession=PF08448.1; Description=PAS fold
  Pfam annotation: Domain name=Phytochrome; Domain location=347-501; Score=253.9; E_value=3.5e-73; Accession=PF00360.11; Description =Phytochrome region
  Pfam module annotation: Pfam domain module=GAF::HisKA::PAS::PAS::PAS _2::PAS_4::Phytochrome; Domain location=176-336::783-846::529 -646::661-787::26-142::535-651::347-501
MSPAGTGGGTVSGEHEPKSDRAATTAYLHQMQKGKLIQPFGCLLVLDEKTYKVIAYSENAPEMLTMASHAVPSVDDHPALDIGTYIRTIFTAPSIASIHKVLGFGDLSLHNTILVHCKTFGNPFYAIIHLVTGSTIIDFESVQPPEVPMTASGSLQSYYKLAAKATTRLQSLATVNMETLCNTMVQEVFELTGYDRVMAYKFHDDDHGEVIAEVKRPGLEPYLGLHYPATDIPHATRFSLWRTRAAHSCHLQFMVNMNSSASLVLAVVINDNDEDGNSSDDAAVQQPHKSSTSLWGLVVCHHTTPKFVPQGRFKDLRGLKQIYFLSICHPRVGKELEIEYQIVEKNILRTQTHLFDVLTRDEPLAIVSQSPNMMDLVKCDGATLLYKNKVWRLGVTPSESQIREIALWLSQCHRDSTGFPGAAALGDIACGMTSARITSKDIVFWFWSHTAAEIRCDGAKHEPGERDDVVKNRSLLWKVYETDAIHSLHLILRDAFKETESMKIATYAPNSRLGCLNIEETQGLEAVTNEMVRLIETATVPVLAVDVNGMVNGWNTKIAELTGLPSDEAMGKHFLTLVEDFSVDRVKKMLHMALQGEEEEERNVQFEINTYDFKIDSGPASLVVNACASRDLQDNIVGVCFVAQGITAQKTMMEKFPRIEGDYKAIVQNPNPSIPPLFSTDEFGWCCEWNSAMAKLTGWKREEVMDKMLLGEIFGTQIAGCRLRNHEAVVNFSIVLNTAMAGLETEKVPIGFFTRDGKHVESSPELQQALHIQLLSEQTAMKRLKDLNYLKRQIRNPLYGIMFSRKLLEGTELGAEQKQFLQMSTQCQHQLSKILDDSDLDSIIDGITHDGFGVPETLLNQMFGRDGHESEEGISMLISRKLMKGDVRYIREAGKIIFHLIC

SEQ ID NO: 114266 - protein, 295 aa, Glycine max
  Coding DNA Sequence Number=SeqID_22581
  Gene Ontology: Mol. function=aminoacyl-tRNA ligase activity; Cellular component=cytoplasm; Biological process=tRNA aminoacylation for protein translation
  Homolog annotation: Hit_ID=P93736; Match level="QueryCoverage=93%, HitCoverage=37%, E-value=6e-43, Identity=60%"; Hit description=Valyl- tRNA synthetase
  Pfam annotation: Domain name=Anticodon_1; Domain location=68-196; Score=-45.2; E_value=0.077; Accession=PF08264.4; Description =Anticodon-binding domain
MVMQGLKLGGDVPFTKIYLHPMVRDAHGRKMSKSLGNVVDPIEVINGISLEGLHKRLEAGNLDPKELAIAIEGQKKDFPNGIDECGVDALRFALVSYTAQVSISFQCFIWLIFSPICFRKTLCTRYFVEELWQRLPSTRECERAESIMICDYPSTVEGWNNEKVENDMDIIESTVKSLRSLAKESCDSHQLDIATLANLSSLTVITEKDAVSSGYADAVVNENLSVYLEFQGANSAEAEGKIKKIDELQKQIERLEKMMNAKGYEEKVLPNIREKNQEKLDSLKLLLKEMAGLTL

SEQ ID NO: 114267 - protein, 241 aa, Glycine max
  Coding DNA Sequence Number=SeqID_22582
  Gene Ontology: Mol. function=transition metal ion binding; Cellular component=integral to membrane; Biological process=transcription initiation from RNA polymerase II promoter
  Homolog annotation: Hit_ID=A9P9Z4; Match level="QueryCoverage=94%, HitCoverage=97%, E-value=5e-65, Identity=60%"; Hit description =Putative uncharacterized protein
  Pfam annotation: Domain name=Cyt-b5; Domain location=72-185; Score =60.1; E_value=7.6e-15; Accession=PF00173.19; Description=Cytochrome b5-like HemeSteroid binding
MAVQLWETLKEAIVAYTGFSPSTFFTVLALLFAVYYVVTGLFGSSDDHHHRHRHVEEEEEMPPLRPPVQLGEITAEELKAYDGTDPEKPLLMAIKAQIYDVSQSRVLTPLIFIMWNCVLPRMFYGPGGPYALFAGKDASRALAKMSFEEKDLTGDISGLGPFELDALQDWEYKFMSKYVKVGTVKSEEVPVTEPESIGEPLESTSRDIDAAAKPTDTEDGKLETPAVKSDETPSNVDADKE

SEQ ID NO: 114268 - protein, 317 aa, Glycine max
  Coding DNA Sequence Number=SeqID_22583
  Gene Ontology: Mol. function=sequence-specific DNA binding; Cellular component=nucleus; Biological process=regulation of transcription, DNA-dependent
  Homolog annotation: Hit_ID=A7QKH6; Match level="QueryCoverage=90%, HitCoverage=98%, E-value=2e-72, Identity=49%"; Hit description =Chromosome chr2 scaffold_112, whole genome shotgun sequence
  Pfam annotation: Domain name=HSF_DNA-bind; Domain location=22-224; Score=161.9; E_value=1.7e-45; Accession=PF00447.8; Description=HSF -type DNA-binding
MAPPLEHNGVSTSGDSQRSIPTPFLTKTYQLVDDHTIDDVISWNDSGSSFIVWNTTAFAKDLLPKYFKHNNFSSFVRQLNTYGFRKVVPDRWEFSNEYFRRGEKRLLCEIQRRKILSASPPPAGATATVAVPSPLPLSAIPTAKPIVSPSNSAEEQVLSSNSSPARAPVELLDENERLRKENILLTKELVKMRSLCNNIFNLMSNYANAQADGSSAAAAKRCSGEDAVEEMNPKLFGVAIGKKRAREEEGHGAKYDTALSLHQPFHADVKSEALDLPGRGENKKTPWLNQCHRANQRKKRLVSVQTFDVSLYSSGQQ

SEQ ID NO: 114269 - protein, 239 aa, Glycine max
  Coding DNA Sequence Number=SeqID_22584
  Gene Ontology: Mol. function=protein binding; Cellular component =integral to membrane; Biological process=vesicle-mediated transport
  Homolog annotation: Hit_ID=A7QZ52; Match level="QueryCoverage=67%, HitCoverage=91%, E-value=3e-61, Identity=73%"; Hit description =Chromosome undetermined scaffold_265, whole genome shotgun sequence
MVKVTIVGRVSDGLPLAQGLRYMNEEYGYLSCYRQQAEFILREFSRGALTAPKMTIHIDNFCFNYLVENGVVFIVLCESTYPRKLAFHYLQDIQKEFEKFDKTLIGKITRPYSFVKFDGIIANISRQYIDTRTQANLSKLNANRKQDLDIATEDIYKILERKRNSETMRRLPVTPQPESTIWCSPQLEMVSISGVRGKNKGMEWPIAIPSPAHNPGKTEKERYRLKKNSDLSRNFYSLP

SEQ ID NO: 114270 - protein, 197 aa, Glycine max
  Coding DNA Sequence Number=SeqID_22585
  Gene Ontology: Mol. function=galacturonate binding; Cellular component=plasma membrane; Biological process=cell-cell signaling
  Homolog annotation: Hit_ID=P93788; Match level="QueryCoverage=79%, HitCoverage=78%, E-value=9e-45, Identity=63%"; Hit description =Remorin
  Pfam annotation: Domain name=Remorin_C; Domain location=85-194; Score= 174.2; E_value=3.4e-49; Accession=PF03763.4; Description=Remorin, C -terminal region
  Pfam annotation: Domain name=Remorin_N; Domain location=28-83; Score =49.5; E_value=1.2e-11; Accession=PF03766.4; Description=Remorin, N -terminal region
  Pfam module annotation: Pfam domain module=Remorin_C::Remorin_N; Domain location=85-194::28-83
MTEEQLKKVAQTESISPNPAPEPEPEPAVPKEEVAEEKSVIPQPSSSPSDESKALVIVEKTSEVAQEKPIEGSVNRDAVLARVATEKRLSLIKAWEESEKSKSENKSHKKLSVISAWENSMKAAAEAELRKIEEQLEKKKAEYGEKLKNKIATIHREAEEKRAFIEAQKGEDFLKAEETAAKYRATGTAPTKLFGCF

SEQ ID NO: 114271 - protein, 37 aa, Glycine max
  Coding DNA Sequence Number=SeqID_22586
MGGGKGSGSWMRGRGRGGGERGHDKGSRRKKKKKVVT

SEQ ID NO: 114272 - protein, 213 aa, Glycine max
  Coding DNA Sequence Number=SeqID_22587
  Gene Ontology: Cellular component=cellulose and pectin-containing cell wall
  Homolog annotation: Hit_ID=A7QG16; Match level="QueryCoverage=77%, HitCoverage=41%, E-value=2e-71, Identity=72%"; Hit description =Chromosome undetermined scaffold_91, whole genome shotgun sequence
  Pfam annotation: Domain name=PAE; Domain location=2-198; Score=34.6; E_value=5.1e-18; Accession=PF03283.4; Description=Pectinacetylesteras e
MAGRFLSSKLKEIISRLYKAYLYQLLKLKSKEKTVQCIQQSNMTISCAQGIEKNLNGNCTRALYFPDLCFFPQYALRYISTPYFILNSAYDVFQFSHILVPPSADMHGHWKQCKANLAECTADQIDTLQGFRLDMLGALRPFYMNSRRGGMFINSCFAHCQSELQETWFGDDSPRINNKTIAEAIGDWYFSRNISKEIDCAYPCDATCHNLIP

SEQ ID NO: 114273 - protein, 83 aa, Glycine max
  Coding DNA Sequence Number=SeqID_22588
  Homolog annotation: Hit_ID=A7QG16; Match level="QueryCoverage=66%, HitCoverage=13%, E-value=3e-12, Identity=67%"; Hit description =Chromosome undetermined scaffold_91, whole genome shotgun sequence
MIKMNLAFAFLCLFTVEPWRVCSQQQQQRLLVNMTLVPSARASGALCLDGSLPAYHLHRGFGAGKDNWLLQFEVRRTSSTSSK

SEQ ID NO: 114274 - protein, 494 aa, Glycine max
  Coding DNA Sequence Number=SeqID_22589
  Gene Ontology: Mol. function=drug transporter activity; Cellular component=membrane; Biological process=multidrug transport
  Homolog annotation: Hit_ID=Q0WWD0; Match level="QueryCoverage=99%, HitCoverage=99%, E-value=0.0, Identity=65%"; Hit description =Putative uncharacterized protein At4g25640
  Pfam annotation: Domain name=MatE; Domain location=267-430; Score =120.2; E_value=6e-33; Accession=PF01554.9; Description=MatE
  Pfam annotation: Domain name=MatE; Domain location=48-208; Score =138.3; E_value=2.1e-38; Accession=PF01554.9; Description=MatE
  Pfam module annotation: Pfam domain module=MatE::MatE; Domain location=267-430::48-208
MDAPLLLVNGEGAALVAENGDYVAVRELKEVKKVFWIETKRVWEIAMPIVFNIWCQFGVNSVTSMFVGHLGDIQLSAISLINSVIGTFAFGFMLGMGSATETLCGQAFGAGQVNMLGVYMQRSWVILSVTSILLLPIYIFAAPILKLLGQQEDIADLAGSFSILVIPQFLSLPFNFPTQKFLQAQSKVKVIAWIGLVALILHIGMLWFLIYVLDFGLAGAALAFDITSWGITVAQLVYVVIWCKDGWNGLSWLAFKDIWAFVRLSLASAVMLCLEVWYMMSVIVLAGHLDNAVIAVDSLSICMNINGWEAMLFIGVNAAVSVRVSNELGLGHPRAAKYSVYVIVFQSLFLGIFFMAIILATRDYYAIIFTNSEVLHKAVAKLGYLLSVTMVLNSVQPVVSGVAIGGGWQALVAYINIGCYYLFGLPLGFVLGYTANLGVEGLWGGMICGIVLQTLLLLLILYKTNWKKEVEQTAERMRIWSGQDIGVDKIVASA

SEQ ID NO: 114275 - protein, 399 aa, Glycine max
  Coding DNA Sequence Number=SeqID_22590
  Homolog annotation: Hit_ID=A5BUA2; Match level="QueryCoverage=39%, HitCoverage=33%, E-value=5e-10, Identity=32%"; Hit description =Putative uncharacterized protein
MATRTGRLFQNQNLNVHVNGGGTVSEKADLTGQRKVRAGGRKPLGDLSNAGNLINHFDGKKGLDGSLYTGKPSVSQAQAPKLHKSKNLESDKRIPASEKSLTRSRKALSDISNSGKPQVPEIKNKKTLKPLEESLPPSAISEEQILHDHKKCIKSQFETADVHQFFKTVGLEDDDHMAISFELSAISKQKSESAYLELEEVPEWLPEVHSLSVLHGGSPAVHCKTPGLSNNDRFFGRHVLFILDIFCATDGVGSYVSIADFVMTIKSFVYYMEQHIIDLNSHSEPPAMLHICRISDVLILQLQRLFKHLVHNEVVEYCICMGRVQRASLLVGISGIAHILHYCMGLVHPTRLKKRRCEILLMNSLSETDWLSESHPLSEAASSLSGCKTLEEDKSEISA

SEQ ID NO: 114276 - protein, 170 aa, Glycine max
  Coding DNA Sequence Number=SeqID_22591
  Gene Ontology: Mol. function=tRNA dihydrouridine synthase activity; Biological process=metabolic process
  Homolog annotation: Hit_ID=A5ATX9; Match level="QueryCoverage=61%, HitCoverage=34%, E-value=6e-13, Identity=39%"; Hit description =Putative uncharacterized protein
MESREGKSISDLEEEFFHKFRDFMTGKTNDHEGLILRHPIYHLPYDRITKIDELGIAGSKLLSGFQQALEFIRRPPIDMNSKLVHKIIVANETERVKAYINSGCRKLNERSNCKVWDLSPPLEVWDSSLGFTRFSTLQLQQLACGVVLPRFLSIDIRAFHRVSWLHCIFA

SEQ ID NO: 114277 - protein, 190 aa, Glycine max
  Coding DNA Sequence Number=SeqID_22592
  Gene Ontology: Mol. function=hydrolase activity; Biological process =cell redox homeostasis
  Homolog annotation: Hit_ID=Q0H8Z8; Match level="QueryCoverage=53%, HitCoverage=30%, E-value=2e-40, Identity=81%"; Hit description=Beta -carotene hydroxylase
GPFELNDVFAIINAVPAIVLLSYGFFHKGLVPGLCFGAGLGITVFGMAYMFVHDGLVHKRFPVGPIANVPYFRRVAAAHQDLNYDLMTLNFCGLYSAPPFGQIQRGAIWLVFGTKAFQLKIFVTGKDLWGHIDGSNPTPNEATHKEEHVKWGHIVLALATSQSWPLYQLDVKNAFLHGDLKEEFYIKLPI

SEQ ID NO: 114278 - protein, 59 aa, Glycine max
  Coding DNA Sequence Number=SeqID_22593
MALLELVNVIDSLGYDLRNPARVPLPLILQSYFIVTSCQEYQAKESSRSPNKSFWHQLG

SEQ ID NO: 114279 - protein, 474 aa, Glycine max
  Coding DNA Sequence Number=SeqID_22594
  Gene Ontology: Mol. function=hydrolase activity, acting on glycosyl bonds; Biological process=cell wall organization and biogenesis
  Homolog annotation: Hit_ID=Q2HUV5; Match level="QueryCoverage=11%, HitCoverage=11%, E-value=1e-17, Identity=73%"; Hit description =Glycoside hydrolase, family 28
MLDEVCHRVKCSVRAAEKSIIMNVTNNIIIDLSFSTMWFKDEPGGRNNGLIDGQGAYWWNKFHQGQLTLTRPYLIETMYSDQIQISFLTLVNSPTWFAHVMESLKKSMPPSFLSKENCGNHKKNHCEVAHEQGFMELQLSNTPVSVYDSPGRISTSDPSEAYISPTSVEKAKQFVSMIDDCESSTVYCKGISVRMKQNPPCPADFQIHRELESKSFSCSFDGESNSSFELCLPDEDSLITLDELFLMPDAENLVMFDSSVSSSAESNLIEADVFSPSSPREMVEKLVEFILNDEISTPHVDNLIVHHGAGLGRFSHSMHAQQTPLKFCSNQLNPERDPQDHNKFQRNSIDSAIYSFFSHPFPSNTFSQPFPLYHDELKRFDHEVSQSMLQQIINPGKLNLCSLQSGVTPHLPALQMASCTQAKSNADSSLCISGTKELWGFCKTKSRINPALVDNFIEEKLRVSHWHPYVQGFW

SEQ ID NO: 114280 - protein, 533 aa, Glycine max
  Coding DNA Sequence Number=SeqID_22595
  Gene Ontology: Mol. function=aspartic-type endopeptidase activity; Biological process=proteolysis
  Homolog annotation: Hit_ID=A7QKE3; Match level="QueryCoverage=92%, HitCoverage=95%, E-value=1e-141, Identity=82%"; Hit description =Chromosome chr2 scaffold_112, whole genome shotgun sequence
  Pfam annotation: Domain name=SPX; Domain location=2-148; Score=113.8; E_value=5.1e-31; Accession=PF03105.10; Description=SPX domain
MVAFGKKLKERQIQEWQRYYINYKLMKKRVKQYAQQIQLGTLDRRHVLKDFSRMLDNQIEKTVLFLLEQQGLLASRIAKLGEEHEVIQQEPHISRIAELREAYRAVGQELLKLLFFVEVNAVGLRKILKKFDKRFGYKFTDYYVKTRANHPYSQLQQVFKHVGFGAVVGALSRNLHELQENQESQGSFLSIYDQPTLPLQDPVIDSIRAAIDRLSNSTNFLNFLGQHALIMHEELPAPVDEHVDDQRYHFMSLFLNLANTFLYMVNTYIIVPTADDYSMSLGAAPTVCGIVIGAMAVAQVDEDDDQDYDDSEEAPEDSRQPANSIGAAYRLLTPSVKVQLLIYFMLKYAMEILLSESSVITTYYFNWTTSTVSIFLACLGLTVLPVNIIVGSYISNMFEDRQILLASEVMVFVGILFSFHVIFPYTEPQYICSGLLMFVSAEVLEGVNLSLLSRVMSSRLSRGTYNGGLLSTEAGTLARVIADATITLAGYGVHEMSQAFAAKERGEELESMLWDLDMTISFMEIPKGLPPLM

SEQ ID NO: 114281 - protein, 678 aa, Glycine max
  Coding DNA Sequence Number=SeqID_22596
  Gene Ontology: Mol. function=nucleoside-triphosphatase activity; Cellular component=protein complex; Biological process=cell division
  Homolog annotation: Hit_ID=A7QNG1; Match level="QueryCoverage=100%, HitCoverage=82%, E-value=0.0, Identity=59%"; Hit description =Chromosome chr2 scaffold_132, whole genome shotgun sequence
  Pfam annotation: Domain name=AAA; Domain location=362-546; Score =264.5; E_value=2.3e-76; Accession=PF00004.20; Description=ATPase family associated with various cellular activities (AAA)
  Pfam annotation: Domain name=AAA_3; Domain location=362-488; Score= -9.5; E_value=0.0037; Accession=PF07726.2; Description=ATPase family associated with various
  Pfam annotation: Domain name=AAA_5; Domain location=362-494; Score =2.6; E_value=0.0018; Accession=PF07728.5; Description=ATPase family associated with various
  Pfam module annotation: Pfam domain module=AAA::AAA_3::AAA_5; Domain location=362-546::362-488::362-494
MQRKYGCPRKEPSFQRSISEVTLERVSGLFGSLSVLPSTGRTRGTLHRQSSGIENSSNPPKLRRNASTACDTISTPQYGPSDPAPLKCTSGFCFDEKLFVQSLYKVLVSLSETSSVILYIKDVEKLFVRSTRLHNLFQKLIKKLSGSVLILGSQIFDSEDDCAEIDEKLTMLFPYNIDIKPPQDETHLASWRTKLKKDMETSLFQDSRNHIAEVLAANDVDCDDLEKVSNADTMLLSNCIEEIVASAISHHLMETKHPEYRNRKLVISHKSLSHVLNLFQESESNPENKDSNKEDALATKKDGDNEFEKHMREEVVPANEIGVTFEDIGALDDIKELLQDVVMLPLRRPDLFKGGLLKPYKGILLFGPPGTGKTMLAKAIANEAGASFINVSISKITSKWFGEDEKNVRALFSLAAKVAPTIIFIDEVDSMLGKRTKYGEHEAMRKIKNEFMAHWDGLLTEPNERILVLAATNRPFDLDEAIIRRFERRIMVGLPSAENREMILKTILAKEKYENIDFKELSTMTEGYTGSDLKNLCTAAAYRPVREVLQQDRLKEKEKKKAEVEVQRSEDASDAKGDKDEVTTLRCLNVEDIRHCSQEKKKTEAEVQSSQNASDAKGDKDDQVMTLRPLNMEDMRLAKSQVAASFAAEGSIMSELKEWNELFGEGGSRKKQQLTYFL

SEQ ID NO: 114282 - protein, 451 aa, Glycine max
  Coding DNA Sequence Number=SeqID_22597
  Gene Ontology: Mol. function=peptidase activity; Cellular component =integral to membrane
  Homolog annotation: Hit_ID=A7QNG0; Match level="QueryCoverage=45%, HitCoverage=58%, E-value=5e-89, Identity=77%"; Hit description =Chromosome chr2 scaffold_132, whole genome shotgun sequence
  Pfam annotation: Domain name=Abi; Domain location=359-449; Score =93.4; E_value=7.2e-25; Accession=PF02517.7; Description=CAAX amino terminal protease family
MAPKFEPGSQIKMGEGMSERWKEWSSSVPPTLAAIVTRENEQRGMTAMVGGAGTGVGCCYLSAGSGGGAGVGGGVGMNGDGGVGGGVSMSGGVGISSGGGVVGRVGMSNEVNMSGGVGMGVCARSAFAEEEDGVVVEEEGGGKREVAGWCGLQQMMNERIDFVRELLNSVSEIKLEEEVRRAPMLALPKLLASRHQQPPKEKKKTQGRRGVDSGGKEASSIFKLEWGGHNCHSWCGTLDSSLDSKDHCSAYTAGFRKESLTYRGQALCSLLTDVAEGVVGIAILRHCLAKFQPLSSDWFKFEVKGKWQFDVGLGCLMFPLINQLSQMNLNLLPVLQYTPVTISSVEQSIVARDPVAMALYAVVVSVCAPIWEEIVFRGFLLPSLTKYMPVWSAILVSSIAFALAHFNIQRMLPLVFLGMVMGTVFVRSRNLFPSMLLHSLWNAFVFLDLMK

SEQ ID NO: 114283 - protein, 482 aa, Glycine max
  Coding DNA Sequence Number=SeqID_22598
  Gene Ontology: Mol. function=molecular_function; Cellular component =cellular_component; Biological process=biological_process
  Homolog annotation: Hit_ID=A7QGE6; Match level="QueryCoverage=94%, HitCoverage=72%, E-value=1e-144, Identity=58%"; Hit description =Chromosome undetermined scaffold_91, whole genome shotgun sequence
  Pfam annotation: Domain name=WD40; Domain location=304-342; Score =45.6; E_value=1.8e-10; Accession=PF00400.23; Description=WD domain, G-beta repeat
  Pfam annotation: Domain name=WD40; Domain location=350-388; Score =5.3; E_value=7.1; Accession=PF00400.23; Description=WD domain, G -beta repeat
  Pfam module annotation: Pfam domain module=WD40::WD40; Domain location=304-342::350-388
MEKMQHAEELVREFLVFRGFTNTLESYEAELRTDIGKGFEVDKILDLIFSLYVPKFHADSLLALLAFFKHYLSSSSDAPLASTLSKLETSLLRFYVVHAVQCNRNDKVVDFFTLYGAELLQRSQDWTNWFAIPYKKNPHLDPEFRVFFSKEWYQALHLSSRNFFSEVSSEMNATNLLKRDIVHLNLKLSQLQASLDEKEVQLRQFRSMEGGSTGSSSTLREKTARMSKDSPEVFPAGVARVGLTESSQDSVAGGLGNIHSELIGSTSGDDSAFLSNDHLRNGGADNAENGGEVYGEEYFSEVQVEHQETFLGHTSPISRCRFSASGNNIASASLDGTVRIWTYDTSTPVSRNATIYCGTEILSLDWEFVPLDKKLLIGTSDGCIKAWNVDAKRVVCDLNTTEAFPSVLDIKCSPVEPIFVSAAASGGAGSNYIDHLGFASLTVWNMKTWKAMSFLLEKIRQQLLLYALITMERFWQLLLLME

SEQ ID NO: 114284 - protein, 321 aa, Glycine max
  Coding DNA Sequence Number=SeqID_22599
  Gene Ontology: Mol. function=hydrolase activity, hydrolyzing O -glycosyl compounds; Cellular component=vacuole; Biological process =carbohydrate metabolic process
  Homolog annotation: Hit_ID=O48642; Match level="QueryCoverage=100%, HitCoverage=100%, E-value=0.0, Identity=92%"; Hit description=Class III acidic endochitinase precursor
  Pfam annotation: Domain name=Glyco_hydro_18; Domain location=29-285; Score=70.7; E_value=4.8e-18; Accession=PF00704.19; Description =Glycosyl hydrolases family 18
MASERQALMLILLTTFFFTIKPSQASTTGGITIYWGQNIDDGTLTSTCDTGNFEIVNLAFLNAFGCGITPSWNFAGHCGDWNPCSILEPQIQYCQQKGVKVFLSLGGAKGTYSLCSPEDAKEVANYLYQNFLSGKPGPLGSVTLEGIDFDIELGSNLYWGDLAKELDALRHQNDHYFYLSAAPQCFMPDYHLDNAIKTGLFDHVNVQFYNNPPCQYSPGNTQLLFNSWDDWTSNVLPNNSVFFGLPASPDAAPSGGYIPPQVLISEVLPYVKQASNYGGVMLDQIKDYVPKYAMRFVTAVSDAIYESVSAATHRILQKKPY

SEQ ID NO: 114285 - protein, 156 aa, Glycine max
  Coding DNA Sequence Number=SeqID_22600
  Homolog annotation: Hit_ID=A7QTS7; Match level="QueryCoverage=100%, HitCoverage=10%, E-value=2e-31, Identity=39%"; Hit description =Chromosome undetermined scaffold_171, whole genome shotgun sequence
MAGFWSVFCGESGCSEAGKMPGSYDFRLLIDPSTCVNHLLISCFDVLLLIMLVFIMIQKSTLKPSRGLIQVQRYPYFQLVSAIVNGALGLAHLCFGIWVLEETLRKNQTVLPLNWWLLEIFHGLTWLLVSLTISLKLKQLPRAWSGFFSVLIFLVS

SEQ ID NO: 114286 - protein, 570 aa, Glycine max
  Coding DNA Sequence Number=SeqID_22601
  Gene Ontology: Mol. function=drug transporter activity; Cellular component=membrane; Biological process=multidrug transport
  Homolog annotation: Hit_ID=A7QVK5; Match level="QueryCoverage=89%, HitCoverage=91%, E-value=0.0, Identity=68%"; Hit description =Chromosome chr16 scaffold_189, whole genome shotgun sequence
  Pfam annotation: Domain name=MatE; Domain location=297-460; Score =150.2; E_value=5.5e-42; Accession=PF01554.9; Description=MatE
  Pfam annotation: Domain name=MatE; Domain location=76-236; Score =143.3; E_value=6.9e-40; Accession=PF01554.9; Description=MatE
  Pfam module annotation: Pfam domain module=MatE::MatE; Domain location=297-460::76-236
MCHITSHLPCKCNSNPEYVVSMKPPEADMMITNPLIQKDITVTLTTLHEEKNDPRTMQTHHHVLKELISICKIAFPMILTGLLLYCRSMISMLFLGRLGELALAGGSLAVGFANISGYSILSGLAVGMESICGQAYGAKKFSLLGLCLQRTILLLLFTCIPISLLWLYMKHILLLCGQDEAIATQAQSYLLYSIPDLLAQSFLHPLRIYLRSQSITLPLTLCATFSILLHIPINYLLVSHLNWGIKGVALSGVWTNLNLVASLILYIVFSGTHKKTWGGFSFECFTQWKSLLNLAIPSCISVCLEWWWYEIMILLCGLLVNPRATVASMGILIQTTSLLYIFPSSISFSVSTRVGNKLGAQKPSKAKFSSIVGLSCSFMLGVFALVFTILVRNIWANMFTQDKEIITLTSFVLPVIGLCELGNCPQTTGCGVLRGTARPKVGANINLGCFYLVGMPVAVWLGFFAGFDFQGLWLGLLAAQGSCAVTMLVVLSRTDWDAEALRAKKLTSVVVDDSKEVGAEKPPKAEIKEDSLLSLADSDEDKQSNKNQKGKIKQDKGRERNLSGILSLAV

SEQ ID NO: 114287 - protein, 327 aa, Glycine max
  Coding DNA Sequence Number=SeqID_22602
  Gene Ontology: Mol. function=phosphoric ester hydrolase activity; Cellular component=cytoplasm; Biological process=carbohydrate metabolic process
  Homolog annotation: Hit_ID=P46276; Match level="QueryCoverage=100%, HitCoverage=99%, E-value=1e-166, Identity=84%"; Hit description =Fructose-1,6-bisphosphatase, cytosolic
  Pfam annotation: Domain name=FBPase; Domain location=13-325; Score =625.8; E_value=3.8e-185; Accession=PF00316.11; Description=Fructose -1-6-bisphosphatase
MDHSADAQRTDLMTITRFVLNEQSKHPESRGDFSILLSHIVLGCKFVCSAVNKGEEQKKLDVLSNDVFIKALISSGRTIFSQCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 114288 - protein, 270 aa, Glycine max
  Coding DNA Sequence Number=SeqID_22603
  Gene Ontology: Mol. function=pyridoxal phosphate binding; Biological process=carboxylic acid metabolic process
  Homolog annotation: Hit_ID=A7QN02; Match level="QueryCoverage=53%, HitCoverage=41%, E-value=2e-42, Identity=47%"; Hit description =Chromosome undetermined scaffold_129, whole genome shotgun sequence
MAFISAVHATELLPNVVRGAKVTTRREKYENNNSHMNLAITQCSGDTQANLASATAYCVETLNQYSLCNLGTIDVDTDIGHGHVDTSHFEKVNEMLIYLSVSVSDTDTCRTPGHGKGMECPYFIGTTMKGAIDDLDLVIQTLEGCGFTRDRFYIHCDGALFGMMLPFVKQTLRITFKKPIGSVTISGHKFLGCPIPCGLIGLQDEVQKCIMKARYLQNRLGDAGIGTILNKFSNIVIFERPLDHDFTRTMLEFGMQWEYCTCDGDATHYR

SEQ ID NO: 114289 - protein, 92 aa, Glycine max
  Coding DNA Sequence Number=SeqID_22604
MTCGDEVGGAYRAHTDLATGPGMGCGLDCEGGGGKEGGGGGNTVGGDGHGGEWRHLKENSVTTMAMQMNMSDDGGGTQTKTKELWQHGGIWT

SEQ ID NO: 114290 - protein, 630 aa, Glycine max
  Coding DNA Sequence Number=SeqID_22605
  Gene Ontology: Mol. function=DNA binding; Cellular component=nucleus; Biological process=regulation of transcription
  Homolog annotation: Hit_ID=A7Q7B9; Match level="QueryCoverage=91%, HitCoverage=89%, E-value=7e-53, Identity=56%"; Hit description =Chromosome chr18 scaffold_59, whole genome shotgun sequence
MELIGDTTTVMETSSGEAVAAHDGGEVIMMDANSGEEENNNKGEEGEEEEEGDNKINSNNNSLCGGNRWPRQETLALLKIRSDMDAVFRDSSLKGPLWEEVARKLSELGYHRSAKKCKEKFENVYKYHKRTKESRSGKHEGKTYKFFDQLQALENQFTVSYSPKPQPTLATTTNIITLPPPTRPSDTTAISYVTTTVPSTNPTIISPSPQPPTHATTTTTITSPTVATNPKNPPQSNNNSNIPNYSLLNMNNLFSTTSTSSSTASDEDLEEKYRKKRKWKDYFRRLTRQVLAKQEEMQKRFLEAIDNREREQVAQQEAWRIQEMARINREHELLVQERSTAAAKNAAVIAFLQQLSGQHQNSTTTKAGANFLQQPLPQQVQPPPQQAPQPLMMSNNNNIEIQKMNNGHSVVAAATPTTVVAATAIATTAVTTTPSSLSSLSSSRWPKTEVHALIRLRTSLEAKYQENGPKAPFWEDISAGMLRLGYNRSAKRCKEKWENINKYFKKVKESNKQRREDSKTCPYFHELEALYKEKSKTTQNPFGASFHNMKPHEMMEPLMVQPEQQWRPPTQYEQGAAKENNNSERKEREEEEEEEDDDENEEGDLESVEDEGGNRYEIATNKLSSVDTVE

SEQ ID NO: 114291 - protein, 297 aa, Glycine max
  Coding DNA Sequence Number=SeqID_22606
  Gene Ontology: Biological process=response to stress
  Homolog annotation: Hit_ID=Q9SRD6; Match level="QueryCoverage=55%, HitCoverage=68%, E-value=8e-27, Identity=43%"; Hit description =Putative heat shock protein; 50341-51150
  Pfam annotation: Domain name=HSP20; Domain location=86-190; Score =2.8; E_value=0.0013; Accession=PF00011.12; Description=Hsp20alpha crystallin family
MNKCFTCHSFVLGATKLYSDTLKIARRHVYSNKNKKLKPLARFHCFQEKLRIMEVELGLKITRTRYDSTSVSDFQFAKDRSGPVFLSKETDAKLILTAHLKGYKKEDIGININKDGSEISVSGEKEVQEMQMIPFKKELKTIGFEKKFGIPDGVVLDWIKAKYNEGDEVLTIVMPKTEVGKGNREIEEVNEEVAEPSVLENVVDSVTPEPEESVPDKSEEETPPVKKPEKPWTPCPPLVFGGSTLLKATPDSPLIGVSEEKGKRRLKPPRLGLAEQSLWRWSMIYEAEAPPEHMLMS

SEQ ID NO: 114292 - protein, 161 aa, Glycine max
  Coding DNA Sequence Number=SeqID_22607
  Subcellular localization annotation: CTP_CleavageSite=28; ConfidenceScore=5.02e-01
MVVMKPASMPAGQSMRMKSGQSCERAFSASTSQEFEVGSALVADEGLVEAAVAIQDLDHGVIDAILETEEEVEVAEADVGIDGDHEEAETGEGEVDLTMVVVLPTPPLPEVMTATQGVEPKSSGLRFHWKACGVVASAREKREFEILFFQLTKIPFKILKF

SEQ ID NO: 114293 - protein, 293 aa, Glycine max
  Coding DNA Sequence Number=SeqID_22608
  Gene Ontology: Mol. function=protein binding; Biological process =ubiquitin cycle
  Homolog annotation: Hit_ID=A7QVJ9; Match level="QueryCoverage=88%, HitCoverage=92%, E-value=1e-104, Identity=65%"; Hit description =Chromosome chr16 scaffold_189, whole genome shotgun sequence
  Pfam annotation: Domain name=F-box; Domain location=28-75; Score =26.3; E_value=0.00011; Accession=PF00646.24; Description=F-box domain
MGAGVSSTNKAEKDGGGSISSSSRDSRPGLGDFPESCISSLFMNLDPPDICKLARVNRAFHRASSADFVWESKLPPSYKFLANKVLGEENIATMTKKEIYAKLCLPNRFDGGTKEVWLDKCSGQVCLFMSSKSLKITGIDDRRYWNYIPTEESRFQSVAYLQQMWWVEVVGELEFEFPVGSYSLVFRLQLGKASKRLGRRVCNVDQVHGWDIKPVRFQLSTSDGQSSLSECYLRGPGEWVYYNVGDFVVEKPKEPINIKFSLAQIDCTHTKGGLCVDSAIICPTEFKERLKQS

SEQ ID NO: 114294 - protein, 56 aa, Glycine max
  Coding DNA Sequence Number=SeqID_22609
MHGERKRKREKKRHIKETMTLEEAHHHRRAWIRAWRKKEMKGEGEKSTKFCALNEL

SEQ ID NO: 114295 - protein, 484 aa, Glycine max
  Coding DNA Sequence Number=SeqID_22610
  Homolog annotation: Hit_ID=A5AR08; Match level="QueryCoverage=94%, HitCoverage=89%, E-value=1e-49, Identity=34%"; Hit description =Putative uncharacterized protein
  Pfam annotation: Domain name=IQ; Domain location=109-129; Score=18.2; E_value=0.03; Accession=PF00612.18; Description=IQ calmodulin-binding motif
  Pfam annotation: Domain name=IQ; Domain location=159-179; Score=17.3; E_value=0.058; Accession=PF00612.18; Description=IQ calmodulin -binding motif
  Pfam module annotation: Pfam domain module=IQ::IQ; Domain location =109-129::159-179
  Subcellular localization annotation: CTP_CleavageSite=18; ConfidenceScore=5.28e-01
MGFLRRIFGAKKPSDSKSAKKRWTFLKHTVRNKSLPPPPPPSAVTYFDSSTPLDANKHAIAVAAATAAVAEAALAAAHAAAEVVRLTSGGVSATSTRPAAMAARVGNLETAAVRIQSAFRGYLELQDFVGIEKRKIGRGKVEWPCAQKPSKARRALRALKALVKLQALVRGHIVRKQSADMLRRMQTLVRLQAQARASRAHLSDPSFNFNSSLSHYPVPEEYEHPPRGFSTKFDGSSILKRCSSNANSRNVDSERARFDSNWLNRWMELDNKSSQTGDASLKNGRPDDDKSDKILEVDTWRPHFKSHHSSSSFQAAHYYLSSDYNNENFGAAHESPSKRSAKALNQSFSSREVLQLSSLKFHKGKEEASSRTADNSPQTFSANSRNGSGARRGGGPFTPTRSECSWGFLSGYPGHPNYMANTESFRAKVRSQSAPRQRLEFDRYGSTRRPVHLVGSNSDHDSDLRNKVLPAFNQMNRIGSSNLR

SEQ ID NO: 114296 - protein, 160 aa, Glycine max
  Coding DNA Sequence Number=SeqID_22611
  Gene Ontology: Mol. function=DNA-directed RNA polymerase activity; Cellular component=RNA polymerase complex; Biological process =transcription, DNA-dependent
  Homolog annotation: Hit_ID=A2Q3E0; Match level="QueryCoverage=84%, HitCoverage=68%, E-value=5e-35, Identity=60%"; Hit description=DNA -directed RNA polymerase, 14 to 18 kDa subunit
  Pfam annotation: Domain name=RNA_pol_Rpb6; Domain location=99-144; Score=34.5; E_value=3.8e-07; Accession=PF01192.13; Description=RNA polymerase Rpb6
MADEDYEDIDMGYEDEPPEPEIEVQNSLSCVLFLYLHKCMLLNSALNEVIELLTAGLIDEQEGAEEDVENKNDEITGEPIDTEDKEEEQPVKRPRKTSKYMTKYERARILGTRALQISMNAPVMVELEGETDPLEGHVVRQADGTEDSFPPDSLIEHAHY

SEQ ID NO: 114297 - protein, 562 aa, Glycine max
  Coding DNA Sequence Number=SeqID_22612
  Gene Ontology: Mol. function=kinase activity; Cellular component =Golgi apparatus
  Homolog annotation: Hit_ID=A7QVJ2; Match level="QueryCoverage=96%, HitCoverage=94%, E-value=0.0, Identity=63%"; Hit description =Chromosome chr16 scaffold_189, whole genome shotgun sequence
  Pfam annotation: Domain name=DUF248; Domain location=77-549; Score =1023.8; E_value=5.9e-305; Accession=PF03141.7; Description=Putative methyltransferase
  Pfam annotation: Domain name=Methyltransf_11; Domain location=154 -249; Score=21.3; E_value=0.00084; Accession=PF08241.3; Description =Methyltransferase domain
  Pfam module annotation: Pfam domain module=DUF248::Methyltransf_11; Domain location=77-549::154-249
MANADSSSSSRYRSVLNLRRKAHIYALVVLLCITSYLLAVFHRGSRLTTALSLSAPCNHFSAESSKTFPRCSANFSEYTPCHDPQRSLRDRAWFANVPHRELTVEKAVQNWIRSDGDRFVFPGGGTTFPNGADAYIEDIGMLINLKDGSIRTALDTGCGVASWGAYLLSRNILTLSIAPRDTHEAQVQFALERGVPAFIGILATKRLPFPSRAFDISHCSRCLIPWAEYDGIFLNEVDRFLRPGGYWILSGPPINWKKYWKGWQRKKEELNEEQTKIEKVAKSLCWNKLVEKDDIAIWQKPKNHLDCKANHKLTQNRSFCNAQNDPDKAWYTNMQTCLSPVPVVSSKEETAGGVVDNWPKRLKSIPPRIYKGTIEGVTAETYSKNYELWKKRVSHYKTVNNLLGTERYRNLLDMNAYLGGFAAALIEDPVWVMNVVPVQAKVNTLGAIYERGLIGIYHDWCEAMSTYPRTYDLIHADSVFSLYSNRCELEDILLEMDRILRPEGCVIIRDDADILVKVKSIVNGLEWDSIIVDHEDGPLQREKLLFAMKKYWTAPAASEKTN

SEQ ID NO: 114298 - protein, 35 aa, Glycine max
  Coding DNA Sequence Number=SeqID_22613
MAHQYNPKVTRAYHGGVPRHSIEHCWLRFTEENHS

SEQ ID NO: 114299 - protein, 128 aa, Glycine max
  Coding DNA Sequence Number=SeqID_22614
MGEMLATQLAQASKQKKVYTDNHSGISAFQRDSNASMTDLMSAEDDKKNVYTDNHSGISARQRDSNVSMTDLVSTEDDQKNVYTDNHSGISACQRDSNVSMTDLVSAEDDGAEDDVSLCMLSGFLSYR

SEQ ID NO: 114300 - protein, 268 aa, Glycine max
  Coding DNA Sequence Number=SeqID_22615
  Gene Ontology: Mol. function=chorismate synthase activity; Cellular component=chloroplast; Biological process=aromatic amino acid family biosynthetic process
  Homolog annotation: Hit_ID=Q57LX0; Match level="QueryCoverage=100%, HitCoverage=74%, E-value=1e-125, Identity=85%"; Hit description =Chorismate synthase
  Pfam annotation: Domain name=Chorismate_synt; Domain location=1-268; Score=496.9; E_value=2.4e-146; Accession=PF01264.12; Description =Chorismate synthase
RYTTQRREPDQVKILSGVFEGRTTGTSIGLLIENTDQRSQDYGAIKDVFRPGHADYTYEQKYGFRDYRGGGRSSARETAMRVAAGAIAKKYLQQKFGIVIRGCLTQMGDIPLAIKDWDQVEQNPFFCADADKLEALDELMRGLKKEGDSIGAKVTVVADGVPAGWGEPVFDRLDADIAHALMSINAVKGVEIGDGFDVVSLRGSQNRDEITAQGFQSNHAGGILGGISSGQQIIANIALKPTSSITVPGHTINRDGEEVEMITKGRHD

SEQ ID NO: 114301 - protein, 123 aa, Glycine max
  Coding DNA Sequence Number=SeqID_22616
  Homolog annotation: Hit_ID=Q5QJQ3; Match level="QueryCoverage=60%, HitCoverage=89%, E-value=8e-24, Identity=57%"; Hit description =Putative uncharacterized protein
MAYERGGDFLEDARKILNREVRGPRQSRFSIGSAPLTSITKSDAQISGGETRQDYKDTRRFPLAAPSSLQAGTVCTNPPFSPTAAPYPVTIVLSPTRKDMQKHHWQQPLVIDLEELVLKSCAG

SEQ ID NO: 114302 - protein, 103 aa, Glycine max
  Coding DNA Sequence Number=SeqID_22617
  Gene Ontology: Mol. function=transporter activity; Cellular component= integral to membrane; Biological process=transport
  Homolog annotation: Hit_ID=A9CHM0; Match level="QueryCoverage=100%, HitCoverage=26%, E-value=2e-51, Identity=93%"; Hit description=ABC transporter, membrane spanning protein
MTSSIPNPGEALPHYVSTAPFDPSLIEPNTSGMAAFSKASQLKLMWWQFRQHKIAVWSGAFLVVLYLSILICEFLAPYNLHTRNIEHIYAPPQAIHLFNDGKF

SEQ ID NO: 114303 - protein, 76 aa, Glycine max
  Coding DNA Sequence Number=SeqID_22618
MAAEWRRKRERRSHFKEKMSLEEAHHHRRPWIRAWRKKEMNEGREREEHEILGTKRALKYEPTNPRSIPRFSTKCA

SEQ ID NO: 114304 - protein, 74 aa, Glycine max
  Coding DNA Sequence Number=SeqID_22619
MVEEDALSLDNIECGVCAEYTDAGVYGRQNSGSNKEAFEMGERRLHLSWTHSERNYGTLLNPSIWKKMPQVTNS

SEQ ID NO: 114305 - protein, 121 aa, Glycine max
  Coding DNA Sequence Number=SeqID_22620
MGDQEETQEQMKADMSALKEQIASMMEAMLGMRKLMENNVATAAAVSLAAEANPTLPAIAHHPLPNAVGRERSTLGHISNPHLGYNRVAYPYGLPPNYTPTVMRDDVGHVPSPVLEGDLLD

SEQ ID NO: 114306 - protein, 35 aa, Glycine max
  Coding DNA Sequence Number=SeqID_22621
MTGDASKFTHISPKKSGHVTYDDNNKGRILGVGKI

SEQ ID NO: 114307 - protein, 161 aa, Glycine max
  Coding DNA Sequence Number=SeqID_22622
MRGAPAEESLSPFLVRDFGGLDWLSKLKIINEENFEVPEEDEEVRALKTELGKARLAKEKFKLVATHIRKECAELREENAATARALERETKRACKEEHGRDKFRGALWGSNNELKLRRGERDQSRAHSMVLKEELAACSRSKRSLSQRLCETETNMLPIVS

SEQ ID NO: 114308 - protein, 129 aa, Glycine max
  Coding DNA Sequence Number=SeqID_22623
MSYRMSRHHASEHADYMCPYEQIKQPLFTTFSPNHYPCDLYLRATLRYENLRSLPLTHTPVFTIKSKTHQRSTLNKRDQLYTLEINSRHIGPTLDVRVPSSLHDYIAVYDSGLQLLDAGGDLSSSEKSA

SEQ ID NO: 114309 - protein, 419 aa, Glycine max
  Coding DNA Sequence Number=SeqID_22624
FASTKRLGERYTDIVVPRKILPERNVILYHTEFDEFTEELECRNWNKELMNFMDGSIDVAIVKEFYANLYDPEDKPPKQVKVRGHLVKFDGDTLNSFLKTPVILKEGENFPAYSRFCRLKPEPQELVPTSHTSDITLDRAGLIYGIIQKMDMNVGYIISAQISLIAQHDSSRLRFPALITALCKARGVISDSLTLESLDPAINVAHVKKNCWNLDDLSVTFRGSHKAKGKRSEAPPSFEIPPSLAPAPIPFAPSAFTSVLPAPLSAGPSEFLFTPQVLRSMLQSLHRGQSSIMQSLQGLGLPSIMSMDEFDAQVAWPRAHPSPSRGGGASATQEPAPEEPVAEGEDELTPPEPFYFDVDAHMAQEEETSINQIPESSLAPVPEETQPSTPVMEPEQPIQDSSAAVALDLNEDQPQDEQD

SEQ ID NO: 114310 - protein, 278 aa, Glycine max
  Coding DNA Sequence Number=SeqID_22625
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GTSYVPINVSFSQKLARASRYQQGHQDLFILRSDLPSQWLLFLSAVPPVQLLTGWCVTAKAPPDISAGKCSGRVPFAIQAAQLLGRAIGAGLFAITPAGERGMCCKAIKLGIRLKATTLSPMKHKGLKVLAFIFHQTHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114311 - protein, 151 aa, Glycine max
  Coding DNA Sequence Number=SeqID_22626
  Homolog annotation: Hit_ID=UPI00006A2939; Match level="QueryCoverage =94%, HitCoverage=82%, E-value=5e-10, Identity=32%"; Hit description =UPI00006A2939 related cluster
MSSPSEDFMSCTIRGLHALTSRGLPVLALRGLHALTLGLHVLALRGLHVLTIRGLHALTSRGLHVLALRGLHALTLGLHVLTIRGLHALTSRGLHVLTFVGLHALTFGGLHALAIRGLHVLAFRGLQALTLRGLHVLANRGLHALTLRGLH

SEQ ID NO: 114312 - protein, 65 aa, Glycine max
  Coding DNA Sequence Number=SeqID_22627
MDTSEPYTVAMKGTMQKGVRNDHNLSLRAIGHDCLRMAKSSPPLDDKRGQNDHNLSLCAIGHDCV

SEQ ID NO: 114313 - protein, 306 aa, Glycine max
  Coding DNA Sequence Number=SeqID_22628
  Gene Ontology: Cellular component=ribosome
  Homolog annotation: Hit_ID=Q1SL03; Match level="QueryCoverage=44%, HitCoverage=42%, E-value=1e-08, Identity=24%"; Hit description =Ribosomal protein S2; Nucleic acid-binding, OB-fold
  Pfam annotation: Domain name=DUF223; Domain location=1-95; Score= -8.1; E_value=0.017; Accession=PF02721.5; Description=Domain of unknown function DUF223
MVLMDQTGSKIGVTLWQELFTELRDKLQCGSSYLIQNLRIVDNQSEYRVSPAPYLVYFLKTTSVKEIHRPEIPSNVYLITPFTDIISGLAPRHTLVDIVGVIADLIDVKTVNPPHRMIVRLRDNSNCDILITVWEDYAIQLHDAIDRNLLLQEPLVVMLTLGKIKDATDGSQSQSSQSNVVEKFLQNAQVVSIGEINNLRQDCYCLTVGTVDEIIIDAPWSYDSCPNCTTTFDPSKGGSAFRSCHTSVVDIVPWMEHNGDKGNFLLWDATCIKLFGKTVGECRDELIAVSSTQLNHRLNNDSVIFH

SEQ ID NO: 114314 - protein, 377 aa, Glycine max
  Coding DNA Sequence Number=SeqID_22629
MAPRKLASKRSRKDKAAEGTSSAPEYDSHRFRSVVHQQRFEAIKGWSFLRERRVQLRDDEYTDFQEEIGRRRWEPLVTPMAKFDPEIVLEFYANAWPTEEGPAPGISDGIGRGPGMRVWPEEESDFARTVAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 114315 - protein, 155 aa, Glycine max
  Coding DNA Sequence Number=SeqID_22630
MAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVWRPLGTLWTQISPTGPWDSPH

SEQ ID NO: 114316 - protein, 235 aa, Glycine max
  Coding DNA Sequence Number=SeqID_22631
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIAASLAREFVSFMVVLPSFSSGGPRRSVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114317 - protein, 150 aa, Glycine max
  Coding DNA Sequence Number=SeqID_22632
MASMMEAMLGMRQLMEKNMATTAAVSSAAEADPTLLATAHNPPPNAVGRGRSTLGHNNNPYLGYNQVAYPYGLPPRDVEFYPPIPVEGLAPNTLPQPNLTPQPIFLSTEGPPPAAEERRKLDLLEERLRAVEGFGDYSFTDMTDLCLVPD

SEQ ID NO: 114318 - protein, 196 aa, Glycine max
  Coding DNA Sequence Number=SeqID_22633
IYHTEFDEFKVELERHNPHKRLFNLQDGSIDVAVIKEFYANLYTIEEQAPKQEIEPRLCIPHKGFILNAEGQSWKLLRKDLTTLGQSVFSYSNLAPTSHTSDLNMDRARLVYGLVTNMDMNIGALISGQISSIAQSNSFRLKFPALITALWKARGVASDSLTYESLSLAINLAYIKKNYWNMDDLTVNFRGARKAR

SEQ ID NO: 114319 - protein, 235 aa, Glycine max
  Coding DNA Sequence Number=SeqID_22634
MEKSSEQQEAKGSYRRDKKKQLSVRGEEEEATQHGWESSGMRAGEIGTGEAPLLAQPLRLRRPHPLQKEKTGLLLYSMASNVSKVKEDGPIREARADGAGKGVGDKVGIGGITEDEGAAEEGISEDWRASDLCPLAFLGPLKVIVGSSRFEQFFFTYATLMAGLRLSKVIESKVTPLALHKAVIKAGNPSLEESCWAIMGSSWRKKERSMSKQGRQVLPEDLQWQAVSIKLKSPP

SEQ ID NO: 114320 - protein, 154 aa, Glycine max
  Coding DNA Sequence Number=SeqID_22635
  Homolog annotation: Hit_ID=Q6UUU1; Match level="QueryCoverage=38%, HitCoverage=40%, E-value=1e-18, Identity=78%"; Hit description =Putative uncharacterized protein
MKQLDYYSIYYYKTRWYYLASTPIATRSGEHELPAYAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114321 - protein, 67 aa, Glycine max
  Coding DNA Sequence Number=SeqID_22636
  Gene Ontology: Biological process=transposition, DNA-mediated
  Homolog annotation: Hit_ID=Q1J7G7; Match level="QueryCoverage=44%, HitCoverage=42%, E-value=2e-10, Identity=100%"; Hit description =Transposase
GFPGINRDTRIYFILRSDLPSQWLLFLSAVPPVQLLTGWCVTAKAPPDISAGKCSGHAARNHHTRRA

SEQ ID NO: 114322 - protein, 59 aa, Glycine max
  Coding DNA Sequence Number=SeqID_22637
MAHLWFVILFGRNNQHESTEKGVEKKSPEFQEPRDFRSNPFQGEGMMQSYLARALDRRL

SEQ ID NO: 114323 - protein, 402 aa, Glycine max
  Coding DNA Sequence Number=SeqID_22638
  Homolog annotation: Hit_ID=Q2HW90; Match level="QueryCoverage=88%, HitCoverage=70%, E-value=1e-38, Identity=33%"; Hit description =Putative uncharacterized protein
MGTNQNGKRFYQVKVKSLDVTSLKELGRLMGPLQRQAFRKVYGKILDLAAAEVFTEAVVSLAQYYDQPLRCFTFGDFQMVPTIEEFEEILGCPLGGRKPYLFSGFLPSLSRIAVVIADSAKELDRMKQTRNGIVGLPRKYLEGKARDMASQEKWGPFADILALLIFGVVLFPNIDDLVDLAAIDAFLAYHHSKESPVVAILADLFDTFDRRCEKNSARIVCCLPALCVWLISHLFQQETRHPCPLQTYRSCAEKGRVDWDQHLAGIGGSAINWFPRWKEGVIFSCGDYPNVPLIGTRGCINYNPALAIRQLGYPMRGAPTEESLSPFLVRNLGAQSLKAIQRVHKAWRSPLRKDKELRGIRNGVIGGYHGWLRIHTRGLDWLSKLKVIDEENFEAPEEDEEI

SEQ ID NO: 114324 - protein, 41 aa, Glycine max
  Coding DNA Sequence Number=SeqID_22639
MAILIANTSTTFHRDERLGHTLSYAWKINGFMIPTWLAHGA

SEQ ID NO: 114325 - protein, 92 aa, Glycine max
  Coding DNA Sequence Number=SeqID_22640
  Subcellular localization annotation: CTP_CleavageSite=10; ConfidenceScore=5.00e-01
MAKSTPSQVLVTHRKSIGKGNTLSPKNEKGGNSKKGYNRIYQATMGTSKNSKSCLHILGLNGCRPWDGRGGNHSPILRINRGGSEVEKGSAP

SEQ ID NO: 114326 - protein, 105 aa, Glycine max
  Coding DNA Sequence Number=SeqID_22641
  Subcellular localization annotation: CTP_CleavageSite=77; ConfidenceScore=5.08e-01
MVKVGTSYVPINVSFSPKVGPGLPAVPPVQLLTGWCVTAKAPPDISAGKCSGHAARNHHTPPRLMRRYRARPIRHSGCATVGKGDRCGPLRYYASWRKGDVLQGD

SEQ ID NO: 114327 - protein, 43 aa, Glycine max
  Coding DNA Sequence Number=SeqID_22642
MADQQATKSKAKGKQSTSRMHLVAHDPGDLNKTSASSEGREIP

SEQ ID NO: 114328 - protein, 36 aa, Glycine max
  Coding DNA Sequence Number=SeqID_22643
MEVEEPWLGLWLPLNYRVIWDQVVFVIGSAVDRLCG

SEQ ID NO: 114329 - protein, 63 aa, Glycine max
  Coding DNA Sequence Number=SeqID_22644
MAVEWRRKRERRCHFKEKMSLEEAHHHRRPWITAWRKKEMNEGRVMVHPTNPRSIPKFSTKCA

SEQ ID NO: 114330 - protein, 241 aa, Glycine max
  Coding DNA Sequence Number=SeqID_22645
  Homolog annotation: Hit_ID=A5BSR3; Match level="QueryCoverage=68%, HitCoverage=47%, E-value=2e-13, Identity=35%"; Hit description =Putative uncharacterized protein
DVRIKAQAIQRQNTAPPPHILSRGGYDYLEQKLLAEKTKKKLQEATESGSVDGVIDPPSPVRRYVKWKMARTKKTGEMTTEAAKEIAEKIDSFEEQATQGSFIPHGCQDVLVAAIGRPEHPGRVRAAGAGVTIKQYFGSAPWMSRSASSLPPDELQQLTQQIRDQLEESITEKVMRQVPSSFSQLQSQMQSQGLAVPPKPLVGPGPSGPRVSTKESCVDPSGNDPETGDSDKCGLYIEADP

SEQ ID NO: 114331 - protein, 63 aa, Glycine max
  Coding DNA Sequence Number=SeqID_22646
  Homolog annotation: Hit_ID=A7Q8B9; Match level="QueryCoverage=66%, HitCoverage=13%, E-value=4e-13, Identity=73%"; Hit description =Chromosome chr14 scaffold_63, whole genome shotgun sequence
KTDLTPSCMLHSARGDIAQLVELRSCNWVVAITEDRNMPLKDSTETKTGCQERRGGGWAVGQI

SEQ ID NO: 114332 - protein, 78 aa, Glycine max
  Coding DNA Sequence Number=SeqID_22647
  Subcellular localization annotation: CTP_CleavageSite=39; ConfidenceScore=5.45e-01
SVAVTLRVTTTPAALNAPLQGASHSPFRLRNCWEGRSVRASSLLRQLAKGGCAARRLSWIGAETRWKGKALQAIFSSF

SEQ ID NO: 114333 - protein, 110 aa, Glycine max
  Coding DNA Sequence Number=SeqID_22648
MNEKVKVILWMNALLEPKLLNPRKTMNCWQPNPITSLESPSDSFSQLISSAKRASTAKHSFSLLSAIEESGRASISRSRPKREISVLSAKGVFNQAQHMTGAKLKSTYSR

SEQ ID NO: 114334 - protein, 188 aa, Glycine max
  Coding DNA Sequence Number=SeqID_22649
  Homolog annotation: Hit_ID=A5BTM1; Match level="QueryCoverage=65%, HitCoverage=5%, E-value=9e-14, Identity=36%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLAGEDPHKHLKEFHIVCSTMKPPDVQEDHIFLKAFPHSLEGVPKDWLYYLAPRSITSGDDLKR

SEQ ID NO: 114335 - protein, 223 aa, Glycine max
  Coding DNA Sequence Number=SeqID_22650
  Gene Ontology: Mol. function=heat shock protein binding; Biological process=protein folding
  Homolog annotation: Hit_ID=O82368; Match level="QueryCoverage=65%, HitCoverage=47%, E-value=2e-26, Identity=44%"; Hit description =Uncharacterized protein At2g29880
MEDTNELLHLLVDAMNRGLRDANGSLSKQNVERIILPQLNAKTKFPKTYSHYLSRMKWFRNQYNMMSTLMRNNSGFGWDPIGKTFTAHEDVWKDYLKSHPSHSKLRGKSMVDYEYLKIVVGGGVSSGNNSISVDPDDTDATTFEPENRIVGIEEFSYDPNSDTFITPNNYEPAYQPPSPNQPSPPSHPPLDSEVPIEKQNCHKRRRSEYGGSSSAVGINNQGN

SEQ ID NO: 114336 - protein, 89 aa, Glycine max
  Coding DNA Sequence Number=SeqID_22651
MADTYSAPEEIHGLLGYSAEADQLSSYCAPSSPNVIGRERSTLGHNSNPHLGYNRVAYPYGLPPNYTPPVMHDDAGHVSSPILEREPPR

SEQ ID NO: 114337 - protein, 199 aa, Glycine max
  Coding DNA Sequence Number=SeqID_22652
  Gene Ontology: Mol. function=structural constituent of ribosome; Cellular component=ribonucleoprotein complex; Biological process =translation
  Homolog annotation: Hit_ID=A4WDH0; Match level="QueryCoverage=67%, HitCoverage=95%, E-value=1e-31, Identity=48%"; Hit description =Putative uncharacterized protein
  Pfam annotation: Domain name=Ribosomal_L19; Domain location=3-67; Score=45.0; E_value=1.3e-11; Accession=PF01245.11; Description =Ribosomal protein L19
HSRAWLSLFVTRGLHSAFTVRKISNGEGVERVFQTHSPVVDSIAVKRRGAVRKAKLYYLRERTGEVDNVLHQQNRKRAAALIALFAILLIVVAPLISVSLQKDPMSAMPGMHHDMSMMSMDEHHGDVSHTVPVDHAEACGYCVLLAHVPGVMLALIVLLSVVLQRLRVKPPRQAVSHWHFFPWLYPDTRAPPRQSAFSL

SEQ ID NO: 114338 - protein, 100 aa, Glycine max
  Coding DNA Sequence Number=SeqID_22653
MTVTNVRVTLTCRWWQSQQHDGEVRAQATIRARCMRAIVTPQREQKDYKTTVSTTMRDDSTTVMRVRGHKLIIVSLKLKMMLKNCLCLPAFEDGCSLKLS

SEQ ID NO: 114339 - protein, 127 aa, Glycine max
  Coding DNA Sequence Number=SeqID_22654
MLPRPVRSQVACGDTQGLSAHTHIHKSITSTCENRVTCRDTQGLSVHTFMLSRLVRSQVACGDTLYGNPHTFRRQKCLRSLHAFKGAMSSHFEDKNFFSHCMPSKGDNDPHLHFEDDNVFSHCMPSK

SEQ ID NO: 114340 - protein, 331 aa, Glycine max
  Coding DNA Sequence Number=SeqID_22655
  Homolog annotation: Hit_ID=Q6WAY4; Match level="QueryCoverage=93%, HitCoverage=53%, E-value=6e-42, Identity=35%"; Hit description =Putative uncharacterized protein
MGTNQTGKRFYQVKIKGLDVTSLKELGRLMGPLQMQAFRRAYRKILDLTIAEIFTEAVVSLTQYYDQPLRCFTFGDFQLVPTVEEFEEILGCPLGGRKPYLFSGFLPSLSKIVVVVRDSARELDRVKQTRNDVVGLPRKYLEGKARDMANQEEWVSFMDVLALLIFGVVLFPSMDGLVDLAAIDVFLAYHHSKESPVVAVLANLFDTFDRRCEKSSARIICCLPALCVWLVSHLFQQDIRHPCPLRSHRSCVKKRRVDWDQHLTGIGGRIINWFPRWKEGKEGFLFSCGDYPNIPLIGTRGCINYNPTLAIRQLGYPMRGAPAEESLSPFL

SEQ ID NO: 114341 - protein, 282 aa, Glycine max
  Coding DNA Sequence Number=SeqID_22656
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISFFLPNLVKFNFAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114342 - protein, 127 aa, Glycine max
  Coding DNA Sequence Number=SeqID_22657
MTTLTQTWMTLLLSNVLASDHNSDLPLPKSQLVYAILTHMSVYVAQSYGVPVTPNKVIRPPITRAFIEKYCTPRQAQSDAHQAADVPPPPRQADPAGSLGVERYLQHLVRQQAANHRGQVQIHECLC

SEQ ID NO: 114343 - protein, 135 aa, Glycine max
  Coding DNA Sequence Number=SeqID_22658
  Subcellular localization annotation: CTP_CleavageSite=18; ConfidenceScore=5.01e-01
SFGVPVAPTKVIRPPITRAFIEKYCTQRQAQGNSPQAASATTTSSGWPGWAANHRAHVQTHDCLYQMSLSMQSQGFASFSCPTPDQFRAEVTWPGDWPEAQAGEAPPEVPGDGEEAHEDEEMGDLLDFLGGNGAT

SEQ ID NO: 114344 - protein, 109 aa, Glycine max
  Coding DNA Sequence Number=SeqID_22659
  Subcellular localization annotation: CTP_CleavageSite=49; ConfidenceScore=5.07e-01
MAQKMTLVSACYKAFRFTDIKKRMFVRITTRVFPPGQRDSNVSMTDLVSAEDDTAKKNVYTDNHSGISARQRDSNVSMTDLVSAEDGAFRLTDIKKRMFVRDNHSGISA

SEQ ID NO: 114345 - protein, 272 aa, Glycine max
  Coding DNA Sequence Number=SeqID_22660
  Homolog annotation: Hit_ID=Q6UUU1; Match level="QueryCoverage=22%, HitCoverage=40%, E-value=4e-18, Identity=78%"; Hit description =Putative uncharacterized protein
  Pfam annotation: Domain name=Ins_element1; Domain location=30-101; Score=-18.4; E_value=0.008; Accession=PF03811.4; Description =Insertion element protein
LPGINRTPRIYLFCEVIFRHSGFCFYQLSPPCSATDGVVRNGKSTAGHQRWQAAQLLGRAIGAGLFAITPAGERGMCCKAIKLGNARVFPVTTLNSMQNGRVERKHRHILNVARALRFQGSLPIEFCLAKFYQAYRYRRPRGGARYQLLFPLVRVNFELGVIMVKAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114346 - protein, 95 aa, Glycine max
  Coding DNA Sequence Number=SeqID_22661
MGCTHGPEIYPKAHKNPRAFSCISGPIYLEFSIQCPCGVGLHHNHKVCSRATGPLGHDRRIETCLRSRPEDADIFGKGADDHIGLCVPIGLRVCE

SEQ ID NO: 114347 - protein, 129 aa, Glycine max
  Coding DNA Sequence Number=SeqID_22662
MKNDEERWKTFTDLLTAALRNNLSLDFLHGNNFFHPKQLKCIAKGVRNIWNSLPSPIYRKRGEEVAAQLAQDFMDYATMLFLTSRRLRIFTDCATMLVLISGMVRDFTNYTTMGVKYFEVVKRRSHANK

SEQ ID NO: 114348 - protein, 183 aa, Glycine max
  Coding DNA Sequence Number=SeqID_22663
  Homolog annotation: Hit_ID=A6N1F2; Match level="QueryCoverage=30%, HitCoverage=70%, E-value=2e-13, Identity=67%"; Hit description=Imp biosynthesis protein
GVVDGQQVNILYYLCWSRGTEEARVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISEIPLWKS

SEQ ID NO: 114349 - protein, 136 aa, Glycine max
  Coding DNA Sequence Number=SeqID_22664
  Homolog annotation: Hit_ID=A7PTD9; Match level="QueryCoverage=30%, HitCoverage=10%, E-value=1e-15, Identity=90%"; Hit description =Chromosome chr8 scaffold_29, whole genome shotgun sequence
  Subcellular localization annotation: CTP_CleavageSite=65; ConfidenceScore=5.07e-01
MGVLFTLPSRYYFTIGHPGVFSLARWSLLIHTGFHVPHATRVRAVQHSLLLRLAGSPVVPRQRPSACLGPAHPFRWTNLCGGTLGFSRLVPHSTFALLKPTFSLPLPIQHCSRELRVAYYAPFISLAQEPSELLPP

SEQ ID NO: 114350 - protein, 53 aa, Glycine max
  Coding DNA Sequence Number=SeqID_22665
MLNKRLAQILHGFPYVNLESAIGCELSPEACAQADLKLTYGKQKEGVNRQFCP

SEQ ID NO: 114351 - protein, 138 aa, Glycine max
  Coding DNA Sequence Number=SeqID_22666
  Homolog annotation: Hit_ID=Q6WAY6; Match level="QueryCoverage=100%, HitCoverage=21%, E-value=2e-08, Identity=32%"; Hit description =Putative uncharacterized protein
MEGLVDLAVIDAFFAFHHGKKSPVVAILAMYDTFDRGCEKSGTRIVCCALALYVWLVSHLFLQEGRPVYLLQGHRSCIEKGKANWDQLLASKEGASVNWFPRWKEGGTRVLISCRGFPNVPLMGTRGCISYNPVLAIR

SEQ ID NO: 114352 - protein, 66 aa, Glycine max
  Coding DNA Sequence Number=SeqID_22667
MVWQSPNQKSIFSKLEFDSLVTIYIKAFKIVETDASDIGYGGILKQRVHGQDHVIAYTSNIGILHN

SEQ ID NO: 114353 - protein, 156 aa, Glycine max
  Coding DNA Sequence Number=SeqID_22668
  Homolog annotation: Hit_ID=Q6UUU1; Match level="QueryCoverage=55%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVWPRLSHSTPDTQFRVAVAPSWT

SEQ ID NO: 114354 - protein, 171 aa, Glycine max
  Coding DNA Sequence Number=SeqID_22669
MASWKLASKRSRKDKAAEGTSFAPEYDSHRLRSAEHQQRFEAIKGWSFLRERRVQLRDDEYTDFQEEVVRRRWASLVTPMAKFDPYIVLEFYANAWPTEEGWIPFDADALSQFLGYPLVLEEGQECEYGQRRKRSDGFGEEAIAQLLCIPGQDFAWTAAGRRVRIVDKGSS

SEQ ID NO: 114355 - protein, 86 aa, Glycine max
  Coding DNA Sequence Number=SeqID_22670
  Subcellular localization annotation: CTP_CleavageSite=74; ConfidenceScore=5.63e-01
MKHFTDTLISPNIVSQYLSASAQYANRLSPRVGRFINAAGTTGFPTGKRAVSATQLITRMTIEFLQPGGSTSSRAAATAVELQFAL

SEQ ID NO: 114356 - protein, 137 aa, Glycine max
  Coding DNA Sequence Number=SeqID_22671
MDCNTNTVDITLRTNRKEKSRQVENLNNNKPTKVTKPKSLIVRIAKIDLAAPPPHEPPMATVTSECSIAHHHSTDLPLPPRFNRLCRRCGRPPKRLMEMASETVNRVDSVDDIEFMEDDEEARVDNDEKESKKGEQK

SEQ ID NO: 114357 - protein, 51 aa, Glycine max
  Coding DNA Sequence Number=SeqID_22672
MSVGKQGAKGPAKPADRPDPDVDPLYLMTLTIPHLFLKPLQAIGCYRVWGV

SEQ ID NO: 114358 - protein, 242 aa, Glycine max
  Coding DNA Sequence Number=SeqID_22673
  Homolog annotation: Hit_ID=Q2HW90; Match level="QueryCoverage=59%, HitCoverage=35%, E-value=2e-13, Identity=30%"; Hit description =Putative uncharacterized protein
MGSSQKPSLKKRLYQVKIKSLEVTSLRELGQLMGQLQRQAFRKAYCKICDLARVEVSMEPIASLSQYYDQPLRCFTFEDFQLVPTVKEFEEILGCPLGGRKPYLFSGFYPLHDKSCQGQRPWQIKANGLSFIDILALLIFGVVLFPNMEGLVDLAAIDAFLAFHHGKESLVVAILAMYDTFDRGCEKSGARIEGRIRILSSCEGCPMRGVPSDESITPFIARGFSDHNARVLQGVRKAWDAA

SEQ ID NO: 114359 - protein, 197 aa, Glycine max
  Coding DNA Sequence Number=SeqID_22674
  Homolog annotation: Hit_ID=Q6WAY6; Match level="QueryCoverage=80%, HitCoverage=32%, E-value=7e-10, Identity=28%"; Hit description =Putative uncharacterized protein
MTPSTEDVKKAMQGLFAVLQLSMWGWFHTFFSKKVGPSIRYKEGRIKILSSCEGCPNVPVMGTRGCINYNPVLAIRQLGYPMRGAPLDESITPFIARGFSDHNTRDRELRGSSNGIIGGYHKWLRVRTQGLDWLPNLKTVREDEVKASEESDEVQALKAELERARVVEEKFKSIAIKGSNSKLKLRRGERNHHGSKA

SEQ ID NO: 114360 - protein, 169 aa, Glycine max
  Coding DNA Sequence Number=SeqID_22675
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=34%, HitCoverage=46%, E-value=1e-24, Identity=94%"; Hit description =Putative uncharacterized protein
MVHMCLDKVIRVNRWQCWWLALTWSIWQHRNSILFSNAVFNGNKVFEDAVFLLWTGLRSLERNFTIHYNQCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114361 - protein, 137 aa, Glycine max
  Coding DNA Sequence Number=SeqID_22676
MQSPVMSSPLGRNFLFSEGEVVVGRDVIEESPKAFYGDVLGYISFIQDFYQQSSMRLRAHEQFQKRDSSWGFVELLNNFELTLLNNAEELAGLLERYLFLVTTLSSLRKTFHRNILTRSGDHFDIWSFRHPCLPLSI

SEQ ID NO: 114362 - protein, 56 aa, Glycine max
  Coding DNA Sequence Number=SeqID_22677
MDSEAQNTFRIDNNDRSRLKSPLLQTLCPEWMSYTVGSANQVLRSIFLRDSLYSSV

SEQ ID NO: 114363 - protein, 123 aa, Glycine max
  Coding DNA Sequence Number=SeqID_22678
MVIPRERRVQLREDEYSDFQEEIARRRWAPLVTPMAKFDLEIVLEFYANAWPTEEGVREMRSWVRGQWIPFDADALSYHRPAAVHTGAGFCPDRCREAGADHAHQHDYFDPDMDDTATQQCLA

SEQ ID NO: 114364 - protein, 169 aa, Glycine max
  Coding DNA Sequence Number=SeqID_22679
MGEVEEVQEQMKADMEAMKGQMATMMEAMMSMNKIMEANAVAVAATSTIAKVNPMPPSDLNRMNHPTSDMTHEIPHHNLADFEPCLGYTTEGQAVGGIPLRSTLEGPQYHPQLHLLHSTTSENPHAMAGIGKLDHLEERLRAIEGGEDYAFVNLDELFLVPKHGHSQVQ

SEQ ID NO: 114365 - protein, 430 aa, Glycine max
  Coding DNA Sequence Number=SeqID_22680
  Homolog annotation: Hit_ID=Q84VI1; Match level="QueryCoverage=100%, HitCoverage=63%, E-value=0.0, Identity=82%"; Hit description =Envelope-like protein
MATSPKETLAPGSPAVPSSPHQEQPDFNIQPIQIIPGQASVPEKLVPRRQQGVKIAVNPSLATSSREVDTEMDKKIRSIVSSILKEASVPEADEDVPTSSTPNVSVPDVEKDVPTSSAPNAEAVPSPSEEESTEEDDQAAEETPAPRAPEPAPGDLIDLEEVESDEEPIANRLAPGIAERLQNRKGKTPLKRSGRIKTMAQKKSTPITPATSRRSKVAIPSKKRKEISSSDSDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDITNRKSDDYQKVFVRGKCVRFSPTVINKYLDRPTDGVVDIAVSEHQIAKEITAKQVQHWPKKGKLSAGKLSVKYAILHRIGAANWVPTNHTSTVAT

SEQ ID NO: 114366 - protein, 304 aa, Glycine max
  Coding DNA Sequence Number=SeqID_22681
MKREKHASYSSHNSCKSLSEELRDYYEGRHRSHLRPHSHRRERKESLKRLTLTSHTSMEDIATLKKKSTSKSYGFHSYPKKDQGQGILGVTPSKPKDDKGKTIEKQAPKASMQEKTSSIKCFKYLIRGHITSQSPTTKTMIMRGQDIYSSQDEATTSPSSSESEEAKGEECSEEIYPQEDGQPLVVKEKCKEVSVSSKRLAKKETHFTIKTNIKETFPLRQPPHFLFCKKTLASIATPLGLEFIPQVKKLLDEGLVRKSLNPCALLVPKIGIIRHQVPKMGGMMNVLSGATLFCKITRTRNMFM

SEQ ID NO: 114367 - protein, 51 aa, Glycine max; identical to SEQ ID NO: 112234
  Coding DNA Sequence Number=SeqID_22682

SEQ ID NO: 114368 - protein, 293 aa, Glycine max
  Coding DNA Sequence Number=SeqID_22683
  Gene Ontology: Mol. function=enzyme inhibitor activity; Cellular component=integral to membrane; Biological process=response to antibiotic
  Homolog annotation: Hit_ID=Q2LMD3; Match level="QueryCoverage=31%, HitCoverage=16%, E-value=2e-39, Identity=79%"; Hit description=GpA
  Pfam annotation: Domain name=Micro_A_star; Domain location=84-291; Score=37.2; E_value=6.6e-13; Accession=PF05441.2; Description =Microvirus A* protein
DLPSQWLLFLSAVPPVQLLTGWCVTAKAPPDISAGKCSGRVPFAIQAAQLLGRAIGAGLFAITPAGERGMCCKAIKLGIRSSTMKSRRGFTIQRLMNAMRQAHADGWFIVFDTLTLADDRLEAFYDNPNALRDYFRDIGRMVLAAEGRKANDSHADCYQYFCVPEYGTANGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 114369 - protein, 92 aa, Glycine max
  Coding DNA Sequence Number=SeqID_22684
  Homolog annotation: Hit_ID=Q6UUU1; Match level="QueryCoverage=73%, HitCoverage=44%, E-value=6e-16, Identity=69%"; Hit description =Putative uncharacterized protein
MSYERGGDFLEDARKILNREVRGPRQSRFSIGSAPLTSITKSDAQIRGGETRQDYKDTRVSPWRLPLALSCSCLSVYRLLSAVMAAFVSFHA

SEQ ID NO: 114370 - protein, 117 aa, Glycine max
  Coding DNA Sequence Number=SeqID_22685
MGHWLCNSSLASGNRLPRLCNRLPEMKSLKIPLLLAYSRERVYPVQVIEVTSSEEDPEEDLEELPSEPAVDALDFLEGDEDPLLEVDSPEEVMSASKADSTEDSGPGEMAISGGSSS

SEQ ID NO: 114371 - protein, 167 aa, Glycine max
  Coding DNA Sequence Number=SeqID_22686
MSSRRNLRDAIEELTNFVDGNIDIAIVKEFYANLYDPEDKSPKQVRVRGHLIKFDEDTHNTFLKTPVIVEEGESLCAYSRFALLRPDPQELATKLCIPGWEFELNADGQPLKILRKNMTTLAQTWSGLSFSNLIPTSHTFDVTLDRARLIYGIIMKMDMNVGYLISH

SEQ ID NO: 114372 - protein, 177 aa, Glycine max
  Coding DNA Sequence Number=SeqID_22687
  Homolog annotation: Hit_ID=A5BTM1; Match level="QueryCoverage=64%, HitCoverage=4%, E-value=2e-11, Identity=35%"; Hit description =Putative uncharacterized protein
MTRGNPSDLQPFDPEIDRTFHRLVRHHFLPFDHPEHSITGESVHSVIGDFEHPDLEHYNFEHSDSEHSDFAHSENMAQPPPRERTLREMAAPDFTYESLCIQYPDEDVPYVLKTGLIHLLPKFHGLSGEDPHKNLKEFHIVCSTMKPPDVQEDHILLKAFPHSLEGVAKDWLYYLAP

SEQ ID NO: 114373 - protein, 117 aa, Glycine max
  Coding DNA Sequence Number=SeqID_22688
MVTSKENERVPLDVENNDGLWWLMVAMGDGETTRKQRLKCLNKRCSRERKILEYSRHLLKDPNGQIMEKCLVKLQTKFREDPTVNERWASFLPRQLHVAFSRSFIKRLPLEASSWLL

SEQ ID NO: 114374 - protein, 108 aa, Glycine max
  Coding DNA Sequence Number=SeqID_22689
MASKKLSTKRFRRDAATEGSSATPEFDSHHFRSAEHQQCFEAIKGWSFHRERRVQLRKDEYTDFQEEIAHRHWTSLVTPMAKFNPEIVLEFYANAWPTEEGVQDMRSW

SEQ ID NO: 114375 - protein, 99 aa, Glycine max
  Coding DNA Sequence Number=SeqID_22690
RQAQRDAPQVADSPPPHQAGPAGSFDTEQYLRHLVRQQATNHRAHVQTHDCLYQLSLSLQSQGFTSFSCPTPDQFRAEVAWPGDWPEARAGEPPAEAPA

SEQ ID NO: 114376 - protein, 176 aa, Glycine max
  Coding DNA Sequence Number=SeqID_22691
  Subcellular localization annotation: CTP_CleavageSite=82; ConfidenceScore=5.21e-01
MEAPKKDLTTLTQTWSVFSYSNLVPTSHTSNLNTDRARLVYGLITRMDMMNIGSLISGQMTMIAQSNPSRLGFPALITALCRSRGVGSDALTSYENLRLAIDLAYIIKNYWNANDQTVNFPETRKTKLRAADVPYSFTPIAGIPASSTSAPPPTLADLSAQSSQTSDAKFQSLFEG

SEQ ID NO: 114377 - protein, 210 aa, Glycine max
  Coding DNA Sequence Number=SeqID_22692
  Gene Ontology: Mol. function=iron-sulfur cluster binding; Biological process=electron transport
  Homolog annotation: Hit_ID=A9I5I5; Match level="QueryCoverage=69%, HitCoverage=38%, E-value=3e-40, Identity=56%"; Hit description =Citrate utilization protein B
DAPPHEIAVNVPQAMAKVRLQTYTEYAFPAALGKLYRRNGLALSLATAAGLALFLALTVMLTGGLLHAPMAGNFYAVFPHNTLALMFGAAFGFAMVALAIGAARFWRDVSPGTASGAAVAEAAHDALRLRYLDGGHGKGCNNADDAFTLWRRRFHHFTFLRLHAGDAAQKPMDRGFIALLLLTSATGLALLAGTRYRRHGPAAGSATWAW

SEQ ID NO: 114378 - protein, 209 aa, Glycine max
  Coding DNA Sequence Number=SeqID_22693
MTVTALGVLYTSSGVEAIKGWSFLRERRVQLRDDEYTDFQEEIGRRRWAPLVTPMAKFDPEIVLEFYANAWPTEEGVRDMRSWVRGQWIPFDADAIGQLLGYPLVLEEGQECEYGQRRNRSDGFDEEAIAQLLCIPGQDFARTVAGRRVRIMRTNMTTLTQIWMTLLLSNILPTDHNSDLPMPKCQLVWRPLGTLWTQISPTGPWDSPH

SEQ ID NO: 114379 - protein, 76 aa, Glycine max
  Coding DNA Sequence Number=SeqID_22694
MAAEWRRKGERRCHFKEKMSLEEAHHHRRPWIRAWRKKEMNEGRGREEHEILCSKRALKSEPTNPRSIPRFSTKCA

SEQ ID NO: 114380 - protein, 84 aa, Glycine max
  Coding DNA Sequence Number=SeqID_22695
  Pfam annotation: Domain name=G-patch; Domain location=32-76; Score =19.3; E_value=0.00088; Accession=PF01585.14; Description=G-patch domain
MMNKGQIEVCSAKKGEGDVCMQLDILPRLSGAALMVARVMLRGGYEPGIGLGRNGDEMANMVEFAENRGRLGLGYEPTHADKRR

SEQ ID NO: 114381 - protein, 145 aa, Glycine max
  Coding DNA Sequence Number=SeqID_22696
MCRCRQWLQRSVSPKGQGRTPQGRDPAQPHKKKLSLMDTVFEVRSISAASKQSRVWGQWIPYDEDAINQFLGHPLVLEEGQRCEFNERRSRVSGFDKEAIGHLLCSPGQDFARSVTGRRVRIMRTSMTMLTQTDLDDASPQQHPS

SEQ ID NO: 114382 - protein, 71 aa, Glycine max
  Coding DNA Sequence Number=SeqID_22697
MGAKHLTRTKEWSHVIKQRSPDEIRADTVVSDGKQRPSLVILHPRYAEIPYGYLHPFARQTQLCPMASRDQ

SEQ ID NO: 114383 - protein, 144 aa, Glycine max
  Coding DNA Sequence Number=SeqID_22698
TNVVICTLFQLGASEPVDTQRLTSSSAPLSSKDGESDDMQRYPSGYLYKTISVNPDSRSQVVGGDTQVTASPMTCGDTQVVIRTNQLLLISTREVRWQAEIPQVVIRTNALLLILTREVKWQEEIPQVVIRTHTVLLPRPVRSQ

SEQ ID NO: 114384 - protein, 53 aa, Glycine max
  Coding DNA Sequence Number=SeqID_22699
MVLTNSMSGATRRRVTRGMRVPRKEYARSRHQRLFEENVGKTGKDAIYELFSE

SEQ ID NO: 114385 - protein, 147 aa, Glycine max
  Coding DNA Sequence Number=SeqID_22700
  Homolog annotation: Hit_ID=Q6UUU1; Match level="QueryCoverage=40%, HitCoverage=40%, E-value=1e-18, Identity=78%"; Hit description =Putative uncharacterized protein
  Subcellular localization annotation: CTP_CleavageSite=15; ConfidenceScore=5.05e-01
MAYIPPKMSSMTVFVAVTVKEQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114386 - protein, 256 aa, Glycine max
  Coding DNA Sequence Number=SeqID_22701
  Gene Ontology: Mol. function=nucleotide binding; Biological process =peptidoglycan catabolic process
  Homolog annotation: Hit_ID=Q8ZL88; Match level="QueryCoverage=85%, HitCoverage=81%, E-value=1e-107, Identity=86%"; Hit description=Gene transcribed divergently from malS
  Pfam annotation: Domain name=Glucosaminidase; Domain location=120 -250; Score=-0.8; E_value=0.0026; Accession=PF01832.11; Description =Mannosyl-glycoprotein endo-beta-N-ace
  Subcellular localization annotation: CTP_CleavageSite=81; ConfidenceScore=5.72e-01
MKRGSVLATTHTATKSHKASVVKKVKKPSSIKVSSKQEYSRNSVKSSSLPDLRKYPSGTPRKKAFLRTVMPYITKQNQAITADRNWLVSKQYDGRWSPSEQARLKDIASRYKVKWSGNTRRIPWNSLLERVDIIPNSMVATMAAAESGWGTSKLARVNNNLFGMKCGGGNCRGAMKGYSQFESVEQSVQAYVRNLNTHPAYSSFRKSRAQLRKTDQEVTASAMIHKLKGYSTKGSSYNNYLFAMYQDNQRLIAAHM

SEQ ID NO: 114387 - protein, 224 aa, Glycine max
  Coding DNA Sequence Number=SeqID_22702
  Gene Ontology: Mol. function=xylose isomerase activity; Cellular component=cytoplasm; Biological process=carbohydrate metabolic process
  Homolog annotation: Hit_ID=Q57IG0; Match level="QueryCoverage=82%, HitCoverage=42%, E-value=1e-104, Identity=94%"; Hit description =Xylose isomerase
MEFSMQTYFDQLDRVRYEGPKSTNPLAFRHYNPDELVLGKRMEDHLRFAACYWHTFCWNGADMFGVGSFDRPWQQPGEALEMAKRKAEVAFEFFYKLNVPYYCFHDVDVSPEGASLKEYSNNFAQMVDVLAEKQQQSGVKLLWGTANCFTNPRYGAGAATNPDPEVFSWAATQVVTAMNATHKLGGENYSVGRSRRLRVAVEYRSAPGARADWPLPADGGGAQA

SEQ ID NO: 114388 - protein, 173 aa, Glycine max
  Coding DNA Sequence Number=SeqID_22703
MDVEERLKTFVKIGKELATQLAQASMVASSRSNSLLEEESGRPNFRRSYGNSRIAQQHLLLVSAALRNFTDRITLLPFKMTSGASRDLHIVQQRGAKYLETTNHEVACHQKSPTRVCGSKAYKLILMMPKTQVKNQDSSKFQEPKSHSIKNQDSSEDSREDSRYARTSRIASR

SEQ ID NO: 114389 - protein, 87 aa, Glycine max
  Coding DNA Sequence Number=SeqID_22704
DIDVWQRKIVLGTGPIQVPIIYAHSYVPILLRDRMSRASSSSAFVLPRNTQDLEGHQFFTDGCGHTCAYLHFLFPLLVPKFTSSVSS

SEQ ID NO: 114390 - protein, 74 aa, Glycine max
  Coding DNA Sequence Number=SeqID_22705
MDNEEGVQEQMKADLSALKDQMASITDAMLKLQKTIEDNATATASNASTSLLSYPNFVRGPLLDDMRPFFGPCE

SEQ ID NO: 114391 - protein, 153 aa, Glycine max
  Coding DNA Sequence Number=SeqID_22706
MTTLTQTWMTLLLNNILPSDHNSDLPLPKCMPPTRHPLDPDKSNRALGFPALITGLCQSFGVPITPSKAANHRAHVQTHDCLYQLSLSLQSQGFASFPCPTPDLFRAEVAWPGDWPEAQAGEAPIEAPGDADEARMDEEMTDLLDFLGGSGAT

SEQ ID NO: 114392 - protein, 118 aa, Glycine max
  Coding DNA Sequence Number=SeqID_22707
MVTAMTIRGLLLGDLQVVAVANPILSPLISFVIGVGHTQRDCSRLKKEQNGGGPNGQTGHPKATGRVFTLNGVEALKSKDLIQGKLKLSVSSLNKDLVVETPTSGSVLTYYELMKHWA

SEQ ID NO: 114393 - protein, 248 aa, Glycine max
  Coding DNA Sequence Number=SeqID_22708
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSYSPKVGPGLPGINRDTRIYLFCEWLLFLSAVPPVQLLTGWCVTAKAPPDISAGKCSGRVPFAIQAAQLLGRAIGAGLFAITPAGERGMCCKAIKLAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114394 - protein, 117 aa, Glycine max
  Coding DNA Sequence Number=SeqID_22709
QAQADAPQAVDAPPPPHQADPVGSFGMERYLQHLVHQQVANHRGQVQIHECLYQLSLSQQSQGFVPFACPTPYQFRAKVAWPEDWLEAQAGEAPGEAPDDAEEAHMDEEMTNLLSFL

SEQ ID NO: 114395 - protein, 192 aa, Glycine max
  Coding DNA Sequence Number=SeqID_22710
  Gene Ontology: Mol. function=transferase activity; Biological process= metabolic process
  Homolog annotation: Hit_ID=A1FV61; Match level="QueryCoverage=100%, HitCoverage=62%, E-value=1e-68, Identity=70%"; Hit description =Malonyl CoA-ACP transacylase
MDAASPADAGMQAVLGLERHTLQPLCDAHGAHVAIANGRDHFIVGGTQAALQALADDARAQGAEIRPLPVHVPAHTPLLRSAVAAFAAALDASALQGPRLPLLAGIDARPVRDRATAVHTLSLQLAQTIEWAQVMRQAYERGARVFLQLGPGNALARMVASDYPCCEVRAVEEFQSLDGAAGWVRNALERLQ

SEQ ID NO: 114396 - protein, 174 aa, Glycine max
  Coding DNA Sequence Number=SeqID_22711
  Gene Ontology: Mol. function=transporter activity; Cellular component= cell outer membrane; Biological process=transport
  Homolog annotation: Hit_ID=A4WAP4; Match level="QueryCoverage=81%, HitCoverage=19%, E-value=6e-59, Identity=79%"; Hit description=TonB -dependent siderophore receptor precursor
  Pfam annotation: Domain name=Plug; Domain location=44-156; Score =95.5; E_value=1.7e-25; Accession=PF07715.6; Description=TonB -dependent Receptor Plug Domain
MKIALLRQAPLLMLPALLPLPLLAADNASNTLVVSAAPAASGLSELDTPAAVSVVSGDDMRHAAPRVNLSENLTSVPGLQIQNRQNYAQDLQISVRGFGSRSTFGLRGIRLYVDGIPASMPDGQGQTSNIDIGSIDRVEVLRGPFSALYGNASGGVINVETQRGQQPTTLEPVA

SEQ ID NO: 114397 - protein, 273 aa, Glycine max
  Coding DNA Sequence Number=SeqID_22712
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLAMFGSQPAGVVAGERESLEEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114398 - protein, 94 aa, Glycine max
  Coding DNA Sequence Number=SeqID_22713
MGIIGGYHKWLRVRTQGLDWLPNLKTVRDNEVKASEESDEPWNEKPRRPERKNTTKTSFEGLYRAAIVSSNSEEVKGIITGQRHDLEGRAKGLP

SEQ ID NO: 114399 - protein, 184 aa, Glycine max
  Coding DNA Sequence Number=SeqID_22714
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=71%, E-value=2e-24, Identity=69%"; Hit description=LacZ protein
MKHFTDTLISANIRLRGTPGMAMDWQVAPASPSSYTVKRILRLEIPVDAYPNTNQLLDPTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114400 - protein, 106 aa, Glycine max
  Coding DNA Sequence Number=SeqID_22715
  Homolog annotation: Hit_ID=A5BP71; Match level="QueryCoverage=70%, HitCoverage=19%, E-value=1e-10, Identity=45%"; Hit description =Putative uncharacterized protein
CGYVSLNYYQYVDVVYTNEHILKAYSTQWWPLGNEAVIPPSNDAWTFIPDPTTIRAKGRPKSTRIRNEMDWVEPSEHRQKCSRCGAKGHNRCRCPMQSEHGSCSNH

SEQ ID NO: 114401 - protein, 81 aa, Glycine max
  Coding DNA Sequence Number=SeqID_22716
LHVLTFRGLHVFAFIELHALTFVGLHALTFRGLHALAFRGLHILAFRGLHVLTFRGPHALAFRGPHAFAFRGLHVLVASLN

SEQ ID NO: 114402 - protein, 272 aa, Glycine max
  Coding DNA Sequence Number=SeqID_22717
  Pfam annotation: Domain name=DUF659; Domain location=184-271; Score= -69.0; E_value=0.091; Accession=PF04937.6; Description=Protein of unknown function (DUF 659)
  Pfam annotation: Domain name=zf-C2HC_plant; Domain location=37-84; Score=14.3; E_value=0.00087; Accession=PF07567.3; Description =Protein of unknown function, DUF1544
  Pfam module annotation: Pfam domain module=DUF659::zf-C2HC_plant; Domain location=184-271::37-84
MSFKGRRKKKGYGHMGVGIWDNVGMGWEGGNLREKRTPRPDKSRNSILSRCGKVISCGITRLKDHLARIPGEVTGCGDEHDEVQDFMDEDAYIIQAAQERIMSHKQWEDKQRFRQQTRGNSYAGAKAWNNPKLTRESRKPKKFGKAVSKLIIYERLSINLANSPRLYNLINADAELGLGVKAPPPYEFLEVYLEEEHKVMQSWIEGLKPTCGRKGGDYNGTMFLKSIDAFDVANRNIGYYLNLIDQIVEEVGEEYVVVQVVTDNEKVLKAAI

SEQ ID NO: 114403 - protein, 110 aa, Glycine max
  Coding DNA Sequence Number=SeqID_22718
DLSSSVPTSLPILIHLHVYFFIFNGRSNDKSLEGTNTWDPPIDFKQETSQTEDEENEDVGLPPELEKIVALEEQEMGPHQEETKLVDLGAGSGKREVKIDTGITAPIREE

SEQ ID NO: 114404 - protein, 171 aa, Glycine max
  Coding DNA Sequence Number=SeqID_22719
MAPRKLSTKRSRRDAAAEGTSATPEFDSHCFRSAEHQQRCKAIKGWSFHRERRVQLRDNEYTDFQEEIARRRWTSLVTLMAKFDPDIVLEFYANALPTEEGVRDMRSWVRGQWISFDADALSQFLGDPLVLEEGQECEFSQRRNMADGFDEEAIAHLLYVDDVAAQQCPTQ

SEQ ID NO: 114405 - protein, 79 aa, Glycine max
  Coding DNA Sequence Number=SeqID_22720
MTHLMVRRRRSTFYPRTMKVMRTSLKKFKVVIIKKEEIVEPSFMMMNQVYSRSFDDDKDDDKKPKRMISRLSQQVQDQV

SEQ ID NO: 114406 - protein, 169 aa, Glycine max
  Coding DNA Sequence Number=SeqID_22721
  Gene Ontology: Mol. function=carbon-sulfur lyase activity; Cellular component=nucleus; Biological process=metabolic process
  Homolog annotation: Hit_ID=A6T8J3; Match level="QueryCoverage=79%, HitCoverage=100%, E-value=4e-57, Identity=76%"; Hit description =Putative uncharacterized protein
  Pfam annotation: Domain name=GFA; Domain location=28-122; Score =101.8; E_value=2.1e-27; Accession=PF04828.5; Description=Glutathione- dependent formaldehyde-activ
MAEKRHAKCHCGAVAFTVELSDGLNTARRCSCSFCRMRGAVVVSAPLSGITVTKGQDKLTEYRFNTGTARHFFCSVCGIYTFHQRRSNPNEYGVNVACLENVSPFDFPEVTVMDGVNHPMDGESGVFGYLSFREKGTDDPREAPESGDKKPQPCEKITQQLRLSATGTA

SEQ ID NO: 114407 - protein, 84 aa, Glycine max
  Coding DNA Sequence Number=SeqID_22722
MQHWMSGVALGETRHKRLMEACLWGFYGGWIFELQWGPLVVIFHHGDAAEDKGRRGINETLGLIRILVVDLKRANKAALTLVNF

SEQ ID NO: 114408 - protein, 96 aa, Glycine max
  Coding DNA Sequence Number=SeqID_22723
  Subcellular localization annotation: CTP_CleavageSite=30; ConfidenceScore=5.00e-01
MERRMQQIPSPRRLAYVATYPSTGGRRVTRGMRVPRKEYARSRHQRLFEENVEKTGKDAIYELLSERFGSCIYARGRVFPFAPTYSSIWDEKIRPT

SEQ ID NO: 114409 - protein, 72 aa, Glycine max
  Coding DNA Sequence Number=SeqID_22724
MGSWVRSSMGSVHGPDQAGPCEQLDALSPFNPLSEMWQKEKESMDRPHRLHPVGTTRSPQGRLRHPGVADRP

SEQ ID NO: 114410 - protein, 20 aa, Glycine max
  Coding DNA Sequence Number=SeqID_22725
MSNSGDHCGLVKLNCDENCS

SEQ ID NO: 114411 - protein, 60 aa, Glycine max
  Coding DNA Sequence Number=SeqID_22726
MTLKCKDFQVQAIGQFAQATCAPEFGLPRPFNQRLLVLHVGGVAIKQRAKFKTNKFQNKK

SEQ ID NO: 114412 - protein, 295 aa, Glycine max
  Coding DNA Sequence Number=SeqID_22727
  Gene Ontology: Mol. function=motor activity; Cellular component=cell projection
  Homolog annotation: Hit_ID=UPI00016621D1; Match level="QueryCoverage =60%, HitCoverage=45%, E-value=3e-12, Identity=33%"; Hit description =UPI00016621D1 related cluster
MKGPLDESISCFLIRVEPWVLVPIAFRGLHVLDFKGLDVLNFRGLDRDTRPRLKGLHVLTFRGLHVLAFRGLHVLTLRGLHVLTFRGLNVIAFRGLHTLAVRGLHALAFRGLHVLAFRGLHVLTFRGLHALTVRGLHALAFRGLHILAFRGLHILTFRGLYVLAFRGLHVLAFRRLHVLTSEGYTSSLQRAPHPCLQRTQARGGGRSPALMRRLSHNYYAYQGKILPRPLQGDECGSCASVLGFPALITGLCQFYGVPIAPNKVIKPPINRDFIKKYCAPRQGQGEVLDKWPQLS

SEQ ID NO: 114413 - protein, 75 aa, Glycine max
  Coding DNA Sequence Number=SeqID_22728
  Homolog annotation: Hit_ID=A0PAV3; Match level="QueryCoverage=50%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTAGPYLQHKLLDPDER

SEQ ID NO: 114414 - protein, 92 aa, Glycine max
  Coding DNA Sequence Number=SeqID_22729
MQRLPFLYPLTRAAVSPAKPPDRPNREVDDPLYLMTLIIPQLFLKPLQVMWDATMFRVFNQDFSLYIKHKDLSEIAHGGQCLSISLIQLWIL

SEQ ID NO: 114415 - protein, 142 aa, Glycine max
  Coding DNA Sequence Number=SeqID_22730
TSPEDVDISRKGTDDDDGDISRIGDDVSHCKLSCFESDGSQMRRFRSLGWKTRTSPGMVANETFSQYRLEDADISGKGANDDSRPEDVDISRKDADISGKGARDDISHCMLSGFQSDRTQMRLFDMNPHGTRADLGSSRIKP

SEQ ID NO: 114416 - protein, 58 aa, Glycine max
  Coding DNA Sequence Number=SeqID_22731
MWKFFIVLHRSVEAKLHDDDKGDDKKLKDQSKNNSSESKTIQEFKIRIKKNSRLKKKV

SEQ ID NO: 114417 - protein, 57 aa, Glycine max
  Coding DNA Sequence Number=SeqID_22732
MTADLLEDMNFESPQASDSNSFFDDENCESNTNEAAIDTKGNSYTFDITLRISTDIL

SEQ ID NO: 114418 - protein, 163 aa, Glycine max
  Coding DNA Sequence Number=SeqID_22733
  Gene Ontology: Mol. function=phosphoprotein phosphatase activity
  Homolog annotation: Hit_ID=A7PI29; Match level="QueryCoverage=97%, HitCoverage=63%, E-value=1e-19, Identity=29%"; Hit description =Chromosome chr13 scaffold_17, whole genome shotgun sequence
ATITLQDVSVLLGLHTEGAPLIGQTNLDWAKLCEELLGVRPQEGGVLFVDKSSSKVSLREMCSATDYKIKSIGGMCILIQMWAWERCTTLAPKRTPPIIENKPLGHRWLRRGNQHIGNDDLIVFRRKLDIMKRHEFLWEPYTTTVMSMLPPICLVGSMAWCAV

SEQ ID NO: 114419 - protein, 68 aa, Glycine max
  Coding DNA Sequence Number=SeqID_22734
MKQKEKEKKTSKRPPTLRCFEPWFTEGVVAVALGEITLVEGAEYVEDKITDAVAERVEDDLGYDEDDF

SEQ ID NO: 114420 - protein, 216 aa, Glycine max
  Coding DNA Sequence Number=SeqID_22735
LDWLAKLKVVSKESFEAPEEDEEVQALKSELGKAKLAKEKFKLAATHVRKECAGLREENAITARALEQETKRARKEEYGRNKFRGALWGSNSELKLRREERDQSRTHSMTNMLAIIAKYQEELGLAAAHEHRIADEYAQVYAEKEARGRVIDSLHQEATMWMDRFALTLNGSQELPRLLAKAKAMTDTYSTPEEIHGLLGYCQHMIDLMAHIIRNR

SEQ ID NO: 114421 - protein, 51 aa, Glycine max
  Coding DNA Sequence Number=SeqID_22736
MLSHQRSPTTTVVPRPVFIPSFNNDGCAFLKQRRAQMTPDVEIDPNNNGAP

SEQ ID NO: 114422 - protein, 93 aa, Glycine max
  Coding DNA Sequence Number=SeqID_22737
GKGRIKRILRLCRFEFFDKGEGRHKRIQAVSPLFFWKREKRDTKRIQTVSPWRILFGRGEENEKMNNTSFQGLENQKDFGTKKKKKFKEIQGL

SEQ ID NO: 114423 - protein, 274 aa, Glycine max
  Coding DNA Sequence Number=SeqID_22738
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A6TAX6; Match level="QueryCoverage=99%, HitCoverage=73%, E-value=7e-89, Identity=60%"; Hit description=RNase D, processes tRNA
  Pfam annotation: Domain name=HRDC; Domain location=114-182; Score =61.9; E_value=2.2e-15; Accession=PF00570.14; Description=HRDC domain
MIDTQILPAFAGQPLSWGFAAMVNHFNQIELDKSEARTDWLARPLTERQCQYAAADVAYLLPIAHQLVAQTEAAGNMAAALSECATLCQRRLDVLQPEEAWSDITNAWQLRPRQLAVLQRLAAWRLNLARQKDMAVNFVVREENLWKVARFMPGSLGELDHLGLNGHEIRFHGKALVAMVAEAQALDEAALPPPLPNLIDHAHYKQAFKAIKALVQQVSEQTGYSQELLASRRQINQVLSVHWGLKSATRPPELLAGWRGEVLKAGIDEILHTL

SEQ ID NO: 114424 - protein, 269 aa, Glycine max
  Coding DNA Sequence Number=SeqID_22739
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVGSIDNDLVLRHIHTDDHLRIQDCHGTPSELGFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114425 - protein, 114 aa, Glycine max
  Coding DNA Sequence Number=SeqID_22740
MSLHVLYLYAFSRFSPRDFLSVVSLVTIFQRNERGFEAFSPHGQDRLGLPFGVKTKHERQKPVKVLKDERKRGWGHDRPIVTLLCAKQAGNVAARQPRILCILQLSFTICLGKE

SEQ ID NO: 114426 - protein, 187 aa, Glycine max
  Coding DNA Sequence Number=SeqID_22741
MAPRKLSAKRSRKDAAAKGTSAAPEFDSHLFRSAKHQQRFEAIKGWSFHRERCVQLRDDEYTDFQEELARWKWTSLVTPMAKFDPDIVLEFYANAWPTEEGVRDMRSWGQKCEYSQRRNRADGFDEKAIAQLLCIPGQDFARAAAGRRVRIMRTSMTTLTQTWMTLLLSNILPSDHNSDLPLLKCQL

SEQ ID NO: 114427 - protein, 142 aa, Glycine max
  Coding DNA Sequence Number=SeqID_22742
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
FLAPHEADHQLDDEAGDASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114428 - protein, 221 aa, Glycine max
  Coding DNA Sequence Number=SeqID_22743
  Homolog annotation: Hit_ID=A2FDT0; Match level="QueryCoverage=42%, HitCoverage=16%, E-value=6e-07, Identity=29%"; Hit description =Putative uncharacterized protein
GLHLLAFRGLHLLAFRGLHVLAFRGLHVLAFRGLYVLPVRGLHILAFRGLHILTFKGLYILAFKGLHTLAFRGLHVLAFRGLHILAFRGLQVLAFRGLHVLTFKGLHALPSEDYMSSPSKDSTSSPSEGYTLLPFRGLHVLAFRGLHVLTFRGLHTLAFREIHASPSEDYTSSPSENHTSSPSECCMPLPSEDYTSSPSEDYTSSTFRGPHVPHQGTIRPP

SEQ ID NO: 114429 - protein, 150 aa, Glycine max
  Coding DNA Sequence Number=SeqID_22744
MPPTRHPLDPNKSNRALGFPALITGLCQSFGGDAHQAVDTPPPPRQVDPAGSLGMERYLQHLVRQQAANHHGQVQIHECLYQFSLSQQGQGSAPFACPTPEQFEAEVTWPGDWPEAQAGEEPAGSPDGAEEARMDEDMTDLLGFLRGSEA

SEQ ID NO: 114430 - protein, 93 aa, Glycine max
  Coding DNA Sequence Number=SeqID_22745
MSVKNLVGRLEVHDKMDHTPEVRSLSLGKIIGKPVNVTLFCENVSTMYDRHKLKRALKHGVFTPRPRLRRVCQGLSLLIQVQPRKYLTRRLYL

SEQ ID NO: 114431 - protein, 52 aa, Glycine max
  Coding DNA Sequence Number=SeqID_22746
MAASVQNNPIDVKKKSHEDSKNGGFNPFSVSLTFENSIGTVGGKTGGISRNR

SEQ ID NO: 114432 - protein, 797 aa, Glycine max
  Coding DNA Sequence Number=SeqID_22747
  Gene Ontology: Mol. function=nucleotide binding; Cellular component =intrinsic to membrane; Biological process=defense response
  Homolog annotation: Hit_ID=Q2HVE0; Match level="QueryCoverage=69%, HitCoverage=62%, E-value=6e-96, Identity=38%"; Hit description =Leucine-rich repeat; Leucine-rich
  Pfam annotation: Domain name=LRR_1; Domain location=461-488; Score =3.9; E_value=58; Accession=PF00560.24; Description=Leucine Rich Repeat
  Pfam annotation: Domain name=LRR_1; Domain location=506-527; Score =7.3; E_value=14; Accession=PF00560.24; Description=Leucine Rich Repeat
  Pfam annotation: Domain name=LRR_1; Domain location=529-550; Score =6.6; E_value=18; Accession=PF00560.24; Description=Leucine Rich Repeat
  Pfam annotation: Domain name=LRR_1; Domain location=552-574; Score =9.8; E_value=4.8; Accession=PF00560.24; Description=Leucine Rich Repeat
  Pfam annotation: Domain name=LRR_1; Domain location=576-599; Score =10.5; E_value=3.5; Accession=PF00560.24; Description=Leucine Rich Repeat
  Pfam annotation: Domain name=LRR_1; Domain location=601-620; Score =3.9; E_value=59; Accession=PF00560.24; Description=Leucine Rich Repeat
  Pfam annotation: Domain name=LRR_1; Domain location=622-643; Score =7.5; E_value=12; Accession=PF00560.24; Description=Leucine Rich Repeat
  Pfam annotation: Domain name=LRR_1; Domain location=645-666; Score =4.2; E_value=52; Accession=PF00560.24; Description=Leucine Rich Repeat
  Pfam annotation: Domain name=LRR_1; Domain location=668-693; Score =12.2; E_value=1.7; Accession=PF00560.24; Description=Leucine Rich Repeat
  Pfam annotation: Domain name=LRR_3; Domain location=506-525; Score =26.6; E_value=9e-05; Accession=PF07725.3; Description=Leucine Rich Repeat
  Pfam annotation: Domain name=NB-ARC; Domain location=111-355; Score= -53.9; E_value=7.8e-07; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_3::NB-ARC; Domain location= 461-488::506-527::529-550::552-574::576-599::601-620::622-643::645 -666::668-693::506-525::111-355
MELKLHTSMTSIPRAIFTHSSSSIPFCTYAVLDASSVKNACRVFDQMSDKNIASWHLMLGGYTSNGLRCDGLLVFQQMKQSGASGGGLVGVEGGVVVNGTAITEEVVEVIDEVAVTRVILLRQRVHMAPHMTYLHGPLIVTNDVELLQEIINLVLMTLRKHTVDSKGLVGIDKQVAHLESLLKQESKDVCVIGIWGVGGNEQLEELFGTPDWYGSGSRIIITTRDIKVLIANKVPEIYHVGGLSSCEAFQLFKLNAFNQGDLEMEFYELSKRVVDYAKGIPLVLKILAHLLCGKDKEVWKSQLEKLKGIKSNNVHDFVKLSFDDLHHEEQEILLDLACFCRRANMIENFNMKVDSINILLGDCGSHNAVVVGLERLKEKSLITISEDNVVSMLDTIQEMAWEIVCQESNDLGNRSRLWDPIEIYDVLKNDKGTKAIRSITTPLSTLKNLKLRPDAFVRMSNLQFLDFGNNSPSLPQGLQSLPNELRYLHWIHYPLTCLPEQFSAEKLVILDLSCSRVEKLWHEVKNLVNLKNVKLRWCVLLNELPDFSKSTNLKVLDVSCSSGLTSVHPSIFSLHKLEKLDLSGCSSLIKFSSDDDGHLSSLLYLNLSDCEELREFSVTAENVVELDLTGILISSLPLSFGSLRKLEMLHLIRSDIESLPTCINNLTRLRYLDLSCCSNLCILPKLPPSLETLHADECESLETVLFPSTAVEQFEENRKRVEFWNCLKLDEFSLMAIELNAQINVMKFAYQHLSAPILDHVENYNDYKDLMILIKQCTCIQEAVFQSGWHIRLERIM

SEQ ID NO: 114433 - protein, 180 aa, Glycine max
  Coding DNA Sequence Number=SeqID_22748
MGRASIYQDDHWVAAHRTEERKRLGGWSALHRIQADVWGNRKIQPGGGGVVVGGEVRRGFRFVVGNEKVLTGFAAVAVGPLFFIVVAESLLAADREFLEGEKEVGRERWPRRRSSSLSSWRRASSVAWGRDIGRNAWTSRRSSGIKPETKQLSRQDGGRPKVRLARRSNSVRYSLTLSVC

SEQ ID NO: 114434 - protein, 106 aa, Glycine max
  Coding DNA Sequence Number=SeqID_22749
MTLLLSNILPRDRNANLPLQKYQLVCVVPTWGSHPQDTQWTRKVHRPWGFSSGYGPLSVLQGAVPPGKAIDAPPPPLEFTSAHPQKGLSIAYDTWPTIRQPSPKPK

SEQ ID NO: 114435 - protein, 159 aa, Glycine max
  Coding DNA Sequence Number=SeqID_22750
  Gene Ontology: Mol. function=DNA-directed DNA polymerase activity; Cellular component=DNA polymerase III complex; Biological process =DNA replication
  Homolog annotation: Hit_ID=A1FTN6; Match level="QueryCoverage=100%, HitCoverage=23%, E-value=8e-88, Identity=100%"; Hit description=DNA polymerase III, subunits gamma and tau
  Pfam annotation: Domain name=ResIII; Domain location=24-155; Score= -37.1; E_value=0.062; Accession=PF04851.6; Description=Type III restriction enzyme, res subunit
MEHPMENGGLMSYLVLARKWRPKRFAELVGQEHVVRALSNALDSGRVHHAFLFTGTRGVGKTTIARIFAKSLNCEQGTSADPCGQCAACLDIDAGRYIDLLEIDAASNTGVDDVREVIENAQYMPSRGKYKVYLIDEVHMLSKAAFNALLKTLEEPPEH

SEQ ID NO: 114436 - protein, 299 aa, Glycine max
  Coding DNA Sequence Number=SeqID_22751
  Gene Ontology: Mol. function=methyltransferase activity; Biological process=hemolysis by symbiont of host red blood cells
  Homolog annotation: Hit_ID=Q2W371; Match level="QueryCoverage=68%, HitCoverage=43%, E-value=9e-13, Identity=30%"; Hit description =Predicted rRNA methylase
DQQHLRAEVVDGRQHLVGPDVAEAEAAAARRQQDVHHAAGTAVAAHAGIGKQPGLVGAVVRHPGILLEDVLGAIAVVHVEIDHRDPLQAMAVAGIRGGDGDVVQQAEAHHRAAGGVVARRAHRAEGQRVLAQHHRIDCGHTGTGGVHGGAGRAGRGPSVHVQLAQRRGLRLQHEVEQGAVVDPGQFAELGRRRFAPLQLAGEGRVQRVQHMLQALRAFGMAGTGVMQQAGRVGIDQHRADSALALLRLPQRFALAIGAGQHPGQHEQQVRQPVEVLQRLTAHGFVAGQGDRFALGAADD

SEQ ID NO: 114437 - protein, 67 aa, Glycine max
  Coding DNA Sequence Number=SeqID_22752
MGSSQTPSLKKRFYQVKLQRQAFRKAYGKIWDLAMVEVSTEAIASLAQYYDQPLRCFTFGDFQLSPM

SEQ ID NO: 114438 - protein, 165 aa, Glycine max
  Coding DNA Sequence Number=SeqID_22753
MQSQFQSQMQSQGLALPPQPEVGPSAARVSTKETCVDPSGNDLDTGDSDRCRLYIEENPPHLVALGRLYEGSITVHNIPLLHDQVKVGVEEVRDANASIPVPIEEVKLVRQTLNTFLAWPTHLVKRLSEQGAVGLVKPADMLDHDVDDPLYPMTLTIPQLFLKPL

SEQ ID NO: 114439 - protein, 203 aa, Glycine max
  Coding DNA Sequence Number=SeqID_22754
MSTLKEQMASMMEAMLRMRQIMEKNVATAAAVSSAAEADPTLLATAHHPPPNTIGRGRSTLGHNSNPHLGYNRVAYPYGLPPNYTPPVMQDDAGHVSSPILEGEPPQQPHEAHEDHQEHAQGDVDFYPPIPVEGPTTNTLPQHNLTAQPVFLSTEGPPPAAEERRKLDLLEERLRAVEGFGDYPFADMTDLCLVSDVVIPPNS

SEQ ID NO: 114440 - protein, 134 aa, Glycine max
  Coding DNA Sequence Number=SeqID_22755
MAPRKLSAKRSRRDAEAEGTSAAPEFDSHRFRSVEHQQGFEAIKGWSFHRERRVQLRDDEYTDFQEEIARRRWTSLVTPMAKFDPDIVLEFYANAWPTEEGARDMQSWVRGQWIPFDANALSQFMGDPLVLEEG

SEQ ID NO: 114441 - protein, 149 aa, Glycine max
  Coding DNA Sequence Number=SeqID_22756
MSTSQGIRKKMQEIQKYNDCPHVLSRGGYDLLEKKMMEEKMNKRQHDAMTTENTPNSADPPSPIQRHASLEEQTRQGTFVPHGREDILNTAIGRPDHGGRVRAAGFGVTISQYFGRAARGSSCSSGSISQVQMAEIIGGLQEQWKNEIQ

SEQ ID NO: 114442 - protein, 219 aa, Glycine max
  Coding DNA Sequence Number=SeqID_22757
MAKNSYTRENFEALEEDEEVQALKSELGQARLAKEKFKLVTTDIGKECTELQEGNAATARALEQETKRVRKEEHGRDKFCGALWGSNNELKLRRKERDQSRVHSMVLKEELAVCSRSKRSLAQHIEATEQSMLAIIRQYKEELNQSLAHEQKLVEDFAQAYAEKEARGRVIDALHQEATMWMDRFALSKGHGRSVFSPRGNSRANQLLSTHDRFNGPYN

SEQ ID NO: 114443 - protein, 67 aa, Glycine max
  Coding DNA Sequence Number=SeqID_22758
MIMRGQDIYSSQDEATTSPSSSESEEAKWEESSFEGRSPEYEEPRDLRSNPFHGEGTDAILPFKGIG

SEQ ID NO: 114444 - protein, 130 aa, Glycine max
  Coding DNA Sequence Number=SeqID_22759
MTRRDKIWSFYTLVSSRGGGPDGPDDTRRYLTVIRTLCHPEAAGPMTRRDKIWSFCTLVSSRGGGPDDTRRYLTVIRTLVSSRGGGPDDTRRYLTVIRILLSSRGGGPDDTQRQNLVILHPCVIQRRRTR

SEQ ID NO: 114445 - protein, 147 aa, Glycine max
  Coding DNA Sequence Number=SeqID_22760
MRSFNGDFPPWRCSGRQRRRGERRCHPIGKEEIHHQECVLDKKLGEDASMEEKKETEKEKGKSTKLKEEASMRSFNGDFPPWRCSGRQRRRGERRCHPIGKEEIHHQECVLDKKLGEDASMEEKKETEKEKGKSTKLKEERGREFEL

SEQ ID NO: 114446 - protein, 158 aa, Glycine max
  Coding DNA Sequence Number=SeqID_22761
MQSQGLALSPKPEVGPSAAHINTKESCVDPSGNDPDTGDLEKCRLYIEENPPRLVALGRLYEWSTTIHNIPLRNDQVKEVVGSEKLADNLDHDVDVPLYLMTLTIPQLFLEPLQVMWDATMFGVFNDNFPLYIKHEDLSEIAHGGQCLNISVIQLWIL

SEQ ID NO: 114447 - protein, 124 aa, Glycine max
  Coding DNA Sequence Number=SeqID_22762
  Gene Ontology: Mol. function=formate C-acetyltransferase activity; Cellular component=cytoplasm; Biological process=carbohydrate metabolic process
  Homolog annotation: Hit_ID=A4WET9; Match level="QueryCoverage=100%, HitCoverage=16%, E-value=2e-62, Identity=95%"; Hit description=Keto acid formate lyase
  Pfam annotation: Domain name=Gly_radical; Domain location=1-105; Score=176.3; E_value=8e-50; Accession=PF01228.12; Description =Glycine radical
MHGRDRKGAVASLTSVAKLPFTYAKDGISYTFSIVPQALGKDELVRKTNLVGLLEGYFHHEASIEGGQHLNVNVMNREMLLDAIAHPENYPNLTIRVSGYAVRFNALTREQQQDVISRTFTQSI

SEQ ID NO: 114448 - protein, 37 aa, Glycine max
  Coding DNA Sequence Number=SeqID_22763
MGKVPPEGYCFWRKQPGSPGRAGREASPLFCYREGRK

SEQ ID NO: 114449 - protein, 66 aa, Glycine max
  Coding DNA Sequence Number=SeqID_22764
MWDTLQLTHEGTTDEHEMELQRLNQNEENDKKKRSIALKASSSIQDENEEGDSDDEEDFSFFVKKF

SEQ ID NO: 114450 - protein, 108 aa, Glycine max
  Coding DNA Sequence Number=SeqID_22765
MEEGYEAVPSAPSDLLDSEWRLLSLAEIAYYGWSFASLTLLRKVEEEPQLLVVFVVTTATVAALEEEHMACLDQQHSGEEGHAVVVVEDLSISDLDDSYNLDCIYCLK

SEQ ID NO: 114451 - protein, 67 aa, Glycine max
  Coding DNA Sequence Number=SeqID_22766
  Subcellular localization annotation: CTP_CleavageSite=39; ConfidenceScore=5.41e-01
MAVIFGSGTGVARPGKLSSPKRANLPFFLGETLTMPPPLTATFSACPAPGRDDDRSVVTLSSICIRP

SEQ ID NO: 114452 - protein, 255 aa, Glycine max
  Coding DNA Sequence Number=SeqID_22767
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLASHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114453 - protein, 112 aa, Glycine max
  Coding DNA Sequence Number=SeqID_22768
MDLVQSDRDDPSLPLWRDLKIIFQNTQQGEKIKKGISWKVGRGDRFKFWEDEWIQGEVSLITKYPRLFVISQQQNNSIQQMGGFKDNEWEWNLSWRRPLFHNEQRQNNSILV

SEQ ID NO: 114454 - protein, 142 aa, Glycine max
  Coding DNA Sequence Number=SeqID_22769
MRVHITFRGLHILIFIPGPPPNIGGRPTVRAHPEREAIMHLLCIPGQDFTRAAAKRRGSHPQRHPVDLKKSNRALGFPALVTGLCRPYRAPVPPNKFMSSWHRDCARKTPSGPCRNLPFGGRAKRDSRDACSTKGIRAESPP

SEQ ID NO: 114455 - protein, 94 aa, Glycine max
  Coding DNA Sequence Number=SeqID_22770
MSNHKSTGSALKNLEVQVGQLARQIADKSSNSFVANTEKNPREECKAVMTRSKRFVEAKDEESIVHKKKAVEKKGTEGKRKDVRGESIKKKRNK

SEQ ID NO: 114456 - protein, 263 aa, Glycine max
  Coding DNA Sequence Number=SeqID_22771
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLALGAATALLPGEGLAQRDWHTGTGTGGLAQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114457 - protein, 106 aa, Glycine max
  Coding DNA Sequence Number=SeqID_22772
  Gene Ontology: Mol. function=nucleotide binding; Biological process =defense response
  Homolog annotation: Hit_ID=A7NX23; Match level="QueryCoverage=91%, HitCoverage=17%, E-value=8e-13, Identity=40%"; Hit description =Chromosome chr5 scaffold_2, whole genome shotgun sequence
LLFLDLSYNAYEGETLNFQSGGFQKLKRLLLGYLDQLKCILIDRGALCSLEVFSLRDLSQLKTVPSGIQHLEKLKDLYIEFMPTKFEQCIAPDGGEDHWIIQDVPH

SEQ ID NO: 114458 - protein, 376 aa, Glycine max
  Coding DNA Sequence Number=SeqID_22773
MGLIIPQDYAEEVANRSIEGQRALRLTPKTLDQNPRKLFLKYMRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLDENYNLHPFEFNHSHFCTMGFVTWWEKYYSTRSVGDTTIMISRLESGFTQPTVENIRSNLQARGKTIMTKKSAETSRTDVRPKKPTGVKIQEGKQEEKEEEERPLIRKRKFPSTSTKSTEQTEAGNSQAQMPKKKKKVKQVEPEPPVAVEGGESIKKKKKKTKSSKEQGNNQPVDVQPPSTNIDGTEVEATPSIAEMGNPVDRPNSPREQSVVEVSSS

SEQ ID NO: 114459 - protein, 92 aa, Glycine max
  Coding DNA Sequence Number=SeqID_22774
MSWFLLYSMLPLMKKPAANLLNVLLTLSEASGRYYLLSTYRLISKYQGLPSRSSSTKQKCAGLPRHLNSMYGRSTCGVSWNMDAKVASTSAI

SEQ ID NO: 114460 - protein, 86 aa, Glycine max
  Coding DNA Sequence Number=SeqID_22775
MEREMITMIVDTLLVFYYEKMVGYMPSSFADLVFAGERIRVGLIRGKFNYPALMNRKTGANGENKKEGGTHDVTVVPTWPNFPPAK

SEQ ID NO: 114461 - protein, 152 aa, Glycine max
  Coding DNA Sequence Number=SeqID_22776
MSPSRNMLKDTLPTLYYEKLIGYMSVNFADLIFAGERIESGLRKGKFEYASNAGPNSNRRALVVGTRKKEGDTHAVTTAPTWMKTPQNAKNLYQHNHPNFWIRAESSLLTQVEGPATTEKAHAQHAAPSTPRPANNTTPSTSYDNQRHPPRD

SEQ ID NO: 114462 - protein, 220 aa, Glycine max
  Coding DNA Sequence Number=SeqID_22777
KEGASVNKFPRWKEGRTGALISCGGFPNVPLMGTKGCISYNPVRKAWEMVQKKDKELRGSNNGPISGYRRWLKAHMQSLDWLLSLRTTKGVEVEAPEEDEEVQALRAELEKAQTVKERFKSVALKIRKENAKLRDGSNNELKLRREERDQSRVDSLLLKDELKVCLRSKRNLSQRLCETETNMLAIISKYQEELNLATAHKHKVADEYARVYAEKEARGR

SEQ ID NO: 114463 - protein, 85 aa, Glycine max
  Coding DNA Sequence Number=SeqID_22778
  Homolog annotation: Hit_ID=A0ST23; Match level="QueryCoverage=31%, HitCoverage=55%, E-value=2e-08, Identity=100%"; Hit description =Putative reverse transcriptase
MKEGIGHILDLTPIGEKRIKLIDTVDLEGGPVGKPVVPAALMNRPTRGERRFAYWALAECILAYYVGTDEGVSEVLHVAGEKRLH

SEQ ID NO: 114464 - protein, 216 aa, Glycine max
  Coding DNA Sequence Number=SeqID_22779
  Gene Ontology: Mol. function=binding; Cellular component=integral to membrane; Biological process=regulation of transcription
  Homolog annotation: Hit_ID=Q13YL0; Match level="QueryCoverage=69%, HitCoverage=29%, E-value=2e-18, Identity=34%"; Hit description =Hypothetical TPR domain protein
MPDTPRSIVLVADTLRQEDARLLSQTSLPLQLWVPGTAPGGPLPPAFASQAIDTRLNVARFQQLRDNGVAVTLATPDDSDLLAIRHHIQQSLSAQQNSRGDLPWHNSGYWLIAPMLLLPLWWRRQILIVLIVLPLSGITPPAAAALLDAFIPPDLQGQHAFQRQNYARAAQHYVDPLRRGIALYYAGDFSAASGAFRQAPVTPESLLWLGNSLAQQ

SEQ ID NO: 114465 - protein, 127 aa, Glycine max
  Coding DNA Sequence Number=SeqID_22780
MVGYTPSSFADLVFAGEMIEVGLKRGKSDHHALTNAKKNIGANEEGENEGETHVVTAIPIQPSFPPTQQCHYSANNKPSPGPPPSYQQRPSLNQPQNPPTTQPMLNTTFSTNQNTNQEMSFAAKKNL

SEQ ID NO: 114466 - protein, 136 aa, Glycine max
  Coding DNA Sequence Number=SeqID_22781
VVDIGQERRPIHDENHETGQIEAKGPSGEGRRPKWRRTKPPSGEGLIKVILVASTLTYLPSLEVASIQTYLPSPEVASTWTYLPSPEVASTLTYLPSPEVASSKLCNLYQRSAPLNAQVEKDEGPSGEGQSPRVEK

SEQ ID NO: 114467 - protein, 128 aa, Glycine max
  Coding DNA Sequence Number=SeqID_22782
  Subcellular localization annotation: CTP_CleavageSite=32; ConfidenceScore=5.36e-01
APVASVSISCPSCSATDGVVRKRQKHRRTSALASVAGGQLLGRAIGAGLFAITPAGERGMCCKAIKLGNARVFPVTTLCDYDSSSDIKLIDTVDLEGGPAECILAYYVGTDEGVSEVLHVAGEKKAAP

SEQ ID NO: 114468 - protein, 272 aa, Glycine max
  Coding DNA Sequence Number=SeqID_22783
  Gene Ontology: Mol. function=DNA binding; Biological process=DNA recombination
  Homolog annotation: Hit_ID=Q47GF7; Match level="QueryCoverage=97%, HitCoverage=63%, E-value=2e-67, Identity=50%"; Hit description=Phage integrase
MAVFAMASIRELNGKLFFDFRFRGQRCREYTAVLDNKTNRSKMEKILTKIEEDIEADRFEYRRYFPNSKNAVKFDDPATVLSKVAAETQKAFTRNPSVGNTPLFSEFVEQWFNEFSVGWRRTYISTVRQIVDTRLIPEFGQSRVSDIHREDILSFRSTLGKEPGRKQDSKLSPRRINAIVLVLTQVLNEAADRYHFITSGDRIKPLKLKKTHVQPFSLEEVNKIISICRPDFKDYFIVRFFTGMRTGEADGLKWKYVDFDKRLIYIRETFTA

SEQ ID NO: 114469 - protein, 82 aa, Glycine max
  Coding DNA Sequence Number=SeqID_22784
MDHFLVTAFSCLFDSGTASIRGLTGVSSKGGKCTESPPTFICGKLRKNRRKPVIKNIPDSGVAFTFEEGINTSHVCPKGQQP

SEQ ID NO: 114470 - protein, 68 aa, Glycine max
  Coding DNA Sequence Number=SeqID_22785
MLDQFHLCTQDSIENIIDVKADGNYGYQAIAVLLGMGEKSWSLVRNHLHKELTSCPKSISTWLPWTSG

SEQ ID NO: 114471 - protein, 158 aa, Glycine max
  Coding DNA Sequence Number=SeqID_22786
NHSGLKRRKFDYISSTNTNARRIGATGAKRKEGDTHVVTSAPAWIKPSQTSHGTHQYAQHHPSFSARAGDPSNSAPVQARAPAPIQRETPQATALTPTRPAGNAHFGVSSNAIRNFPPRRIQDFTMIPMTYEDLLPRRQPDGCDISRKDLPASFPKVV

SEQ ID NO: 114472 - protein, 207 aa, Glycine max
  Coding DNA Sequence Number=SeqID_22787
  Homolog annotation: Hit_ID=A0ST23; Match level="QueryCoverage=12%, HitCoverage=51%, E-value=6e-07, Identity=100%"; Hit description =Putative reverse transcriptase
ISVTGIYSAQSASAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIFKDQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 114473 - protein, 76 aa, Glycine max
  Coding DNA Sequence Number=SeqID_22788
  Homolog annotation: Hit_ID=A5ATT4; Match level="QueryCoverage=48%, HitCoverage=9%, E-value=2e-07, Identity=62%"; Hit description =Putative uncharacterized protein
MGSKSILRLMRTLGSSVASLAQSSWSLLSNALGGYEPIWEIIDKRWENQLYRPLHAGAYYLNPQFHFEDDFKKDNG

SEQ ID NO: 114474 - protein, 196 aa, Glycine max
  Coding DNA Sequence Number=SeqID_22789
  Homolog annotation: Hit_ID=Q9AXI7; Match level="QueryCoverage=30%, HitCoverage=17%, E-value=9e-08, Identity=48%"; Hit description =Putative POL3-like reverse transcriptase
MARAGDNGGVYHQLDESQRLSINTTTTRVQRLLNCNKEEPYRRIAKSSSFTLKPLSPRKGCLSQGDPHGLPPSRSIEHQVDLLLEASLPNKPTYNSKPQETQHKDAQVKVEYEKRLYDQVKVQIAKKNESYAKQANKKRKEVVLELGDDPGHLRTNVFQEGGNDENHETGQIQAKGPSGEGRRPKWRRTKPPSGEG

SEQ ID NO: 114475 - protein, 105 aa, Glycine max
  Coding DNA Sequence Number=SeqID_22790
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=70%, E-value=4e-11, Identity=55%"; Hit description=LacZ protein
  Subcellular localization annotation: CTP_CleavageSite=28; ConfidenceScore=5.29e-01
MSSNIDNNRQSNSCSPGDPLVLERPPPRWSSNSPYTHPPFASWRNSEEARTDRPSQQLRSLNGEWDAPCSGALSAAGVVVTRSVTATLASADVRRCFCRYAPPRQ

SEQ ID NO: 114476 - protein, 59 aa, Glycine max
  Coding DNA Sequence Number=SeqID_22791
MRNPHAQLFSIRGRQTQAMINSGSQYSEVLSDAMNSGQQESNTHIVNEFDRHNHTFIIT

SEQ ID NO: 114477 - protein, 107 aa, Glycine max
  Coding DNA Sequence Number=SeqID_22792
  Gene Ontology: Cellular component=nucleus; Biological process=cell division
  Homolog annotation: Hit_ID=A7NUY9; Match level="QueryCoverage=64%, HitCoverage=7%, E-value=5e-13, Identity=52%"; Hit description =Chromosome chr18 scaffold_1, whole genome shotgun sequence
MISTKPVDRYTRPEFTENGPLAIDSKQAINHIKRKYELENMEIVNKEKEKVRYDFLADKAIAEIEAKCGQKIEECKEEQRQQLMRIEDEHTLLVSIEKVLNLKLLAA

SEQ ID NO: 114478 - protein, 50 aa, Glycine max
  Coding DNA Sequence Number=SeqID_22793
MEKIRGGWLFSTVTTLLLLWSYKLCYDAAYCHLIESCIPDNKDFLTIIVR

SEQ ID NO: 114479 - protein, 305 aa, Glycine max
  Coding DNA Sequence Number=SeqID_22794
  Gene Ontology: Mol. function=acyltransferase activity; Cellular component=cytoplasm
  Homolog annotation: Hit_ID=A7Q397; Match level="QueryCoverage=99%, HitCoverage=63%, E-value=1e-43, Identity=34%"; Hit description =Chromosome chr12 scaffold_47, whole genome shotgun sequence
  Pfam annotation: Domain name=Transferase; Domain location=8-305; Score=-186.2; E_value=0.064; Accession=PF02458.6; Description =Transferase family
MAEHREHKVVDKSQVAPATSRTMSFPLSFLDLPYARLLYVKRLFFYHFPHPPHIFYETLLPSLKHNLSLTLQHFFPLAGNLLCPPQPNKPFIRCTDDDSVTLTIVESKAYFNHLSSNHPKNLKDLDHLVPMLTFTTVHGDDDEDTYVSPLVALQVTVFPNHGLCIAITNSHVIMDGRSSCYFIKYWSSICRSGGVDLTTPCFDREVFKDTKGLEAIFLRDYFEERSTWKDKLKLIGQTPNHHEDYVKATVSFGRDDIDGMKRWVLNQLEKNDELMKAPQYLSKFVVTCGFEWASWVKAKYRPDDI

SEQ ID NO: 114480 - protein, 955 aa, Glycine max
  Coding DNA Sequence Number=SeqID_22795
  Gene Ontology: Mol. function=nucleic acid binding; Cellular component= chromatin; Biological process=chromatin assembly or disassembly
  Homolog annotation: Hit_ID=A7PQX9; Match level="QueryCoverage=94%, HitCoverage=52%, E-value=0.0, Identity=71%"; Hit description =Chromosome chr6 scaffold_25, whole genome shotgun sequence
  Pfam annotation: Domain name=Helicase_C; Domain location=140-219; Score=100.2; E_value=6.3e-27; Accession=PF00271.22; Description =Helicase conserved C-terminal domain
MELRPHILRRVIKDVEKSLPPKIERILRVEMSPLQKQYYKWILERNFHNLNKGVRGNQVSLLNIVVELKKCCNHPFLFESADHGYGGDSGSSDNSKLERIVFSSGKLVILDKLLVKLHETKHRVLIFSQMVRMLDILGEYMSLRGFQFQRLDGSTKAELRQQAMDHFNAPGSDDFCFLLSTRAGGLGINLATADTVIIFDSDWNPQNDLQAMSRAHRIGQQEVVNIYRFVTSKSVEEDILERAKKKMVLDHLVIQKLNAEGRLEKKEAKKGGSYFDKNELSAILRFGAEELFKEERNDEESKKQLLSMNIDEILERAEKVEEKEADGEQGNALLGAFKARYVDSTVANFCNDEDDGSFWSRWIKPDAVFQAEEALVPRSARNIKSYAEVDPSEKSNKRKKKEPEPLDRVSKRRKAEYSAPAVPMIEGASVQVMKYGNESQVDLIVAEVGGAVGAAPPGVQIELFNALIDGCTEAVELGNLDAKGPLLDFFGVPVKANDLLTRVQQLQLLAKRIGRYEDPIAQFRVLSYLKPSNWSKGCGWNQIDDARLLLGIHYHGFGNWETIRLDERLGLTKKIAPVELQHHETFLPRAPNLKDRANALLEQELAVLGVKNANSRVGRKPSKKERENMINISLLRGQEKKKKSSSVNVQMRKDRFQKPQKVESIVKEEGEMSDNEEVYEQFKEVKWMEWCQDVMVEEMKTLKRLHRLQQTSANLPKEKVLSKIRNYLQLLGRRIDQIVLEHEQEPYKQDRMTVRLWKYVSTFSHLSGERLHQIYSKLRQEQNEAGVGPSHANGSVSVSFSRNGNPFHRHMERQRGLKNMAPYQMPEPVDNTGKSEAWKRRRRTESDNHFQGQPPPQRTLSNGIRITDPNSLGILGAGPSDKRFASEKPYRTQPGGFPSRQGFSSASAIVHSVEFFSSTHANKTLRIPFWCVLADMRNIPTLGFTSLKMAEAEKI

SEQ ID NO: 114481 - protein, 357 aa, Glycine max
  Coding DNA Sequence Number=SeqID_22796
  Gene Ontology: Mol. function=ATP-dependent helicase activity; Cellular component=mitochondrion; Biological process=mRNA catabolic process, nonsense-mediated decay
  Homolog annotation: Hit_ID=Q9LUW5; Match level="QueryCoverage=90%, HitCoverage=55%, E-value=1e-114, Identity=62%"; Hit description=DEAD- box ATP-dependent RNA helicase 53
  Pfam annotation: Domain name=DEAD; Domain location=107-277; Score =244.1; E_value=3.1e-70; Accession=PF00270.20; Description=DEADDEAH box helicase
  Pfam annotation: Domain name=ResIII; Domain location=103-272; Score= -21.1; E_value=0.0028; Accession=PF04851.6; Description=Type III restriction enzyme, res subunit
  Pfam module annotation: Pfam domain module=DEAD::ResIII; Domain location=107-277::103-272
  Subcellular localization annotation: CTP_CleavageSite=60; ConfidenceScore=5.47e-01
MLTAILRRTCSTLSRRGFPAALISASTAGNHFRPPSAAFISRTFHSNTGPLNFRSSSCHRAEYAVDDFPYEEGSKGNAADEGLEIAKLGISEDIVSALAKKGITKLFPIQRAVLEPAMQGRDMIGRARTGTGKTLAFGIPIMDKIIQFNAKHGRGRDPLALVLAPTRELARQVETEFCESAPNLDTICVYGGTPISRQMRELDYGVDIAVGTPGRIIDLLNRGALNLKDVQFVVLDEADQMLQVGFQEDVEKILERLPPKRQTLMFSATMPSWIKQISRNYLNNPLTIDLVGDSDQKLADGISLYSIATDLYVKAGILAPLITGWCLLTRRSQVQILETAFPLEAVRLCTSTLLRPN

SEQ ID NO: 114482 - protein, 280 aa, Glycine max
  Coding DNA Sequence Number=SeqID_22797
  Homolog annotation: Hit_ID=A7QS50; Match level="QueryCoverage=100%, HitCoverage=90%, E-value=1e-82, Identity=50%"; Hit description =Chromosome chr5 scaffold_156, whole genome shotgun sequence
FHPLEELKGSNDIQPARLSPAEIAKTTVEANKSALLVFPGMVHCEPHDQISWAEFQYHIDDVGDIYFEISDDANLLADCGANNPVNALIGMDIPIYDNNRRTASEYDIFNNGSDDEFKFDDDDIEVSEMEEFNIPVNWGQSDTTKSVHPIYFSKCLAKAINNMEYVKRMNHPSNGVSIIGFLRPVYGEEKSYLRWMYHTEDGDVYISDWRDAEPDILAHSSSEILERFNQFCDDEIKALCKKKGLYGEGAYLVGVDSLGVDVRVLSGAEVKTHRFPFKVQ

SEQ ID NO: 114483 - protein, 484 aa, Glycine max
  Coding DNA Sequence Number=SeqID_22798
  Gene Ontology: Mol. function=binding; Cellular component=cytoplasmic membrane-bound vesicle; Biological process=regulation of transcription, DNA-dependent
  Homolog annotation: Hit_ID=A7PFW4; Match level="QueryCoverage=96%, HitCoverage=24%, E-value=1e-119, Identity=50%"; Hit description =Chromosome chr6 scaffold_15, whole genome shotgun sequence
  Pfam annotation: Domain name=HEAT; Domain location=36-72; Score=19.9; E_value=0.0094; Accession=PF02985.13; Description=HEAT repeat
  Pfam annotation: Domain name=HEAT; Domain location=444-478; Score =3.9; E_value=7.1; Accession=PF02985.13; Description=HEAT repeat
  Pfam module annotation: Pfam domain module=HEAT::HEAT; Domain location=36-72::444-478
MAESSSSSLAKSDSEVEEMLDRMLTRLALCDDSKLEPLLSKLLPLCISSLSSQSVAVRNKVLEILSHVNKRVKLQPQIGLPLSDLWKLYSESAAVPIIRNFCIVYIEMAFQRVNAKEKEDLAPDLLVNISKLPLQHQEIILRIIVKQRSPSVINLQDMTTYGFLLPSSGGFPPGLSVAQVNRVTGKQQLQSNEILLRKLGILNVIQAMELAPELVYPLYIAASVDCEEPVIKRGEELLKKKANGANLDDLNLINRLFLLFNGTVGVEHVDSESRVSPGSPALKAKLMSIFCRSIAAANNFPSTLQCIFGCIYVCGNRLYYQKGEDNQDIENENGQTLKDRNKKRNGTTSRLKQLGMEFTVWVFKHAKIDQLKLMGPVILSGIMKSLDNHPSSEADASAREVKTYAFQAIGLIAQRMPLLFRKVNNVADSPCAFKGDWQLCHLMEKIDIAARLFHALKDESQSLRFVVQEATISLASAYKSWKMY

SEQ ID NO: 114484 - protein, 936 aa, Glycine max
  Coding DNA Sequence Number=SeqID_22799
  Gene Ontology: Mol. function=binding; Cellular component=cytoplasmic membrane-bound vesicle; Biological process=ER-associated protein catabolic process
  Homolog annotation: Hit_ID=A7PFW4; Match level="QueryCoverage=99%, HitCoverage=52%, E-value=0.0, Identity=67%"; Hit description =Chromosome chr6 scaffold_15, whole genome shotgun sequence
  Pfam annotation: Domain name=HEAT; Domain location=131-161; Score =4.0; E_value=6.8; Accession=PF02985.13; Description=HEAT repeat
  Pfam annotation: Domain name=HEAT; Domain location=207-243; Score =9.7; E_value=0.95; Accession=PF02985.13; Description=HEAT repeat
  Pfam annotation: Domain name=HEAT; Domain location=293-329; Score =3.9; E_value=7.2; Accession=PF02985.13; Description=HEAT repeat
  Pfam annotation: Domain name=HEAT; Domain location=420-456; Score =0.4; E_value=24; Accession=PF02985.13; Description=HEAT repeat
  Pfam annotation: Domain name=HEAT; Domain location=559-595; Score =11.6; E_value=0.51; Accession=PF02985.13; Description=HEAT repeat
  Pfam annotation: Domain name=HEAT; Domain location=600-636; Score =9.8; E_value=0.94; Accession=PF02985.13; Description=HEAT repeat
  Pfam annotation: Domain name=HEAT; Domain location=693-730; Score =13.7; E_value=0.24; Accession=PF02985.13; Description=HEAT repeat
  Pfam module annotation: Pfam domain module=HEAT::HEAT::HEAT::HEAT::HEA T::HEAT::HEAT; Domain location=131-161::207-243::293-329::420 -456::559-595::600-636::693-730
MALEGLCLLKSGSEIVGLKYPKLGMMLDYILRQQPKLLESSETREQNLLFPSNTYVAMIKFLLKCFESELEQNKSLEGSSEFISSVKTFCLVLEHSMSFEGSVELHANASKALLIIGSHMPEVVASHFALKVSWLKQLLSHVDWDTRESIARILGIVSSALPIPDVMSELTSLFSQSHKSRFETQHGALCAIGYVTANYLSTTPMPEIFLQDTLRCLVDVVNSETSALAAAAMQALGHIGLRISLPPLDDSNSDGILIMLSDKLSKLLSGDDIKAIQKIVISIGHICVKETSSTELDMALNLIFSLCRSKVEDILFAAGEALSFLWGGVPFNADIILKTNYTSLSMASNFLMGDLTSSVSKQSTNEQSEYSGDYHAAVRDAITKKLFDVLLYSSRKEERCAGTVWLVSLIKYCSNHPTIQQMLPEIQEAFSHLLGEQNELTQELASQGMSIVYDIGDESMKKNLVNALVNTLTGSGKRKRAIKLVEDTEVFTDGALGESASGGKLNTYKELCNLANEMGQPDLIYKFMDLANYQASLNSKRGAAFGFSKIAKQAGVVLKPYLRSLIPRLVRYQYDPDKNVQDAMIHIWKSLVDDSKKTIDENLDLIIDDLLVQCGSRLWRSREASCLALTDIIQGRKFHEVGKHLKRLWSGTFRVMDDIKETVRISGEKLCRAVTSLTTRLCDVSLTDMSDAHKAMDIVLPFLLAEGILSKVDSVRKASIAVVMKLTKHAGTAIRPHMSDLVCCMLESLSSLEDQSLNYVELHAANVGIQSEKLESLRISIAKGSPMWETLDSCIKVVDAESLNTLIPRLAHLVRSGVGLNTRVGVANFITLLLESVGVDIKPYANMLVRLLFPVVKEERSTAAKRAFASACAKVLKYIPASQAQKLIEDTTALHAGDKNSQIACAFLLKSYSSMAADVVGGYHAVIIPVVFLSRS

SEQ ID NO: 114485 - protein, 485 aa, Glycine max
  Coding DNA Sequence Number=SeqID_22800
  Gene Ontology: Mol. function=hydrolase activity, acting on glycosyl bonds; Cellular component=integral to membrane; Biological process =cell wall organization and biogenesis
  Homolog annotation: Hit_ID=A7QN93; Match level="QueryCoverage=60%, HitCoverage=83%, E-value=1e-137, Identity=79%"; Hit description =Chromosome chr2 scaffold_132, whole genome shotgun sequence
  Pfam annotation: Domain name=Glyco_hydro_28; Domain location=3-300; Score=5.4; E_value=2e-09; Accession=PF00295.8; Description=Glycosyl hydrolases family 28
MATGFCVQTIPFLSHTIHIFIGENGTIDGQGDAWWNKWRQGTLQFTRPNLVEFVNSRDIIISNVIFKNSPFWNIHPVYCSNVVVRYVTILAPRDSPNTDGIDPDSSSNVCIEDSYISTGDDLVAVKSGWDEYGIAYGRPSSDITIRRITGSSPFAGIAIGSETSGGVENVLAEHINLYNMGIGIHIKTNTGRGGFIKNITMSHVYMEEARKGIRISGDVGDHPDDKFDANALPLVKGVTIKNVWGMKVLQAGLIQGLRNSPFTDICLYDINLHGVTGPRTPPWKCSDVSGFAHQVSPWPCSELSSNQQGSFVIGALGGPEIVIGALGDPAFGGPEVVIGALGGPAFGGPEVVIGALGCPAFGGPEGVIGGSGSEAVTGALGGPAFGGPEVVIGTLGGPSFGGLEVEIGALGGPAFGGPEVVTGGSGSEAVTSVLGGPAFGDLEVVISTLGGPSFGGPEVEIGALGGPAFGGPEGVTGGSGSEAVA

SEQ ID NO: 114486 - protein, 175 aa, Glycine max
  Coding DNA Sequence Number=SeqID_22801
MIWGEIVYLGGHDNGTGSEIQRHVAGLGVEGASITHAPKLRYGYVVVVIGALGGPEVIIGVLGGPAFGGPEVVIGALGGPEAVTGALGGPAFGGLEGVTGGSGSEAVTSALGGPAFGGPEGVTGGSDSEAVTGALGGPAFGGPEGVTGGSGSEAVTVRTNTTSRGKIAINTFFIL

SEQ ID NO: 114487 - protein, 494 aa, Glycine max
  Coding DNA Sequence Number=SeqID_22802
  Gene Ontology: Mol. function=oxidoreductase activity; Cellular component=nucleus; Biological process=electron transport
  Homolog annotation: Hit_ID=Q8LE44; Match level="QueryCoverage=80%, HitCoverage=93%, E-value=1e-174, Identity=67%"; Hit description =Putative amine oxidase
  Pfam annotation: Domain name=Amino_oxidase; Domain location=38-401; Score=272.2; E_value=1.1e-78; Accession=PF01593.15; Description =Flavin containing amine oxidoreductase
  Pfam annotation: Domain name=DAO; Domain location=30-399; Score= -20.9; E_value=0.00026; Accession=PF01266.15; Description=FAD dependent oxidoreductase
  Pfam annotation: Domain name=FAD_binding_2; Domain location=30-392; Score=-112.9; E_value=0.00068; Accession=PF00890.15; Description=FAD binding domain
  Pfam annotation: Domain name=HI0933_like; Domain location=29-399; Score=-274.9; E_value=0.075; Accession=PF03486.5; Description=HI0933- like protein
  Pfam annotation: Domain name=Pyr_redox_2; Domain location=30-382; Score=-31.9; E_value=0.0055; Accession=PF07992.5; Description =Pyridine nucleotide-disulphide oxidore
  Pfam module annotation: Pfam domain module=Amino_oxidase::DAO::FAD _binding_2::HI0933_like::Pyr_redox_2; Domain location=38-401::30 -399::30-392::29-399::30-382
MCSECKIQRGSFSKSLCCANDDKQQERSPSVIVIGGGMAGIAAARALQDASFQVILLESRERLGGRIHTDYSFGFPVDLGASWLHGVCKENPLAPLIGKLGLPLYRTSEDNSVLYDHDLERLEGLSHKVLQWYLCRMEGWFATDADTISLKCWDQEVLLPGGHGLMVRGYQPVINTLAKGLDIRQGHRVTKIVRQYNEVKVAVENGKTFVADAAIVAVPLGVLKAKSIKFEPKLPDWKEAAISDIGVGIENKIILHFKNVFWPNVEFLGVVAETSYGCSYFLNLHKATGRPVLVYMPAGQLAKDIEKMSDEAAASFAFMQLKKILPDTSSPIQYLVSRWGTDINTLGSYSYDAVGKPHDLYERLRVPVDNLFFAGEATSMLYTGSVHGAYSTGMMAAEDCRMRVLERYGELDLVPPTGRTVGYIHGCMVRASIHPEQYIYHTELIDGVKFAAPDDWSSIAIESDSKKVGNINRNVTDWSELGVIYEGIRLAVIV

SEQ ID NO: 114488 - protein, 370 aa, Glycine max
  Coding DNA Sequence Number=SeqID_22803
  Gene Ontology: Mol. function=transcription regulator activity; Cellular component=nucleus; Biological process=regulation of transcription, DNA-dependent
  Homolog annotation: Hit_ID=A7PJR3; Match level="QueryCoverage=98%, HitCoverage=65%, E-value=2e-44, Identity=34%"; Hit description =Chromosome chr12 scaffold_18, whole genome shotgun sequence
MKNSIPGLDFESDACLTNQRKLIGPDQELVELLWQNGQVVRHNQTHRKPLGNSSNLRQAQKTDHSTLRSSGPYGNSSNLDQEEATPWIQFPLEDPLEQDFCSNLLSELPPTCEFESYKPIKQLEEDKFTNFFASSTPHHPTTSSSKPLPPNMTSSWVQRIQGNPNPMPAPRFHVPDSSQKDNDLGASRKVLNFPHFSTPRNNVSSAPGSTQFREKTTANLSQSEAREYSVITVGSSHCGSSHIPQEKDVSRVSSSAVWATNNNNSLSAEPEAVRDCVQRPICPRSDKGKSEMIEPTVTSSSGGSGSTGIGRTCSLSTRDHGQKRKGTEEEASEEQSEATELKSADGNKASQRTGSSKRNRAAEVHNQSER

SEQ ID NO: 114489 - protein, 308 aa, Glycine max
  Coding DNA Sequence Number=SeqID_22804
  Gene Ontology: Mol. function=molecular_function; Cellular component =cytoplasm; Biological process=biological_process
  Homolog annotation: Hit_ID=A7PJR8; Match level="QueryCoverage=83%, HitCoverage=96%, E-value=4e-91, Identity=68%"; Hit description =Chromosome chr12 scaffold_18, whole genome shotgun sequence
MNTSRKGEECVEEEEGIGGVQLTIASQSLVTIVALLVRFFLSGLSFIGALFMGGVEDEEPSMKRMKLSSKGLVGLSNGSSKEPVGGLSSDLMARPLPSKGDEHVGSKGVIKKEEFVRIIAKALYSLGYGKSGAHLEEESGIPLHSPGVNLFMQQILDGNWDDSVATLYKIGLADESMVRSASFLILEQKFFELLNGEKVMEALKTLRTEIAPLCINSSRIRELSSCLVSASSRLDILRVRSRSKLLEELQKLLPPTVMIPEKRLEHLVEQALILQREACPFHNSLDKEMSLYSDHHCGKDQIPSSTLQ

SEQ ID NO: 114490 - protein, 410 aa, Glycine max
  Coding DNA Sequence Number=SeqID_22805
  Gene Ontology: Mol. function=peptidyl-prolyl cis-trans isomerase activity; Biological process=protein folding
  Homolog annotation: Hit_ID=A7PR19; Match level="QueryCoverage=30%, HitCoverage=43%, E-value=3e-27, Identity=54%"; Hit description =Chromosome chr6 scaffold_25, whole genome shotgun sequence
  Pfam annotation: Domain name=CRT-like; Domain location=62-167; Score=- 55.4; E_value=0.033; Accession=PF08627.1; Description=CRT-like
  Pfam annotation: Domain name=Rotamase; Domain location=281-366; Score= 12.6; E_value=7.4e-05; Accession=PF00639.12; Description=PPIC-type PPIASE domain
  Pfam module annotation: Pfam domain module=CRT-like::Rotamase; Domain location=62-167::281-366
  Subcellular localization annotation: CTP_CleavageSite=9; ConfidenceScore=5.09e-01
MASLCRRLSAAAPAGHFRFHRPAGICAVRYGYSVRRPMRLVAAGTTVGGGAWVTSDDVGGREEKVGPCSYAVEDRRVAEDGGSDAVVGSRNRVVEVAAAAVATVVLGVGNRVLYKLALVPLKHYPFFLAQLATFGYVIVYFAILYIRHHAGIVTDEMLDAPKAPFIVVGLLEALAAATGMAAGVPISIYVFTMPLPYLGVASSLPTGFMAGAIILILGLLIYAWTPSNGSSDSTTPQGTNSGSLLGDGYKKEKEIGRSSSYGTGASGAAEGDRPREILVQHLLVKEDDQKLLLYLQQKISSGEDLSDLAVEYSLCPSKEEGGMLGQFCRFQMVFITALCKVEEAYEVPEFEEAAFTAPLNQVVREESILQDIQPDELHMKIQDPSFLDEAQLIDVREPDEVYAHIFFNHN

SEQ ID NO: 114491 - protein, 770 aa, Glycine max
  Coding DNA Sequence Number=SeqID_22806
  Gene Ontology: Mol. function=hydrolase activity, acting on carbon -nitrogen (but not peptide) bonds; Cellular component=cytoplasm; Biological process=nucleobase, nucleoside, nucleotide and nucleic acid metabolic process
  Homolog annotation: Hit_ID=Q9FMP3; Match level="QueryCoverage=64%, HitCoverage=93%, E-value=0.0, Identity=77%"; Hit description =Dihydropyrimidinase
  Pfam annotation: Domain name=Amidohydro_1; Domain location=102-456; Score=41.4; E_value=3e-09; Accession=PF01979.11; Description =Amidohydrolase family
  Pfam annotation: Domain name=Amidohydro_3; Domain location=102-454; Score=-59.9; E_value=0.0011; Accession=PF07969.2; Description =Amidohydrolase family
  Pfam annotation: Domain name=Las1; Domain location=571-723; Score =199.6; E_value=7.7e-57; Accession=PF04031.4; Description=Las1-like
  Pfam module annotation: Pfam domain module=Amidohydro_1::Amidohydro _3::Las1; Domain location=102-456::102-454::571-723
MVSGCQCRIRYTDLLLFCVDFCSTNLLIPFYVIKELELRFLSFCDAGTEIPSSKLLIKGGTVVNAQHHQIADVYVEDGIIVAVNPNIMVGDDVTVIDATGKYVMPGGIDPHTHLDMDVGFTATVDDFFSGQAAALAGGTTMHIDFVIPLNGSLTAGFEDYEKKAKKSCMDYGFHMVITKWDETVSREMELMVKEKGINSFKFFMAYKGILMINDELLLEGFKKCKSLGAVAMVHAENGDAVYEGQRKMIELGITGPEGHALSRPAVLEGEATARAIRLADFVNTPLYVVHVMSIDAMEEIAKARKAGQRVIGEPIASGLALDESWLWHPDFEIAAKQVPSLVSMYVMSPPIRKRGHDKALQAALSTGVLQLVGTDHCAFNSTQKARGIDDFRKMPNGVNGIEERMHLVWDIMVESGQISVTDYVRITSTECAKIFNIYPRKGAVLPGSDADIIILNPNSSFEMSAKSHHSRLDTNVYEGRRGKGKIEVTIAGGRVVWENNELKVTPGTGRYIQMPPFSYLFDGLDKKDAIYLNSLQAPGGSTFEMEQALLLGFEEDAKMVTESSSSSAHRLVPWLNWDEWLFVKNALFSDSPHSVYSALKRISAWRSRGSLPVLIEVTTSIIEIQLKDPSFRHDQWNDASLSEEMLAMLYCMAIMRLVNGVVEKTRKKEVASIAVAADAIGIPRMLIDIRHEGSHRELPSLKIVRSASVKALGWLKSYYWEPQSKAIPFHGEGIAKVNKEIKSRIRELAICLKVNGSAQSSSSLLKAKRL

SEQ ID NO: 114492 - protein, 493 aa, Glycine max
  Coding DNA Sequence Number=SeqID_22807
  Gene Ontology: Mol. function=nucleic acid binding
  Homolog annotation: Hit_ID=A7PJT1; Match level="QueryCoverage=89%, HitCoverage=87%, E-value=1e-158, Identity=67%"; Hit description =Chromosome chr12 scaffold_18, whole genome shotgun sequence
MERALGHLGPDYGENGIQVCVCILVSVCVGKRKITLITDLLYCFECFPFLRIRRNEPSVKGTIIFDANSTITISPVNFHGLPKYDGCCFCILFVAFTTYESSDIGTPQKKDYFLCAETPGAARAWVSTLHATQLVLKAHKEAVNSLSGNGSTKLGTVATVVAAANSTALECSKEIEAAMQISLRNALGMMNNRTTDGPMDDLTIMKETLRVKDEELQNLSRDLRARDSTIKDIADKLSETAEAAEAAASAAYTMDEHRRIACAEIERLNNDSEKQQELFTQKLKESAEKIVGLSKEREQLIRQRDAAIQEANMWRSELAKAREHDVILEAAVVRAEEKVRVAEANAETRIREAVQRESAALKEKEELLAYVNVLKAQLQRQHIDTTQVFEKTESCSDTKHVDPTEENVDKACLSVSRAIPVPAENVVHMATDQVNIQPVGDNEWSDIQATEARIADVREVAPETDGSSLDIPVVSQPGTNHHHEQGANSFHQP

SEQ ID NO: 114493 - protein, 877 aa, Glycine max
  Coding DNA Sequence Number=SeqID_22808
  Gene Ontology: Mol. function=ubiquitin-protein ligase activity; Cellular component=anaphase-promoting complex; Biological process =ubiquitin-dependent protein catabolic process
  Homolog annotation: Hit_ID=Q67YV2; Match level="QueryCoverage=98%, HitCoverage=99%, E-value=0.0, Identity=57%"; Hit description=MRNA, complete cds, clone: RAFL24-07-B09
MGGILKQPGAFAITPHKVSLCILLKIYAPPAQISVPFPFASVAQHNRLGLFLLALTKSCDDIMEPKLDELIHQLRMMSQNWEASWVIDQLMSRLSSLSSPDDLFNFFSDIRGILGGPDSGAVEDDQVILDMNSNLGIFLRRCVLAFNLLSFEGVSHLLTNLGIYCKEEFSNCPSYEEHGLDDSSSNLETYSEYENMDLENFVYEKVSEEIEARKEASEIVPFHLHTHNTLLSLVDDIDVPADSVSKQSEKVRVASPYGDPSSNMLRDVDHSSPVFLRTNWQVQGYLQEQAHTIEKNGSAVSFNGLEIILRQLQKLAPELHRVHFLSYLNGLSHDDYISALENLHCYFDYSAGTEGFDYIPSVSGNGFGRYEIGLLCLGMMHFHFGHPKLALEVLSEAVRVSQQQQLFVLLRGSLKRAESLKLKRLVASNHLAMAKFDLTMRPAFESVWVYAREVMSTAGCDHVQRPLLSFGPKTSMKLSTCPVNVCKEIRLSSHLISDFSYESSAMTIDGAFSTAWLRNLQKPTGSLVLCQENGSGNSSNASQFIAQPTSIPGSVLQVLGLSYILRATAWELYGSSSDAALAYVKLIQHLAVSKGYKEAFFALKIAEEKFLSVSKSQILLLKLQLLHEHALHRGQLKLAQKLCDELGVLASRVTGVDMELKTEASLRHARTLLAANQFREAAAVAHSLFCMCYKYNLQVENASVLLLLAEIHKKSGNAVLGLPYALASLSFCLSFNLDLLKASATLTLAELWLSLGSSHATRALNLIHGAFPMILGHGGLELRSRAFIVEAKCYLCDSNFNVFENYEIVIDSLRQASEELQLLEFHELAAEAFYLMAMVYDKLGQLEEREEAAASFQKHILALRNPQDEDDPLVSVF

SEQ ID NO: 114494 - protein, 119 aa, Glycine max
  Coding DNA Sequence Number=SeqID_22809
  Subcellular localization annotation: CTP_CleavageSite=33; ConfidenceScore=5.09e-01
MGQSNSHHGIATFRYCWPNIIIRGVSFALVLPSPSMAMKILIASFSSASFPTFPYIMALYDNNDMNLEEIDLEVFEIDAAILRELLEEDQEGKDDKDHGKVECMVESVEENDAHPDMMK

SEQ ID NO: 114495 - protein, 308 aa, Glycine max
  Coding DNA Sequence Number=SeqID_22810
  Gene Ontology: Mol. function=triacylglycerol lipase activity; Biological process=lipid metabolic process
  Homolog annotation: Hit_ID=A7PJU4; Match level="QueryCoverage=88%, HitCoverage=74%, E-value=1e-112, Identity=74%"; Hit description =Chromosome chr12 scaffold_18, whole genome shotgun sequence
MVDFDEVVVFMGQKRRLGVKRSSGAEIDGHTVRKDVNYKRTVIACFIQAVYLLELDRQEKRTQGNALAPNWWIPFKYKLKQTLIDERDGSIFGAILEWDRSAALADLIPIRPSGAPRAVLALRGTLLKSPTMRRDIEDDLRFVAWESLKGSVRFKAALEVLKLICGKYGSNNVCIAGHSLGAGFALQVGKELAKEGTYVEAHLFNPPSVSLAMSLKTIGEKAEFVWNRLKSMLPYIGEAQISNGGLKDASLGVAKWVPYLYVNKGDYICCYYNDGAGTSTKVNVGTTNGQAKLFVVSKEKQKFLEGVV

SEQ ID NO: 114496 - protein, 1045 aa, Glycine max
  Coding DNA Sequence Number=SeqID_22811
  Gene Ontology: Mol. function=transferase activity, transferring glycosyl groups; Biological process=sucrose metabolic process
  Homolog annotation: Hit_ID=A5BA36; Match level="QueryCoverage=99%, HitCoverage=99%, E-value=0.0, Identity=71%"; Hit description =Putative uncharacterized protein
  Pfam annotation: Domain name=Glycos_transf_1; Domain location=470 -635; Score=22.4; E_value=1.2e-05; Accession=PF00534.11; Description =Glycosyl transferases group 1
  Pfam annotation: Domain name=S6PP; Domain location=761-1032; Score= -63.5; E_value=4.5e-06; Accession=PF05116.4; Description=Sucrose-6F -phosphate phosphohydrolase
  Pfam module annotation: Pfam domain module=Glycos_transf_1::S6PP; Domain location=470-635::761-1032
MAGNEWINGYLEAILSTGTGAGTVDEQMQKAVTPPESGHFNPTQYFVEEVVSSVDESDLHRTWIKVVATRNTRERSSRLENMCWRIWHLARKKKQLEGEELQRFANRRWEREQGRRDATEDLSEELSEGEKGDGVGEMIQIETSKKNFQRQISNLEVWSDDKKEKKLYIVLVSLHGLVRGENMELGRDSDTGGQIKYVVELARALAKMPGVYRVDLFTRQISSPEIDWSYGEPTEMLTAGTDEDDDNIGESSGAYIIRIPFGPREKYLQKELLWPHIQEFVDGALAHILNMSKVLGEQVSGGKPVWPHVIHGHYADAGDSAALLSGALNVPMVLTGHSLGRNKLEQLLKQGRQSKEDINSTYKIMRRIEAEELSLDAAELVITSTRQEIDEQWGLYDGFDVKLEKVLRARVRRGVNCHGRFMPRMAVIPPGMDFSNVVTQEDGPEVDGELTQLTRGVDGSSTKALPTIWLEVMRFFTNPHKPMILALSRPDPKKNITTLLKAFGECRPLRELANLTLIMGNRDDIDEMSSGNASVLTTVLKLIDKYDLYGQVAYPKHHNQSDVPEIYRFAAKTKAAAHGLPMVATKNGGPVDIHRALNNGLLVDPHDDIAIADALVKLLSEKNMWHECRKNGWKNIHLFSWPEHCRTYLTRVAACRMRHPQWQTNNPEDDKAVEEEESFNDSLKDEHDMSLRLSIDGDLAAASGGTGLDMQDQVKRILSKIRKTDSGSNGNGGGNINMLLDNVTSTSTSTNTSKYPLLRRRRRLIVIALDLYDNNGAPEKKMIEMVQKIIKAVQLDPQTARVTGFALSTAMPVIETVEFLTSGNVQVNEFDALICSSGSQVYYPGINTEEGKLLPDPDYEVHIDYRWGCEGLKKTIWKLMNGDENSPIEEDLKSSNAHCISYKIKDLSKAKKVDELRQKLRMRGLRCHPMYCRGSSRMHVIPLLASRAQALRYLFVRWRLNVANMYVILGETGDTDYEEMISGTHKTIIMKGVVSKGSEELLRGPGSYQRDDIVPNESPLVASITETTHENIANALKQLSKSGGI

SEQ ID NO: 114497 - protein, 179 aa, Glycine max
  Coding DNA Sequence Number=SeqID_22812
MDSNLEGKNIERCCEIEKENYNSKGLTWVSANDDSSSTKIAAIWNRILLIILIEGIRSMVPDGIWVAVGLAMHQLAPEEIGEFTVVGVVNGIVEAGETVSGLELGFRNGDVEMVGVVGTKFGMVVMGVVVRDKGEGLRKQKWGVVRESVGGCKQEKEQKGGEKVTKKVENEVKEELFGI

SEQ ID NO: 114498 - protein, 116 aa, Glycine max
  Coding DNA Sequence Number=SeqID_22813
EEANEVYGDSSLPLTDVASEETVETSVLKSDENDQVAPTIIEKSLDFEPTLDEIEEPSGGQEESSYESAKQSFQPSPSVPDAESTENPNIVPVAQRENTSWKSCCGLFEIMRGGDR

SEQ ID NO: 114499 - protein, 835 aa, Glycine max
  Coding DNA Sequence Number=SeqID_22814
  Gene Ontology: Mol. function=nucleotide binding; Cellular component =intracellular; Biological process=signal transduction
  Homolog annotation: Hit_ID=A7PR14; Match level="QueryCoverage=96%, HitCoverage=94%, E-value=0.0, Identity=69%"; Hit description =Chromosome chr6 scaffold_25, whole genome shotgun sequence
  Pfam annotation: Domain name=RhoGAP; Domain location=150-297; Score =152.2; E_value=1.4e-42; Accession=PF00620.18; Description=RhoGAP domain
MTVLHCHPITIQPLWNRLEVLEEAVSALPQRGGEVNLTLGGIDLNNSGSVVVREDKKLLTVLFPDGRDGRAFTLKAETSEDLLEWKTALEQALAQAPSAALVMGHNGIFRSDASDSIEGSFHQWRDKRPIKSLVVGRPILLALEDIDGGPSFLEKALQFLEKYGTKVEGILRQSADVEEVDRRVQEYEQGKTEFGPEEDAHVVGDCVKHVLRELPSSPVPASCCTALLEAYKIDRKEARINAMRCAILETFPEPNRRLLQRILKMMHTIGSHSQENRMTPSAIAACMAPLLLRPLLAGECELEDEFDASGDSSAQLLAAANAANNAQAIITTLLEEYENIFDEENIQRCSMSADSQVENSGSEDSTDDDNIDVKENGYHDAENEVDQETDDDADRIQSGKLSESSGYAGSDLYDYKAFGGDDSDVGSSSSNHAKTENANLNAVPDTPLSEDQNKQRKGSENPVDENDASNLLPSTESYRSMGEILSSMDPGNHLPMPVIESGSGKQTSKASSASFSSKRSTFWGRSNPRKTPSVESVDSSGEEELAIQRLEIAKSDLQLRIAKEARGNAILQASLERRKQALHERRLALEQDVSRLQEQLQAERDLRAALEVGLSMSSGQLSSSRGMDSKTKAELEEIALAEADVARLKQKVAELHHQLNQQRQHHYGSLTDVGDRYQHAQNHPQQRFLQQDFDSTLAFVNHERKQRTEESLLGTDWRNIKGQVLASGRQPSRKQFLESSPSDSKSTEASTSMSVDDLGALDSASVPSTSRAAEVGEYARHPSVASSTLVELTTRLDFFKERRSQLMEQLHNLDLNYGSTTSQDFVYKPSSPSWS

SEQ ID NO: 114500 - protein, 37 aa, Glycine max
  Coding DNA Sequence Number=SeqID_22815
MQWIHINLAVKGGCGNCLKRNIAVTITASIIAGAPST

SEQ ID NO: 114501 - protein, 444 aa, Glycine max
  Coding DNA Sequence Number=SeqID_22816
  Gene Ontology: Mol. function=transferase activity, transferring hexosyl groups; Cellular component=Golgi apparatus; Biological process=carbohydrate biosynthetic process
  Homolog annotation: Hit_ID=A7PJY2; Match level="QueryCoverage=99%, HitCoverage=83%, E-value=1e-167, Identity=64%"; Hit description =Chromosome chr12 scaffold_18, whole genome shotgun sequence
  Pfam annotation: Domain name=Glyco_transf_8; Domain location=83-418; Score=264.6; E_value=2.1e-76; Accession=PF01501.11; Description =Glycosyl transferase family 8
MKKLRDELTRALIEANDGNANEGGAMSFNELVKVLALKQDLKAFAFKTKAMLSQMEREVQSARKKESLNWHIASHGVPQSLHCLCLKLAEEYAVNAMARSRLPSPEHVSRLVDPTFHHIVLLTDNVLAASVVVTSTVENSANPGRLVFHVVTDKKTYTPMHTWFAINSINSAVVQVRGLHHCDWSKEVNAGVKEMQETNQLIWKHYYNNYKEKELDHSEEHDRYFEALRPSSLSLLNHLRIYIPELFPDLNKVVLLDDDVVVQHDISSLWELDLNGKVSGSVFKSWCENSCCPGNKYVNFLNFSHPIISSNFDGDKCAWLFGVNIFDLEAWRRSDITKTYHQWLKLNVQSGLTLWNPGVLPPALIAFAGQVHPIDSSWFVTDLGYRHRSEEISNSIERVEAAAVVHFNGPAKPWLEIGLPEVRTLWTRYVNFSDKFISKCRIIL

SEQ ID NO: 114502 - protein, 63 aa, Glycine max
  Coding DNA Sequence Number=SeqID_22817
  Gene Ontology: Mol. function=aspartic-type endopeptidase activity; Cellular component=chromatin; Biological process=chromatin assembly or disassembly
MTIHSQRLRSRFSVTNGMSRGEKVNKTAESSSERGLHNKLADFEELGRGKREKKPSWKITESH

SEQ ID NO: 114503 - protein, 229 aa, Glycine max
  Coding DNA Sequence Number=SeqID_22818
  Gene Ontology: Mol. function=L-ascorbic acid binding; Cellular component=cytoplasm
  Homolog annotation: Hit_ID=A7Q0A0; Match level="QueryCoverage=80%, HitCoverage=80%, E-value=3e-47, Identity=49%"; Hit description =Chromosome chr7 scaffold_42, whole genome shotgun sequence
  Pfam annotation: Domain name=2OG-FeII_Oxy; Domain location=123-225; Score=13.7; E_value=0.0069; Accession=PF03171.11; Description=2OG -Fe(II) oxygenase superfamily
MRVAEEEKAVLEQVFGSSSSEECDSDGYSESESEWEPISEVNGLWLCPHFLSPRRQSHILSSIQADNWFPSPSINQAMRFGLQHLPSWATPLAHSIRRSVQAQAQAQTHPPPFPLHLLHREPLFDQMIANVYQPGEGICAHVDLLRFDDGIAILSLESSCVMHFTPLSGSLSVPVLLTPGSLILMSGEARYRWKHEINRAPEFQIWRAQPLTQSKRTSITLRKLCPSSP

SEQ ID NO: 114504 - protein, 566 aa, Glycine max
  Coding DNA Sequence Number=SeqID_22819
MVAATFDGFSIRDYTSKMRSIDVFKCWPFASTSSRDVSDEEVQSWLPPMNPCPRSDDSTDHRAQNLEIPPSAAETDEDDGDVDCSEEESAESMESEKSAPPSDSSPANNNNNNEDEKLEMVCPVCREFNAATLTAVNAHIDGCLAQTMREERRHMRIMNLKSSSSKSKPSKPLKKRSIAEIFMVEEQPHLPQPQPQPQLPPQIESVLKFWPFREGKVDDVSITVTKFEWLSRRLEALRSTRVDGESAKSDQGDISEEKMEMLCPVCRDFNAATVTAVNAHIDGCLAQAVREERRQMRRSTGNCKPIPKTPKKRSRSIAEILTVAPPIEAGKRKAIQVEEEDEEKSDYGYSGGDSTRAATPAPSAAVATPVASVIKNKKSTMKNRNKKKLMKVKKKKSKVEKHGDSGVWFVNNEKKTVASKKKKKKKKNVFNNRPTGNKRNTRQVKVGKGELQERKTKTSAFVRGRDSEGSEACKNVAPAVVCAVCIISTSTLARRGHSWVTSFSDVERFYTQLTAGCILASGRSVSGDNFECLLEPNLGGLYRTNGNRKTMSVCGYAGRNLKVEVN

SEQ ID NO: 114505 - protein, 131 aa, Glycine max
  Coding DNA Sequence Number=SeqID_22820
  Gene Ontology: Mol. function=transporter activity; Cellular component= integral to membrane; Biological process=transport
  Homolog annotation: Hit_ID=A5GXP4; Match level="QueryCoverage=43%, HitCoverage=15%, E-value=1e-16, Identity=77%"; Hit description =Plastid glucose-6-phosphate/phosphate translocator
MSLDEISPLTFSIGNTMKRISVIVSSIIIFHTPVQPINALGAAIAIFGTFLYSQVEEPTLSTTTVQTVLGLYFKRCSVEQFDFFAVEGLEISRKRLVVRKQISRVEELRIIPELLYMWSYKVTDKEVSFGM

SEQ ID NO: 114506 - protein, 463 aa, Glycine max
  Coding DNA Sequence Number=SeqID_22821
  Gene Ontology: Mol. function=calcium ion binding
  Homolog annotation: Hit_ID=A7P296; Match level="QueryCoverage=65%, HitCoverage=77%, E-value=4e-51, Identity=40%"; Hit description =Chromosome chr19 scaffold_4, whole genome shotgun sequence
  Pfam annotation: Domain name=F-box; Domain location=1-47; Score=27.1; E_value=6.4e-05; Accession=PF00646.24; Description=F-box domain
  Pfam annotation: Domain name=FBD; Domain location=378-428; Score =44.7; E_value=3.2e-10; Accession=PF08387.1; Description=FBD
  Pfam module annotation: Pfam domain module=F-box::FBD; Domain location=1-47::378-428
MSINSLPIELLITIVSLLPFKEAVRTSVLSKKWLELNVCKFTKNIEFDELFFVKPDQPNETREIQRRTFLDFINLWIENYKGTLVEKFSFRLSNPRNGGEIIDQCVAFATECEVKELELDFADPNWNENNIYYGNYEEALFKLPARVYQHGSLESLKLYSCSFVETEVLNFHALKEVSLGWMEVRLSAIKALLSNCNMLESLSFKRCWNSDKFDLGEEEHTGLRKLVLDKCRFEFDVFKVNAPDLKIFQYCGLMNFFITEIHSPAMEEANIDFSPEYGFEGLGHPLYNLVENLFIVRVLTVCSFVLQVIPTGPELLGFQSGMLVQHLILKTALHKNEFLGITFFLNSCTMLECLTIDLCSEKDLFDYEAPFVFNRKRFWSDNVGVYESLSLSLEVVEINGFSGTENELLVLMYFIANGDMLKRISINMLEDDSGRTMEPQIRENAEFLLTVPRASTNLEISIC

SEQ ID NO: 114507 - protein, 96 aa, Glycine max
  Coding DNA Sequence Number=SeqID_22822
  Gene Ontology: Mol. function=DNA-directed DNA polymerase activity; Cellular component=intracellular; Biological process=DNA replication
  Homolog annotation: Hit_ID=A7P230; Match level="QueryCoverage=87%, HitCoverage=9%, E-value=4e-37, Identity=88%"; Hit description =Chromosome chr19 scaffold_4, whole genome shotgun sequence
MVVVVDLGGEIQQGSAADVAMCAMLQISKNKRLKELGWKLLLQVHDEVILEGPTESAEVAKSIVIECMSKPFNGKNILKVDLSVDAKCAQNWYSGK

SEQ ID NO: 114508 - protein, 836 aa, Glycine max
  Coding DNA Sequence Number=SeqID_22823
  Gene Ontology: Mol. function=binding; Cellular component=nucleus; Biological process=ribosome biogenesis and assembly
  Homolog annotation: Hit_ID=A7Q575; Match level="QueryCoverage=86%, HitCoverage=31%, E-value=1e-120, Identity=50%"; Hit description =Chromosome undetermined scaffold_52, whole genome shotgun sequence
  Pfam annotation: Domain name=BP28CT; Domain location=613-784; Score =170.8; E_value=3.5e-48; Accession=PF08146.3; Description=BP28CT (NUC211) domain
HLLLGPLFKLLSKVFSEEWVNGAFSPVIRVFAGEVLEHMLDILEVIGQAAVTQIDSHSKHVFEDLISAIVPCWLAQTDDVEKLLKIFMDILPEIVEHRRLSFVLYLLRTLGEGKSLASLLILLFRSLISRKAACFLYVETHALTFYTEEWEYKFAVQICEQYTSTIWLPSLVMLLEQRGNSDVDQALFLELFIVMQFSLQKLQDPEFVFKLKSGEDTTVIQLLFLPDPCPIMANRYIQFHAEMFLVLVFNVEMLFLVSYCDSNGISVMNIFIIKINVIASSIFQRALGELMEHVVLLLQLVDAWKKQLNFPVILRRELKETMRAVVRNLTTVMIPAGYFKSIIKLLHHADKNVGKKALGLLCEASRNHKNVSLKLKDNKGSRSTPSFLLLHMNETSQESLNKLCLEIMRVLDDSSNTSLKVAAVSALEVLAERFPSNNSIFSLCLGSVTRHIASHNLAVTSSCLKTTAALINVLGPKSLAELPKIMDNVMKSSRRVLADMKPETIDVLSASNESHFYVLITLEAVVDKLGGFLNPYLTNIMELLVLYPEYVSGVDVKVESRAHGIRKLLAEKIPVRLALPPLLKLYPASIEAGDKSLTIVFDMLGTIIGTMDRSSIVAFHGKIFDLCLVALDLRRQSPPSVQNIDVVEKGVLNAMTVLTLKLTESMFKPLLIKSIEWAESEVDETASSGSIDRAISFYGMVNKLTESHRSLFVPYFKHLLGSCVHHLSDGGDVKVSRVNRKKKARILDDGNIKEIGSVSIKGWHLRALVLSSLHKCFLYDTGTLKFLDCSNFQASEFFYIIRTLICFIYLYPIPKLLNTSLIRVCEVSSLFKGVKI

SEQ ID NO: 114509 - protein, 37 aa, Glycine max
  Coding DNA Sequence Number=SeqID_22824
MTEGYRKVLLQVPQPDNRYVSLDLVNIADGWVDFPDI

SEQ ID NO: 114510 - protein, 182 aa, Glycine max
  Coding DNA Sequence Number=SeqID_22825
MVAKWRGGDGIGWWHNAEVVNDGNGCMIVVRGLSIRGGLDQISFPRNQMNKCNHKYGVVAFAESSKGKATWLRDPDQDVDIISVHHASGLICEINLSNPLSTSDDLRFLGTFHVFSVTGFYNNNLSASSSPNNNSIPYSSSAIQFTRGSPPKLFEGLIGGKLIGVEPVQVMASIVKKRTCST

SEQ ID NO: 114511 - protein, 192 aa, Glycine max
  Coding DNA Sequence Number=SeqID_22826
MEVGSVRQVVVEVVLEARRPALWLWLWHNRALGSERSEILPQQLPWGPIGVQDESSFGKDDEGVKDVVDGLCVKSDNMPPHLTVLQSTVLWVVDYPVPLPPLELFVKFIEHACRELHIPLRRNPMWIPLLEWALLGVSMRPSEKIGAHLAPSLEASGLSATVSLSASYSLSDFIHLYECATRFARLAMLFNC

SEQ ID NO: 114512 - protein, 119 aa, Glycine max
  Coding DNA Sequence Number=SeqID_22827
  Gene Ontology: Mol. function=protein serine/threonine kinase activity; Biological process=protein amino acid phosphorylation
  Homolog annotation: Hit_ID=A7NVJ2; Match level="QueryCoverage=44%, HitCoverage=7%, E-value=6e-13, Identity=69%"; Hit description =Chromosome chr18 scaffold_1, whole genome shotgun sequence
MATARWALKHPVYGIVILRTTFLNEKLYTVPEFQQTLLTTMKQKKGGDPDVIKWARLEVNALEAPEMLDDEACPPSNLQSHLNLALLDVEDDSLSMCSLAPKRLVGGLPQRPVEPLIKL

SEQ ID NO: 114513 - protein, 123 aa, Glycine max
  Coding DNA Sequence Number=SeqID_22828
MAYERGGDFLEDARKILNREAFPPGGSLVRSPVPAFRFTGVIPLLWPRLSHSTPDTQFRVGSSLQAGLYARTPRSVRPLRLIRHAPGKAKLKGQVLVTALLQASYLGSRVGSSEEPSKNRPAR

SEQ ID NO: 114514 - protein, 66 aa, Glycine max
  Coding DNA Sequence Number=SeqID_22829
VRHDFAIPNGENARNWVANVVLKFHDDPTVNESEIIVFLRQVLWAAGKRKGFERRRRKTKMRGKEG

SEQ ID NO: 114515 - protein, 192 aa, Glycine max
  Coding DNA Sequence Number=SeqID_22830
  Gene Ontology: Mol. function=sequence-specific DNA binding; Cellular component=intracellular; Biological process=regulation of transcription, DNA-dependent
  Homolog annotation: Hit_ID=A4WA37; Match level="QueryCoverage=59%, HitCoverage=95%, E-value=2e-57, Identity=94%"; Hit description =Transcriptional regulator, AraC family
  Pfam annotation: Domain name=HTH_AraC; Domain location=136-180; Score= 37.9; E_value=3.6e-08; Accession=PF00165.14; Description=Bacterial regulatory helix-turn-helix proteins, araC family
  Pfam annotation: Domain name=HTH_AraC; Domain location=84-130; Score =40.4; E_value=6.4e-09; Accession=PF00165.14; Description=Bacterial regulatory helix-turn-helix proteins, araC family
  Pfam module annotation: Pfam domain module=HTH_AraC::HTH_AraC; Domain location=136-180::84-130
PPGKTRQEAPRHFLCPGWLKAICVVHRHKTVTVANTLFAAIVGRRLTKCKNNCCTLCAIRSDVKKARFRLRGGNPMNTGAFMHDLLDWIDNNLDSRLDIESVARRSGYSKWHLQRLFKEHTGYPLAGYIRAQKLQKSVERLTHSDEPILNVAIALGFDSQQSFNRSFKRQYGQAPGAWRRSVACRETQQAHT

SEQ ID NO: 114516 - protein, 128 aa, Glycine max
  Coding DNA Sequence Number=SeqID_22831
FTLYASGSYNAQWNAPGLLHDKHTLRSSRILRKMEVDEPWLGLFAAKFLFVGVFLVCAKGGLRHWNNDTVGFGGKLGRIGMAVTAWVSPSFSPSHLPQFLSRPSRMINLPLFGPTSILSLAKTKSAKL

SEQ ID NO: 114517 - protein, 88 aa, Glycine max
  Coding DNA Sequence Number=SeqID_22832
MSHYSTSVNGKGTSHKDPLSRILDELSSLNSHNSCKSLSEELRDYYEGRHRSHLRPHSHRREKERKPQEANINLSYFHGKDNVEANLD

SEQ ID NO: 114518 - protein, 64 aa, Glycine max
  Coding DNA Sequence Number=SeqID_22833
MITYGGAITCATGGLDELYMSLLDPWMDDEKLLNMDDGDEAGRYKSNQQQGQWRTHPGNQFNKD

SEQ ID NO: 114519 - protein, 268 aa, Glycine max
  Coding DNA Sequence Number=SeqID_22834
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFGILMYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114520 - protein, 89 aa, Glycine max
  Coding DNA Sequence Number=SeqID_22835
MATRCYGRAYSNFRPYTCCYYGMNIHGSIMELPFYSFTSSYVNGKIVASIFPTAIQGLYDVSSRRMWDLFALAFGSHVLLRQMLVKKHL

SEQ ID NO: 114521 - protein, 152 aa, Glycine max
  Coding DNA Sequence Number=SeqID_22836
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MPALDAQAAAIGALYNLAEVNMDCRLKIANERCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114522 - protein, 68 aa, Glycine max
  Coding DNA Sequence Number=SeqID_22837
MDKVDIFVPHPLTNACLLIQLSPECGCKPLVCLLKQPALLSVDFQDRSIRDYSSCTGCRKTTSKVQNK

SEQ ID NO: 114523 - protein, 113 aa, Glycine max
  Coding DNA Sequence Number=SeqID_22838
MIMRGQDIYSSQDEATTSPSSSESEEAKGEESSEEIYPQEEGQPLMVKEKCKETLVSIATPLGLEFIPQVKELLDESLEGIGHILDLTPIGEKRKESLKRLTLTSHTSMGRKM

SEQ ID NO: 114524 - protein, 46 aa, Glycine max
  Coding DNA Sequence Number=SeqID_22839
MESLKMFGEDIEEDADIPLILGHPFMSTASYVVDMGKKILQMGIED

SEQ ID NO: 114525 - protein, 64 aa, Glycine max
  Coding DNA Sequence Number=SeqID_22840
MPQHNSSHSHYMQRPPQPAAFNSTLGNRLHPLVIDYQKPSWLPDLVFKPGNRLHPLVIDYQRPS

SEQ ID NO: 114526 - protein, 147 aa, Glycine max
  Coding DNA Sequence Number=SeqID_22841
MPISPCRCIGIAPKRRPVDPKKSNRALGFLALVTSLCQSYRVPFPPARSCHRDIGKGHARKTLGGHEEVRQVLELPALITGLCQFYGVPVAPSKVISPPTNRAFIKKYCAPRQAQGETPQQPGDGQQRATDAPPSPLEFTSAHPQKG

SEQ ID NO: 114527 - protein, 47 aa, Glycine max
  Coding DNA Sequence Number=SeqID_22842
ANGREPLAFPCERFQRAKSQGYTKSPQGVENSVEERHVGQVASDILR

SEQ ID NO: 114528 - protein, 147 aa, Glycine max
  Coding DNA Sequence Number=SeqID_22843
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPGGSSCALLFCLSVTGVIPLLWARLSHSTPDNSVP

SEQ ID NO: 114529 - protein, 175 aa, Glycine max
  Coding DNA Sequence Number=SeqID_22844
MTGDSSKFTQVSPKKSGHVTYGDNNKDSKGKGKGSNEDPLEEAKSNYELPKELDIRRLELQKETNQEEKIRRRREYALKAHLHPEESDHRRSIDLDEDEDLSFIKDVTKCFSKWLNQRRQYMLNFNLQRKIFLEKSTLLKEKDIGDKKAKKACITWDYNDLESSDDSEKEWLIYV

SEQ ID NO: 114530 - protein, 153 aa, Glycine max
  Coding DNA Sequence Number=SeqID_22845
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=55%"; Hit description =Putative uncharacterized protein
  Subcellular localization annotation: CTP_CleavageSite=25; ConfidenceScore=5.49e-01
MTMITPSSKLTLTKGNKSWYRAPPRGRRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114531 - protein, 92 aa, Glycine max
  Coding DNA Sequence Number=SeqID_22846
MASGVDKRANTYYAPFIIQEQQAKFCALYHSDFASWVINAQRQILHPLSFRTPFHYPEVIVSNKTRRQIMVILRLVSTERNKFDSIGMMCRY

SEQ ID NO: 114532 - protein, 154 aa, Glycine max
  Coding DNA Sequence Number=SeqID_22847
  Gene Ontology: Mol. function=oxidoreductase activity, acting on the aldehyde or oxo group of donors, disulfide as acceptor; Biological process=metabolic process
  Homolog annotation: Hit_ID=P0AFG5; Match level="QueryCoverage=84%, HitCoverage=13%, E-value=7e-72, Identity=99%"; Hit description=2 -oxoglutarate dehydrogenase E1 component
MQNSALKAWLDSSYLSGANQSWIEQLYEDFLTDPDSVDANWRSTFQQLPGTGVKPDQFHSQTREYFRRLAKDASRYSSTISDPDTNVKQVKVLQLINAYRFRGHQHANLDPLGLWQQDKVADLDPSFHDIEFLQPGGSTSSRAAATAVELQFAL

SEQ ID NO: 114533 - protein, 45 aa, Glycine max
  Coding DNA Sequence Number=SeqID_22848
MVEVSTEAIASIAQYSSTVDLRRSPLSECGWVGGPSSDRRFSCLS

SEQ ID NO: 114534 - protein, 130 aa, Glycine max
  Coding DNA Sequence Number=SeqID_22849
MPSRFRADRVWPGRISQCFTSAGTVSEEEVAAIEEEFPQDPPSFVQPCHPDSQVGNWRVISQSEVYTANSIYEGRFFEDPNNEGLTIDFNRDISQTVNEEEEEDVLSPELERLVAQEEREMNPHQEETEL

SEQ ID NO: 114535 - protein, 78 aa, Glycine max
  Coding DNA Sequence Number=SeqID_22850
MEAWKPAKRDKNKTGKAGNKGKKMKELLLLETVQLNSCFLNGKGSDDVKSLNVNSCGSNRTLSPKWVNFFYEVFALMD

SEQ ID NO: 114536 - protein, 53 aa, Glycine max
  Coding DNA Sequence Number=SeqID_22851
MKKIQGLQAPHGATSCVSYMMPMKKLSCGAELSLHFVGSSGLRIIKKGGGRLN

SEQ ID NO: 114537 - protein, 570 aa, Glycine max
  Coding DNA Sequence Number=SeqID_22852
  Gene Ontology: Mol. function=phosphatidylglycerol-membrane -oligosaccharide glycerophosphotransferase activity; Cellular component=integral to membrane; Biological process=glucan biosynthetic process
  Homolog annotation: Hit_ID=A7MG94; Match level="QueryCoverage=83%, HitCoverage=62%, E-value=0.0, Identity=62%"; Hit description =Putative uncharacterized protein
MYGSQELKSRVADPSYRNNWGFYDDTVMDEVFEKYEELSRQQKRFALFTLTVDTHHPDGFISRSCQRKSYSYDGKPNQSFSAVACSQEHVARLIARIKASPWFKNTVIVVSSDHLAMNNTAHQYLIKQPRRDLFMVIRGDQPQAEVLDGKRSTLDNGATVLDILGGDNAIGLGRSGLSSASLSSQFDDMAKKVTAWKADIIQLWNFPSQMKTFTIDQPKNTFSFSGATFRLPILFRVSDHQVEPLPEGEYAAPLRFQLADFAASDKFVWVDRCFKMGRLWQPALALSTDLCLAMGQTGGQPTVTRIDQPVWQGKAQFPQVKVSAATYQLNEQQMRIEDNAIRYQADSFLLTVPGAPASVKRFSGISRPESWGRWSNANLAPEVNIEYVDPLPARFDVVITARAYGANAYRPIPVRVGEQVQQLNLGDAFSTQTLHFTNPGASRNLIITPPEPQLSNLGNITGQDPRKLGIGMAEIKIIPQPEKQQERRPGATGMIPTMMNTHKAFKALQQAGVADHQAEVMVDIFAEMQQENSLTKTHLSQAMEGVMRANHATAQRVDKLAQSLRHFENE

SEQ ID NO: 114538 - protein, 70 aa, Glycine max
  Coding DNA Sequence Number=SeqID_22853
MARSLFAPCPYLRDLYGRELTRLLVITPKVVISLLMVSRGIIPFEEHTAAVGTTSNNMFSKRKTLDEGSL

SEQ ID NO: 114539 - protein, 159 aa, Glycine max
  Coding DNA Sequence Number=SeqID_22854
MAGGEDLAHQHRRAAGDKGHQESIAAAAVEHAETPAGQPHHQHHQPARVVLGEDHDMLHFGHHLHIDAAIDVLAGGGQAGAVAEGGQHHRIGGDRAFHAVHPQRQPHAGRQLFHHRALGAVLQQQQRALNAQAGDFTLLPVRLRPVCGVSLLHGAPLLA

SEQ ID NO: 114540 - protein, 42 aa, Glycine max
  Coding DNA Sequence Number=SeqID_22855
MEIKRVVKDDKDEQIKLNTTRESYYCTLKQMNEYLFPYPSLS

SEQ ID NO: 114541 - protein, 89 aa, Glycine max
  Coding DNA Sequence Number=SeqID_22856
MSVSYLLLKIYVLILPELDAPLSVERPSFDGLEALLVLGAPETVAIKLGGGTGPFSRSVSPRPLRRKLFRSNFLQGQTFGKLIYKEMLF

SEQ ID NO: 114542 - protein, 197 aa, Glycine max
  Coding DNA Sequence Number=SeqID_22857
  Gene Ontology: Mol. function=helicase activity; Biological process =viral genome replication
  Homolog annotation: Hit_ID=Q2R1R7; Match level="QueryCoverage=72%, HitCoverage=11%, E-value=2e-30, Identity=40%"; Hit description=AT hook motif-containing protein, putative
MMFAFTSAGIKFDKSINHSRGPPTIRIQGQPCHRIGSMLPMPGKEPKFAQLYIFDTENEVQNRINAISSPHNQIQEHIVSQLSEMLDEYNMHAKTFRMTRDRLQDVQHGQLQRIHELHSSYLALQYPLLFPYGEDGYRPDILHSSRSDGDYSNNLLFMAILWLSQKGFLTSETTKKNFELTSFVAYNSHWMMEVREA

SEQ ID NO: 114543 - protein, 312 aa, Glycine max
  Coding DNA Sequence Number=SeqID_22858
  Gene Ontology: Mol. function=motor activity; Cellular component=cell projection
  Homolog annotation: Hit_ID=UPI00006A16D8; Match level="QueryCoverage =89%, HitCoverage=84%, E-value=2e-17, Identity=27%"; Hit description =UPI00006A16D8 related cluster
HVLAIRGLHTLPFRGLHVLAIRGLHALTFKRQHVLTIRGLHALSFRGLHVLAIEGLHALTFQGLHLFAIRGLHVLACRGLHVLAIRGLHALTSRGLHVNAIRGLHAFALRGLHVLAIRVLHALTFRGLHILAIRGLHALSFRGLHVLAIEVLHALTFRGLHVLAIRGLHILACRGLHVLDCRGVDVLAIGRLHALTFRGLYVQAIKGLHAFALRGLHVLAVRGLHALTIRGLHVLPIRGLHAVSFRGQHILAIGGLEALTFRGQHVLAIRGLHTLAFRGLHVFSIRGLHALTIRDYTSSPAEGCTPSPLEDY

SEQ ID NO: 114544 - protein, 167 aa, Glycine max
  Coding DNA Sequence Number=SeqID_22859
  Subcellular localization annotation: CTP_CleavageSite=49; ConfidenceScore=5.00e-01
MPISPAEVSVGLCRHDIGKDRARKTPSGPRGAQQGPGVSSSSYGPLSVLQGARPSLQGIAPARHPVDPEKSNRVLGFPALITGLCQFYGVPIAPSKVIKPPTNRAFIKKYCAPRKAHGETPQQPREGRQRATDAPPPPLKPLSSSTKARALPTTRGRPAGDQVQSQR

SEQ ID NO: 114545 - protein, 71 aa, Glycine max
  Coding DNA Sequence Number=SeqID_22860
MEAITNGMMNLNRQRHQHLVALRIIFAHETAGNRRRYVHCQSDVNGAVSEIAQEDTVNKGSERAAAKPFFP

SEQ ID NO: 114546 - protein, 177 aa, Glycine max
  Coding DNA Sequence Number=SeqID_22861
MKVDLSTLKDQMAFITEAMLKLQKTIEDNATAAASNKAREAEPVLQPTINLDRDRSATGFNQRYSPQAYPYGLPPDFTPRTAPDDLSQAPTFEGQLPPHVDYPLQEDDEGDAHLGPLLPLKEPAPHELPQPNIVCHVPSPSAPVKEFVPFAKDKGKIDLLEERQRAVEGLGNYPFSD

SEQ ID NO: 114547 - protein, 91 aa, Glycine max
  Coding DNA Sequence Number=SeqID_22862
GLRPQSKQLLDASAGGQIKLKTPEEAMDLIENIAASDIAILRDRAHIPTRKSLLELTSQDALLAQNKLLSKQLKALTETLSYRMYHLWGSS

SEQ ID NO: 114548 - protein, 195 aa, Glycine max
  Coding DNA Sequence Number=SeqID_22863
  Homolog annotation: Hit_ID=Q6WAY6; Match level="QueryCoverage=68%, HitCoverage=21%, E-value=5e-15, Identity=37%"; Hit description =Putative uncharacterized protein
MTDAWGANTFPVHKYNSRTFHLKFVDHVFSVGGDFACIPFLEHAPTSHASPSHRRVGCDIAILADLYDTFGRRCEKSSTRIVCCTPALYLWLVSHLFHQEVRHACPLEGHHSCIEKGGANWDQLLANKEGASINWFPRWKEGRTGVLILCGGFPNVPLMGMRGCISYNPVLAIRQLGYPMRGAPLEEEIAPVIHE

SEQ ID NO: 114549 - protein, 190 aa, Glycine max
  Coding DNA Sequence Number=SeqID_22864
  Gene Ontology: Mol. function=dihydropteroate synthase activity; Cellular component=mitochondrion; Biological process=folic acid and derivative biosynthetic process
  Homolog annotation: Hit_ID=A6TEJ6; Match level="QueryCoverage=94%, HitCoverage=63%, E-value=1e-91, Identity=93%"; Hit description=7,8 -dihydropteroate synthase
  Pfam annotation: Domain name=Pterin_bind; Domain location=20-187; Score=216.7; E_value=5.5e-62; Accession=PF00809.13; Description =Pterin binding enzyme
MQLHAQGSTLDLSHPHVMGILNVTPDSFSDGGSHNSLIEAVKHANLMINAGATIIDIGGESTRPGAADVSVEEELARVIPVVEAIAQRFEVWISVDTSKAEVIRESARAGAHIINDIRSLTEPGALQAAAQTGLPVCLMHMQGQPKTMQEAPKYDDVFAEVDRFFAEHIVRCEQAGIAKKNCCSTRDSDS

SEQ ID NO: 114550 - protein, 178 aa, Glycine max
  Coding DNA Sequence Number=SeqID_22865
  Homolog annotation: Hit_ID=A5ANU0; Match level="QueryCoverage=73%, HitCoverage=19%, E-value=1e-12, Identity=29%"; Hit description =Putative uncharacterized protein
MGEVRKSDAHERKFNYLAKASEKNESYAKQANKNKKEVVLEPGDKPFQVLEIINDNAYRIGIPGDNSKHLMANAFQEGENDKNPKTIQIQGPMTRSRIKQLGDTLQQMVADILNKAQVEKDEDPEAEALPRILIVAEGQTNLKAYAKYTYQDNPYSVYPGLFSLTGSGLSQNSVIYIK

SEQ ID NO: 114551 - protein, 51 aa, Glycine max
  Coding DNA Sequence Number=SeqID_22866
MAGRNDFAIADALQALAQAIGNPNRGETVGRIKDNCSSINPTGKFNRQLGN

SEQ ID NO: 114552 - protein, 106 aa, Glycine max
  Coding DNA Sequence Number=SeqID_22867
MIMRGQDIYSSQEETTSSPSSSGSEDKVRGEESSEEVYPHEEGGLLMVRKLLAGSDAPHGTSLQGQLDREDLRRRLAKMLREGPRVPSMSLRVDYGLRAKYEPTYL

SEQ ID NO: 114553 - protein, 72 aa, Glycine max
  Coding DNA Sequence Number=SeqID_22868
  Homolog annotation: Hit_ID=P03845; Match level="QueryCoverage=58%, HitCoverage=100%, E-value=9e-12, Identity=76%"; Hit description =Putative uncharacterized protein 1
MDTLAPVFTWANIYARRQGADAAAIQWLLPVVLLHVFPGWTQDDSYRIRRSGRTERGVRAYSPAWSELPTRN

SEQ ID NO: 114554 - protein, 127 aa, Glycine max; identical to SEQ ID NO: 100610
  Coding DNA Sequence Number=SeqID_22869

SEQ ID NO: 114555 - protein, 84 aa, Glycine max
  Coding DNA Sequence Number=SeqID_22870
MWLIPVMIANLVYGSRMTAVGCRDEILLRSRQADVMTLGLFWGEKASFMMMNQVDSSSFDDDKDDDKKTKKMISRLSQQVQDQD

SEQ ID NO: 114556 - protein, 122 aa, Glycine max
  Coding DNA Sequence Number=SeqID_22871
MMSMKKIMEANAVTVATTSTVAKVNPTPPSGLNQMNHPTSDIVGLEGKELGGTGDPHLVRKTSMPSHHMACLPTIHHPMWHTLLVRMSITPFPYSLKANNLNLIMHMSLNPLGRHMKCPTTI

SEQ ID NO: 114557 - protein, 103 aa, Glycine max
  Coding DNA Sequence Number=SeqID_22872
MAYERGGDFLEDARKILNREAFPPGGSLVRSPVPAFRFTGVIPLLWPRLSHSTPDTQFRVGSSLQAGLYARTPRSVRPLRLIRYYRLESNPEGHAKHHLAAAT

SEQ ID NO: 114558 - protein, 113 aa, Glycine max
  Coding DNA Sequence Number=SeqID_22873
  Homolog annotation: Hit_ID=A5BEV8; Match level="QueryCoverage=54%, HitCoverage=8%, E-value=7e-09, Identity=45%"; Hit description =Putative uncharacterized protein
DALPRVIVTDKDLSLMNAVETVFSDATNLLCRFHIEKNMKTKCKTLVAQKNAWDYVMEAWRSLVDCPCKNPSRCGCVMRSTHGLPYQGLCETQVTIIEEMETISKCFEQLDVC

SEQ ID NO: 114559 - protein, 42 aa, Glycine max
  Coding DNA Sequence Number=SeqID_22874
MEKELPLDSAQATEARYRSKMVNLGGLIMFRNKRNNSMVELL

SEQ ID NO: 114560 - protein, 227 aa, Glycine max
  Coding DNA Sequence Number=SeqID_22875
  Gene Ontology: Biological process=transposition, DNA-mediated
  Homolog annotation: Hit_ID=Q6UUU1; Match level="QueryCoverage=31%, HitCoverage=46%, E-value=1e-18, Identity=71%"; Hit description =Putative uncharacterized protein
GFPGINRDTGLFILRSDLPSQWLLFLSAVPPVQLLTGWCVTAKAPPDISAGKCSGHAARRVPFAIQAAQLLGRAIGAGLFAITPAGERGMCCKAIKLGNARKAKELEYYHLDHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 114561 - protein, 168 aa, Glycine max
  Coding DNA Sequence Number=SeqID_22876
MAASDHAILHDRAHIPTKRSLLELSSQDALLAQNKLLSKQLEALTETLSKLPTQLHARQPSPSSVLQVVCCVICGGAHDSGCCIPTKDTTHEVNYMGNQPRPNFNGQWRTHPSNQFNKDQGGPLNRQQQGPSLYDRMMKLEETLAQFMQVSMSNQKSTESAIKNLEVQ

SEQ ID NO: 114562 - protein, 227 aa, Glycine max
  Coding DNA Sequence Number=SeqID_22877
  Homolog annotation: Hit_ID=Q6WAY4; Match level="QueryCoverage=43%, HitCoverage=17%, E-value=3e-10, Identity=35%"; Hit description =Putative uncharacterized protein
MGSSQKPSLKKRFYQVKIKSLEVTSLRELGQLMGQLQRQAFRKAYGKIWDLARVEVSMEPIASLSQYYHQPLRCFTFEDFQLVPTVKEFEEILGCPLGGRKPYLFSGFYPSTTRVAKLSLSEYGRVSGLAAMTLSSLSSWQGKPGRRHLGHKEGRIRILSSCEGCPNVFLMGTRGCINYNPVLAIRQLGYPMRGVPSDESITPFIARGFSDHNARVLQGVRKAWDAA

SEQ ID NO: 114563 - protein, 154 aa, Glycine max
  Coding DNA Sequence Number=SeqID_22878
  Subcellular localization annotation: CTP_CleavageSite=41; ConfidenceScore=5.22e-01
MTQSENSFDSGNRLPFLNQDFKTSSNEFFCFSKVFKTELLSSNLFQNWRCNPDGTSLEGNRYQWVVVTEIKFKQERGNRLLALFNREQGRVTPSNGSLLVQRSNSSQGFLTDRRVYNKDRLGDLDVQKGGLLPNQYTPTLVCNLLILSSSSSHF

SEQ ID NO: 114564 - protein, 150 aa, Glycine max
  Coding DNA Sequence Number=SeqID_22879
MFLQKAVASGGSNLACLGELGGKLLPYFPIKRGRSEGERGSALLARCFRNVSVGDFAKIVNRSSSFVVRSSSFFGLQLALIPSSNVNTTPESGIFFMTGFLRFFRCFPQINVGGDSAHFPPLEDAPVSLASLSRKRVCCDRWRLHWGLFL

SEQ ID NO: 114565 - protein, 247 aa, Glycine max
  Coding DNA Sequence Number=SeqID_22880
  Homolog annotation: Hit_ID=Q2HW90; Match level="QueryCoverage=69%, HitCoverage=34%, E-value=2e-19, Identity=33%"; Hit description =Putative uncharacterized protein
MGSSQKPSLKRGFYQVKSELRVTSYESWGIMGHFNGKPSAKPMYYDQPMRCFTFGNFQLSPMVEEFEEILGCPLGGRKPYLFTRFYPSLARISKIVQILAQELDHRKQVENGVVGIPRKYLEAKARILAGKGEWAPFIDILALLIFGGVLFPNVDGLVDLAAIDVFLAYHNHKEIPVVAMLADLYDTFDRRCEKSSARIVCCALALCVWLVSHLFLQEGRPVYPLQGHCSCVEKRKANWIGPCILAI

SEQ ID NO: 114566 - protein, 146 aa, Glycine max
  Coding DNA Sequence Number=SeqID_22881
  Pfam annotation: Domain name=GRP; Domain location=1-123; Score=23.3; E_value=2.6e-07; Accession=PF07172.2; Description=Glycine rich protein family
MDSKTKVAILIPGMLAILLFISSEVAARDLKEEGVLKETSKVGDAKLVGGGLQGSGRGSPTPVFPGRGIPGRGFPGQGFPGQGFPGQGFPVQGFPFPGQGYPLVPGQGFPGQGFPGQGFPGQGFPGQFRCINGCCYGNARGCLACC

SEQ ID NO: 114567 - protein, 141 aa, Glycine max
  Coding DNA Sequence Number=SeqID_22882
MGYVGVRELSWRWATGDGGFMRALWMWKTCCAPSPDRHLVPHVMEWYLEICRGGQETLGTSGGVLLPKTKLDQSRPNPGVATYPSAGGRRVTCGMRVPRKEYARSRHQRLFEENVGKTGKDAIYELFSERFGSCIYARGRY

SEQ ID NO: 114568 - protein, 241 aa, Glycine max
  Coding DNA Sequence Number=SeqID_22883
  Gene Ontology: Mol. function=peptidase activity
  Homolog annotation: Hit_ID=Q8H6W2; Match level="QueryCoverage=37%, HitCoverage=97%, E-value=1e-15, Identity=47%"; Hit description=Gag -protease polyprotein-like protein
  Pfam annotation: Domain name=zf-CCHC; Domain location=184-201; Score =17.8; E_value=0.003; Accession=PF00098.14; Description=Zinc knuckle
MASSNPLFPEGNSIHRPPIFNGEGYHYWKTRMQIFIEAIDLNIWEAIELGPHIPTIVDVSTSTTTQKPRDKCIEEDRRKIQYDLKAKNIITSALGIDEYFRVSNEHEMELQRLNQNEENDKKKRSIALKASSSIQEENEEGDSDDEEDFSFFVKKFQKYIKKRRIDRRQNFNNGRKSQDDSQVLRCYKCNQIGDIKANCPSNEEWSEKSEKKIFDERRTKKAYIAWMTMIHPMVQKRRLIF

SEQ ID NO: 114569 - protein, 229 aa, Glycine max
  Coding DNA Sequence Number=SeqID_22884
  Gene Ontology: Mol. function=homoserine dehydrogenase activity; Cellular component=chloroplast; Biological process=aspartate family amino acid biosynthetic process
  Homolog annotation: Hit_ID=P00561; Match level="QueryCoverage=100%, HitCoverage=27%, E-value=1e-101, Identity=80%"; Hit description =Bifunctional aspartokinase/homoserine dehydrogenase 1 (Aspartokinase I/homoserine ...
  Homolog annotation: Hit description=dehydrogenase I) (AKI-HDI) [Includes: Aspartokinase (EC 2.7.2.4); Homoserine dehydrogenase (EC 1.1.1.3)]
  Pfam annotation: Domain name=Homoserine_dh; Domain location=23-220; Score=347.6; E_value=2.1e-101; Accession=PF00742.10; Description =Homoserine dehydrogenase
MRAAAAKSRRKFLYDTNVGAGLPVIENLQNLLNAGDELIKFSGILSGSLSFIFGKLDEGVTLSEATRMARELGFTEPDPRDDLSGTDVARKLLILAREAGHQLELSDIDIEPLLPASLTDIADVDQFMARLPELDNAFAARVAKARDEGKVLRFVGAIEEGGACKVKIDAVDGNDPLYKVKNGENALAFYSRYYQPIPLVLRGYGAGNDVTAAGVFADLLRTLTWKLGV

SEQ ID NO: 114570 - protein, 123 aa, Glycine max
  Coding DNA Sequence Number=SeqID_22885
TGAEPGIICMGWILNSGRSWFAGALVDDGDDGTEGEPGAEVSFGGVAMEKQSVWNVVNVLLMLSETFEHVQIAVAAIISLASRQIPAVAPQFFNDLLAIQGSSSQILKYYHSTQVSQYYGQTS

SEQ ID NO: 114571 - protein, 189 aa, Glycine max
  Coding DNA Sequence Number=SeqID_22886
MHKALRSNAPLPYPHLIILFLHHFDVPLDSEPFVQVMRSFSIGVGVVTSFGYRKERDGSWVKKDAPAQAAEDRSPSPPPQRDDSSSLMQIVLDRLDGLYIFVGERFDSLDSRIDAIDARFAGMDTRITQLEEDMSFIWGDCGSNAFQDYFDDAKDSSQESRVKQVLRIKESFNRSKFQESKSRSIKIQD

SEQ ID NO: 114572 - protein, 130 aa, Glycine max
  Coding DNA Sequence Number=SeqID_22887
  Gene Ontology: Mol. function=DNA binding; Cellular component =intracellular; Biological process=regulation of transcription, DNA -dependent
  Homolog annotation: Hit_ID=A0K360; Match level="QueryCoverage=76%, HitCoverage=70%, E-value=7e-33, Identity=66%"; Hit description =Transcriptional regulator, HxlR family
  Pfam annotation: Domain name=DUF24; Domain location=33-121; Score =43.3; E_value=8.7e-10; Accession=PF01638.8; Description =Transcriptional regulator
  Pfam annotation: Domain name=MarR; Domain location=35-105; Score =18.2; E_value=0.00082; Accession=PF01047.13; Description=MarR family
  Pfam annotation: Domain name=PadR; Domain location=32-109; Score= -8.3; E_value=0.012; Accession=PF03551.5; Description=Transcriptional regulator PadR-like family
  Pfam module annotation: Pfam domain module=DUF24::MarR::PadR; Domain location=33-121::35-105::32-109
MTSDREALLQFSQAFCEELSDDDEGLKREVLAHAGNRWSLGVLHILGTHGPLRHGEIGRQLAGVTQRMLTRTLRHLERDGLISRCDYQEKLPRVDYAITDAGKRCCSTCCRSGRDYRLRRCLQGGPLALR

SEQ ID NO: 114573 - protein, 71 aa, Glycine max
  Coding DNA Sequence Number=SeqID_22888
  Gene Ontology: Biological process=transposition, DNA-mediated
  Homolog annotation: Hit_ID=Q1J7G7; Match level="QueryCoverage=46%, HitCoverage=47%, E-value=1e-11, Identity=96%"; Hit description =Transposase
GQGFPVSTGTPGFIYLRSDLPSQVLQWLLFLSAVPPVQLLTGWCVTAKAPPDISAGKCSGHAARNHHTRRA

SEQ ID NO: 114574 - protein, 87 aa, Glycine max
  Coding DNA Sequence Number=SeqID_22889
MGQDNRKRGAVDKSGAFAPTYPQFEMRNLDLRSSSFRYVRITRRCLRILPDSWVMIAKGGAVDKSEAFAPTYPQFVMRNSDLRSSFL

SEQ ID NO: 114575 - protein, 204 aa, Glycine max
  Coding DNA Sequence Number=SeqID_22890
  Homolog annotation: Hit_ID=Q9AVH2; Match level="QueryCoverage=41%, HitCoverage=41%, E-value=2e-39, Identity=70%"; Hit description =Putative senescence-associated protein
  Subcellular localization annotation: CTP_CleavageSite=39; ConfidenceScore=5.01e-01
CARGGSSCHTWQDPRSHAHTHTHTHAGTRGGGAGRPSARAHTREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 114576 - protein, 59 aa, Glycine max
  Coding DNA Sequence Number=SeqID_22891
MLAGNVTIEKPRDQWDEDERKRVQNNLKAQNIITSTLGMDEYIRVSNSKNDKEMWDTLQ

SEQ ID NO: 114577 - protein, 64 aa, Glycine max
  Coding DNA Sequence Number=SeqID_22892
FLQKAVASGGSNPARLGELGGNHLPYFAINRGGRQEGRGEESRKAFNRSSTFFIRSSSFFDLQR

SEQ ID NO: 114578 - protein, 83 aa, Glycine max
  Coding DNA Sequence Number=SeqID_22893
PLGPSEIFLQKAVASGGSNPARLGELGGNHLPYFAINRGGRQEGRAEALPKRFRNVFREEFRKDFNRSSTFFIRSSSFFDLQR

SEQ ID NO: 114579 - protein, 71 aa, Glycine max
  Coding DNA Sequence Number=SeqID_22894
MDPKRIKVIPEWPTPPFVEERIPEFQVTMGLRSNAFQGGGNDAILPPPPGHWIEDFKKIRPEMQEKTLRFS

SEQ ID NO: 114580 - protein, 106 aa, Glycine max
  Coding DNA Sequence Number=SeqID_22895
MGEVEEVQEKMKADMEAMKEQMATMMEAMMIMKIMEANAVAVAATSTVAKAKIWEVRAAPMMCKFKTSRPSRHMAWVGNYTPPNVAYTPNKNVNNSTPIPIESQQP

SEQ ID NO: 114581 - protein, 123 aa, Glycine max
  Coding DNA Sequence Number=SeqID_22896
MSQGSGDLGESGGVLLPNDQVDNPDPNLSGIVNGSICLRKWRQLCCGGLGNRLLIFSGIRLHRVTSHWSNRLPVMSNRSSHIAGFQFRSVNRTQNEENVTGLGGIDGNPVLRGTRIRGYVGST

SEQ ID NO: 114582 - protein, 66 aa, Glycine max
  Coding DNA Sequence Number=SeqID_22897
MTGDASNFTHISPKKSGHVTYGDNNKVRILGRLKNEFWKNPEKKNHSEKETGTLFTHMGENDALNL

SEQ ID NO: 114583 - protein, 114 aa, Glycine max
  Coding DNA Sequence Number=SeqID_22898
MLDWAIEVIWPEIRAPMFMSMRETRPKISLALSTIRSEVCDVGARLEYETKLHTWAKVVKSFLRILHGWPSAFKMNPRPGVSKNVLRLLASIFTRWPLTLAYFGEEPSELYRFA

SEQ ID NO: 114584 - protein, 129 aa, Glycine max
  Coding DNA Sequence Number=SeqID_22899
  Gene Ontology: Mol. function=protein binding; Biological process =defense response to fungus
  Homolog annotation: Hit_ID=Q9SDM7; Match level="QueryCoverage=99%, HitCoverage=30%, E-value=1e-49, Identity=63%"; Hit description =Putative uncharacterized protein
  Pfam annotation: Domain name=LRR_1; Domain location=10-33; Score =15.0; E_value=0.29; Accession=PF00560.24; Description=Leucine Rich Repeat
  Pfam annotation: Domain name=LRR_1; Domain location=101-125; Score =1.3; E_value=1.7e+02; Accession=PF00560.24; Description=Leucine Rich Repeat
  Pfam annotation: Domain name=LRR_1; Domain location=35-58; Score=4.5; E_value=46; Accession=PF00560.24; Description=Leucine Rich Repeat
  Pfam module annotation: Pfam domain module=LRR_1::LRR_1::LRR_1; Domain location=10-33::101-125::35-58
MPVTLGTLSNLVMLDLSSNLLEGSIKESNFVKLLKLKELRLSWTNLFLSVNSGWVPPFQLEYVLLSSFGIGPKFPEWLKRQSSVKVLTMSKAGYIASVSANVEVLNVANNSVPGTFLPFYVGKGNATNN

SEQ ID NO: 114585 - protein, 326 aa, Glycine max
  Coding DNA Sequence Number=SeqID_22900
STLEDPPLWGSNSKLKLRREERDQSRVLGMVLEKELAACSRSKKSLAQHLEATEQSMLAIIGQYKEELNQSLTHEQKLVEDFAQAYAEKEARGRVIDALHQEATMWMDRFALTLNGSQDLPRLLAKARAMVKMKADMSALKDQMASITEAMLKIRKSIEDNATAAASNTAREAEPVLQPTMNLGRDRSVMGFNRRYSPQAYPYGGPLDFTPRTGPDDLSQAPTFEGKLPPHVDYPLQEDDEGDAHLGPLLPLKEPPPHELPQPNIICHAPSQSAPIKELLPISKDKGKINLLEERLIAVEGLGNYPFSDLANLCLVLNIIIPPKFK

SEQ ID NO: 114586 - protein, 103 aa, Glycine max
  Coding DNA Sequence Number=SeqID_22901
MGDQEETQEHMKADMSALKEQMASMMEAMLGMRQLMEKNVVAAVSSAAEADPTLLATARHPPSNTPNEVHENPQDYARRDVEFYPPIPEGSAPNTLLQPNLTT

SEQ ID NO: 114587 - protein, 165 aa, Glycine max
  Coding DNA Sequence Number=SeqID_22902
  Homolog annotation: Hit_ID=Q2HW90; Match level="QueryCoverage=98%, HitCoverage=30%, E-value=3e-18, Identity=35%"; Hit description =Putative uncharacterized protein
MVLFPNLDGLMDLAAIDAFLAYHHNKEIPIIVVLDDAYDTFDLRCEKSNARIVYCTLVLYVWLVSHIFFHEGRPVCPLQGHCMCIEKGKANWEELLAGMVGASISWFPRWKEGRAGVLCSCEGFPNVPLMGTRGYINYNPMLAIRQLGYPMKGAPLEEIITPFVA

SEQ ID NO: 114588 - protein, 119 aa, Glycine max
  Coding DNA Sequence Number=SeqID_22903
MSKSCGFGMTGPLDESISCFLIRVDPWVLVPITLRGLRVLAIRGLHVLNFRGLHALAIRGLHVLALRGLHALTLVTLTVERTTRPRLERTTRPHQQRAARPHLQRTTPPRLERATRPHL

SEQ ID NO: 114589 - protein, 60 aa, Glycine max
  Coding DNA Sequence Number=SeqID_22904
  Homolog annotation: Hit_ID=A7Q8B9; Match level="QueryCoverage=55%, HitCoverage=11%, E-value=2e-07, Identity=68%"; Hit description =Chromosome chr14 scaffold_63, whole genome shotgun sequence
KTDLTPSCMLHSARGDIAQLVELRSCNWVVAITEDRNMPLKDSTETRRAVKNVEEVGWAV

SEQ ID NO: 114590 - protein, 178 aa, Glycine max
  Coding DNA Sequence Number=SeqID_22905
  Gene Ontology: Mol. function=aspartic-type endopeptidase activity; Biological process=DNA integration
  Homolog annotation: Hit_ID=Q2RAY7; Match level="QueryCoverage=27%, HitCoverage=4%, E-value=7e-08, Identity=50%"; Hit description =Retrotransposon protein, putative, Ty1-copia subclass
METHLVLASYSYSDYVVDLDVWRFVTGCAFTIGNFLKGKDQVYHEKTKGIEIRYHFIRTKKRVEVHKVDARENPTDMFMKPIPRSNFMHYGPLELLFISTIECDVGVQEEEEVEESIVLEKEMKAQAKLSTQDPGLPRLAFSSPGPLNCFGVKEPARLGEPAYFRMKQQLTWASCHDP

SEQ ID NO: 114591 - protein, 186 aa, Glycine max
  Coding DNA Sequence Number=SeqID_22906
MSEIEEVQEQMKADMEAMKDQMAAMMEAMLSMKKIMESNVVVVATTSAATEVDPTHPSGLNQLATPVGACTFCSTHGGGAHEEPWDRALADFEPYLGHAIEGLAFGGVPQSNTSRGPQYHPQPQPLPFAMGKVPFAMVEREKFNHIEERLKAIEGIGDYPFPDMAELCLVLDVVVPPKFKVPDFDK

SEQ ID NO: 114592 - protein, 157 aa, Glycine max
  Coding DNA Sequence Number=SeqID_22907
YEGRFFEDPNNEGLTIDFDRDISQTINEEEEEDILSPELERLVTQEEREMKPHQEETELVNMGTTEEKKKVKVGTGIDASSIGACRPRIFFINGFLCFLEDEWQRNGERERERRRHFKEKMSLEEAHHHRRPWIRAWRKKEMNEGRGREEHEILCSK

SEQ ID NO: 114593 - protein, 207 aa, Glycine max
  Coding DNA Sequence Number=SeqID_22908
  Gene Ontology: Mol. function=aspartic-type endopeptidase activity; Biological process=RNA-dependent DNA replication
  Homolog annotation: Hit_ID=Q6WAY3; Match level="QueryCoverage=99%, HitCoverage=8%, E-value=1e-11, Identity=28%"; Hit description =Gag/pol polyprotein
  Pfam annotation: Domain name=G-patch; Domain location=38-85; Score =5.0; E_value=0.047; Accession=PF01585.14; Description=G-patch domain
MPYVEAAEESMETTFQSFEVVSITSVDSLSRPPRLSDAAMMVARVMLGHGYKLGMGLGKNNSGRTSMADIRINISERKNKGQGSRSGQRAKEAPSCHISRNFISVGLRREGQVATICDGDSPRRSDLVRPCPPSFQLGNWRVEERPDVYATSIISDDESREGTSTGDLAVDFDQKASQTENEEDENVGLPLELERIIAQEDREIRLH

SEQ ID NO: 114594 - protein, 90 aa, Glycine max
  Coding DNA Sequence Number=SeqID_22909
  Gene Ontology: Mol. function=NADH dehydrogenase (ubiquinone) activity; Cellular component=mitochondrial respiratory chain; Biological process=ATP synthesis coupled electron transport
  Homolog annotation: Hit_ID=P15688; Match level="QueryCoverage=74%, HitCoverage=13%, E-value=7e-25, Identity=76%"; Hit description=NADH -ubiquinone oxidoreductase chain 2
MFSYVGIPPLAGFCSKFYLFFAALGCGAYFLAPVGVVTSVIGCWAAGRLPRLGKNGEVHPNRPMKNKREQSANGARSACETGTEKNQCGG

SEQ ID NO: 114595 - protein, 94 aa, Glycine max
  Coding DNA Sequence Number=SeqID_22910
MAPYRILGCLAATFSACPAPGRDDDLSIVKTLSSICIRSLRPKVGNNNAWQIVIGSSSYLLIYVVNFVSTSDCGPKDRFMPICYHKICIVHMHA

SEQ ID NO: 114596 - protein, 82 aa, Glycine max
  Coding DNA Sequence Number=SeqID_22911
MSNHKSTKSALKNLEIQVGQLAKQLAEKSSNNFGANIEKNPKEECKVVVTRSRKLMVAEDKDVVALKEHAPLKDTTIKKKNE

SEQ ID NO: 114597 - protein, 40 aa, Glycine max
  Coding DNA Sequence Number=SeqID_22912
MAFVDNWAAGKEKVPLELPGLSTFGRILLKDPCPLFAHVL

SEQ ID NO: 114598 - protein, 106 aa, Glycine max
  Coding DNA Sequence Number=SeqID_22913
  Homolog annotation: Hit_ID=A5BLV7; Match level="QueryCoverage=55%, HitCoverage=6%, E-value=2e-10, Identity=57%"; Hit description =Putative uncharacterized protein
MNLCEGVSIDMQSEFEMSMMGELNYFLGLQIKQTNDGIFVNQENVARNSSKEMENLKNIIVLTISYRRYLPKDESEPKNFKEAIIDDQWIVSMQEELNQFERNNLD

SEQ ID NO: 114599 - protein, 147 aa, Glycine max
  Coding DNA Sequence Number=SeqID_22914
MARNVFAPCPYLKDLYGREQKRFLVIIPKVVISLLMVSRGIILFEEHTAAVGTTSNNMFSKRKTLDEGSLKSSKSETKHDHRFTSTPYVPTNPVPSGVANCRNLPFDGRATPDSRVHVPRKEYARSRHQRLFEENVRKTGKDVIYEL

SEQ ID NO: 114600 - protein, 50 aa, Glycine max
  Coding DNA Sequence Number=SeqID_22915
MTKETMKILQKKANPNDVLPREWKTSRDHPLDNIIGDISKGIYLDHYLLP

SEQ ID NO: 114601 - protein, 46 aa, Glycine max
  Coding DNA Sequence Number=SeqID_22916
MTRPCLKGIEEKTAKLKGSEKALVARHEPSHAVVGSGYQTPGFNDL

SEQ ID NO: 114602 - protein, 181 aa, Glycine max
  Coding DNA Sequence Number=SeqID_22917
MVGYTPSSFAYLVFTDERIKMGLKRGKFDHPALMNEKTRANKKDGKEGETHAATAVPTWPSFPPTQQCHYSANNNPSPYPPPNYPQRPSLNQPQNPPSTQPMLNTTSSTNPKHQPRNEFCSEKTCRIHPNSAITPTKVPQPPFLQGYDSNATCAYHGGAPGHSIEHCMTSKRKVQSLIDAS

SEQ ID NO: 114603 - protein, 166 aa, Glycine max
  Coding DNA Sequence Number=SeqID_22918
ESGPCLSPSVADHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHNVVTLYR

SEQ ID NO: 114604 - protein, 71 aa, Glycine max
  Coding DNA Sequence Number=SeqID_22919
MVNFVLTGQLNFVSIVIDSFKHLKWSISDENPETGQIQAKGPSGEGQRPRVEKDEGPEVETLSRMKDEGSD

SEQ ID NO: 114605 - protein, 97 aa, Glycine max
  Coding DNA Sequence Number=SeqID_22920
  Homolog annotation: Hit_ID=A5APK5; Match level="QueryCoverage=67%, HitCoverage=5%, E-value=3e-27, Identity=95%"; Hit description =Putative uncharacterized protein
MSPPCGDMDGALALPEKEVIQPHLPVRLPCYDFTPVTSPAFGIPLLAVKVTTSGMASSHSVTGGVYKARERIHRRMADRRLLAIPASCRRVAAYNPN

SEQ ID NO: 114606 - protein, 84 aa, Glycine max
  Coding DNA Sequence Number=SeqID_22921
MFVDPNNANTITLGEVVETLQYMVSPQGRNTWTIDDLVPYVEKLAIICKEQERITESVSHGPASEREFTAQEFHILQSSVETRA

SEQ ID NO: 114607 - protein, 128 aa, Glycine max
  Coding DNA Sequence Number=SeqID_22922
  Homolog annotation: Hit_ID=Q9AY32; Match level="QueryCoverage=28%, HitCoverage=54%, E-value=3e-08, Identity=83%"; Hit description=RRNA intron-encoded homing endonuclease
KPWTLALFNAMGYYSYVASLIVVGSSQYLGFMKDESTAKAFAKDGSADVAFRTPLAPYEKSKSLGSGGSMVARRNLKELTEGHHQEGALRLNLTQLGEIARPLCRRRIIQISALSTFDGRIVAYHGGD

SEQ ID NO: 114608 - protein, 201 aa, Glycine max
  Coding DNA Sequence Number=SeqID_22923
  Gene Ontology: Mol. function=helicase activity; Biological process =viral genome replication
  Homolog annotation: Hit_ID=Q2R1R7; Match level="QueryCoverage=89%, HitCoverage=11%, E-value=8e-39, Identity=47%"; Hit description=AT hook motif-containing protein, putative
MWYNESILKRSNTSNPRFSLCCGDGKVELPLLQNPPKFLQQVIFEQIQLMQKNYQQNIRTYNMMFAFTSAGIKFDKIISHLRDPPTVRIQGQPCHRIGSLLPMPGKEPKFAQLYIYETENEVQNRINTMSQYNEIEAHIVSNLQKMMDENNAHAKSFRMARDRLTGTEVHNVRFKLIAGREKKMVIHIMYQVFQKLLHLLQ

SEQ ID NO: 114609 - protein, 213 aa, Glycine max
  Coding DNA Sequence Number=SeqID_22924
  Homolog annotation: Hit_ID=Q84VH5; Match level="QueryCoverage=81%, HitCoverage=29%, E-value=6e-74, Identity=73%"; Hit description =Envelope-like protein
PTEGVVDIAVSEHQIAKEITAKQVKHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDALIAELKDTCKVLEATIKATTEKKMELERLIKRLSNNGIDDGEAAEEEEDAAEIQNQMMMILMPPHDHQTFIFAFYSY

SEQ ID NO: 114610 - protein, 110 aa, Glycine max
  Coding DNA Sequence Number=SeqID_22925
MGLRKKTENGELLYSITTHGSKARRWRTHERKRNSWGSRKKIENWRIALSNHYAWLQTRGGHNERKRNSWGSQKRLRMENCTKKSLRMAPNSSGGGHMNENAIHGAPKKD

SEQ ID NO: 114611 - protein, 201 aa, Glycine max
  Coding DNA Sequence Number=SeqID_22926
  Homolog annotation: Hit_ID=Q6WAY6; Match level="QueryCoverage=88%, HitCoverage=28%, E-value=6e-22, Identity=38%"; Hit description =Putative uncharacterized protein
MGKGKWAPFIDILALLIFGGVLFPNVNGLVDLAAIDAFLAYHNHKENPVVAMLADLYDTFNRRCEKSSTRIVCYTPVLYVWLVSHLFRQEVRHACPLECHRSCIEKGGANWDQLLANKEGAPINWFPRWKQGRVGVLISCGGFPNVSLMGTMGCISYNPVLAIRQLGYPMSGAPLEEELAPIISRGFNKTNLETLQKVRKA

SEQ ID NO: 114612 - protein, 396 aa, Glycine max
  Coding DNA Sequence Number=SeqID_22927
  Gene Ontology: Mol. function=motor activity; Cellular component=cell projection
  Homolog annotation: Hit_ID=UPI00006A2D9E; Match level="QueryCoverage =66%, HitCoverage=97%, E-value=5e-17, Identity=18%"; Hit description =UPI00006A2D9E related cluster
LHTLAFGWLHALAFRGLHILAFRGLHVLAFRGLHALAFRGLHALSFRGLHALTFGGLHAHAFRGLHAFVLRGLHALVFRGLHVHAFRGLHVLIFRGLHVLDFKGLHLLSFSGQHVLAFSGLHVLTFRKLHVLAFRVLHVLAFREPHTPAFEGLHALSFRGLQVVTFKGLSVLAFRRLLASPLEGYASSPLEGYMPLPSKDCTSSPSKDYTIARPRLLRTTCLHLQRTVRPRLQRTAFLAFIGLHTLAFKGLHTLAFKGLHALAFRGLHVLAFRGLHPLTIRGPHALDFRRPQRASCPRLLKAARPRHRRATRPRLRRATRLRLRRAAHPHFPRAARPCLQRIARPRLQRATCPCLQRVASPRLEGYMPSLSEGYTPSQSEGYTPSPSEGYMPSPLE

SEQ ID NO: 114613 - protein, 78 aa, Glycine max
  Coding DNA Sequence Number=SeqID_22928
MCYRSSGNSLSVSMRHSHLGKLGSKYRGQPIMHMKLPPPHGDQLESQGSSKSSDMPPSTRISIMVTAPPMYIHNMHPS

SEQ ID NO: 114614 - protein, 204 aa, Glycine max
  Coding DNA Sequence Number=SeqID_22929
  Homolog annotation: Hit_ID=Q6L477; Match level="QueryCoverage=51%, HitCoverage=16%, E-value=6e-10, Identity=29%"; Hit description =Putative uncharacterized protein OSJNBa0009L15.8
  Subcellular localization annotation: CTP_CleavageSite=30; ConfidenceScore=5.40e-01
MATPPASPPPPPPPPAIASTSPYTLKRTCKATQLRSLATRPPGAERPVVHIDPAIGKADGPHKKKLRTYLGIVARDKVDVTYETWKEVPATQKGLIWEDIQAEFDIPKASDGRTKKKVLQTVSERWRQFKFGLTRKWALAADKDSVDDTVRENTALARRNWPSFVRPSETPRGRMCGKRHKPSKSKTLPPTCCLVGVMNIKNRS

SEQ ID NO: 114615 - protein, 101 aa, Glycine max
  Coding DNA Sequence Number=SeqID_22930
MTSISMCQRAHTMIDKGCRRRHSKRMFVGYLRVSPHVTGLLGHGEQVSDAQEFWLAIKGRGPLPVVGNVYGELGFWLKACRTDGHDIRQSVGLASGSGTKG

SEQ ID NO: 114616 - protein, 154 aa, Glycine max
  Coding DNA Sequence Number=SeqID_22931
  Homolog annotation: Hit_ID=Q6WAY6; Match level="QueryCoverage=85%, HitCoverage=21%, E-value=7e-14, Identity=36%"; Hit description =Putative uncharacterized protein
MEILVVVVLVDAYDTFDRRCEKSSARIVCCTPVLYVWLVSHFFGHESRPVCHLQGHHMCAEKGKANWEQLLAGMVGASVNWFPQWKEGRARVLSSCEGFPNVPLMGTRGCINYNLVLAIRQLGYPLRGVPSKESIAPFIARAFSDPNAKTLQKI

SEQ ID NO: 114617 - protein, 89 aa, Glycine max
  Coding DNA Sequence Number=SeqID_22932
  Subcellular localization annotation: CTP_CleavageSite=18; ConfidenceScore=5.23e-01
MTDVWGANTFPARKYNSRGFHLKVRRSRLFWVFRSFPQINVGGDSARIPFVEHASRESRVALPPKGLKHTPFTCHGVSAPSHTKMLHYI

SEQ ID NO: 114618 - protein, 77 aa, Glycine max
  Coding DNA Sequence Number=SeqID_22933
MGSGASGTPNVFWSWLASGGSNPARLGELGGNLLPLFPIKRLKGAVLRIPQPPGYVFQLFWVKKIISVKKIQAEMLP

SEQ ID NO: 114619 - protein, 457 aa, Glycine max
  Coding DNA Sequence Number=SeqID_22934
  Homolog annotation: Hit_ID=Q2HW90; Match level="QueryCoverage=46%, HitCoverage=40%, E-value=2e-25, Identity=36%"; Hit description =Putative uncharacterized protein
KWGPFADILALLIFGVVLFPNVDGLVDLAAIDAFLAYHHSKECPVVAILADLFDTFDRRCEKSSARIVCCLPALCVWLISHLFQQDTRHPCPHQSYRSCAEKGRVDWDQHLAGIGGSAINWFPRWKEGKEGVLFSCGDYPNIPLIGTRGCINYNPALAIRQLGYPMRGAPTEESLSPFLVRDLGAQGLKVIQRIHKAWRSPLRKDKELRGIRNGVIGGYHGWLRIHTRGRTSKLRRKMKKSELSILELGKARLAKEKFKSAATHIRKECTELQEENATTARALEQETKRARKEEYGREKFRGALWGSNNELKLRREERYQSRVHGMILKEELAACARSKRSLAQHLEATEQSMLAIIGQYKEELNQSVAHEQKLVEDFAQVYAEKEARGRVIDALHQEATMWMDRFALTLNGSQDLPRLLAKAKAMDEVCTAPEEIHGLINYCQHMIDLMAHIIRNC

SEQ ID NO: 114620 - protein, 68 aa, Glycine max
  Coding DNA Sequence Number=SeqID_22935
MIIQKSDQGVLTDPKRIKVNPKWPTPPSIREIWGFHDLTNFYKRCRGKKPKVSITFGFEVKSFPRGSG

SEQ ID NO: 114621 - protein, 119 aa, Glycine max
  Coding DNA Sequence Number=SeqID_22936
  Subcellular localization annotation: CTP_CleavageSite=53; ConfidenceScore=5.13e-01
MGVVIKKGGANSNQTHLGLSGGSNRRRCLLVDATQLAWAAITSFFSPINRGKRAEQKCSALLVFRILSKLVRKIVSVEKIQAEVLLKRFRDVSVSDFVKILHRSSSFFVRSLSFFGFQL

SEQ ID NO: 114622 - protein, 191 aa, Glycine max
  Coding DNA Sequence Number=SeqID_22937
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=P77316; Match level="QueryCoverage=68%, HitCoverage=31%, E-value=5e-60, Identity=83%"; Hit description =Uncharacterized zinc-type alcohol dehydrogenase-like protein ybdR
  Pfam annotation: Domain name=ADH_N; Domain location=25-160; Score =122.8; E_value=1e-33; Accession=PF08240.3; Description=Alcohol dehydrogenase GroES-like domai
MKALTYHGPHHVRVENVPDPIIEQPDDIILRVTATAICGSDLHLYRGKIPKVQHGDIFGHEFMGEIVECGSEVKQLQKGDRVVIPFVIACGDCFFCRLQQYAACENTNAGQGAALNKKQIPAPAALFGYSHPLRRRAGGTGGICARAERAGGATDHCLRAAVRGRADLCYRSPPVSVAICRGALRCHPHQL

SEQ ID NO: 114623 - protein, 118 aa, Glycine max
  Coding DNA Sequence Number=SeqID_22938
MTRGNPGNLQPFDLEIDRTFHRLVRHSVHPDNSVHFEHCEHFEHSEYFVAGDSEYYDFEHSTTNFHTENVAQPPPRERNLREMVAPDFTYESLCIQYPDEGVPYVLKTGLIHLLPKFH

SEQ ID NO: 114624 - protein, 47 aa, Glycine max
  Coding DNA Sequence Number=SeqID_22939
MEGWTSLSSNCKDGFLTQEMYSTSIHMSSHTTNKMVIAVSKEESSSS

SEQ ID NO: 114625 - protein, 173 aa, Glycine max
  Coding DNA Sequence Number=SeqID_22940
IPHIRKECAGLREENATTTRALEQETKRARKEEYGRNKFRGALWGSNSELKLRREERDQSRAHSMVLKEELVACSRSKRSLSQRLCETETNMLAIIAKYQEELGLATAHEHRIAEKEARGRVIDSLHQEATMWMDRFALTLNGSQELPRLLAKAKAMADTYSAPEEIHGLLGY

SEQ ID NO: 114626 - protein, 286 aa, Glycine max
  Coding DNA Sequence Number=SeqID_22941
  Homolog annotation: Hit_ID=A4DID9; Match level="QueryCoverage=19%, HitCoverage=49%, E-value=8e-19, Identity=80%"; Hit description =Putative uncharacterized protein
VPPQGSSTEGESGPKIRPKGVVDGQQDARCPCFFRVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGHVCEDAGLPCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPT

SEQ ID NO: 114627 - protein, 71 aa, Glycine max
  Coding DNA Sequence Number=SeqID_22942
DRSLSGDAPSSMSEPFRNWLGMGVTIPALIQPEEEIAMHLAQLARRSLEWECSVGKVPEVPQFLGSTSRCI

SEQ ID NO: 114628 - protein, 136 aa, Glycine max
  Coding DNA Sequence Number=SeqID_22943
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MAIEELYKRGERSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114629 - protein, 153 aa, Glycine max
  Coding DNA Sequence Number=SeqID_22944
MEQCSAREVRAINVRNLGQEGLVEGPLWVARGPPDPVGLSRDSRASYTCGPERAWWTYAERGEPDGTLAGGSRAAILTIAGARGRVLSGRCGCSVEPRHGIESSKWAIFGKQNWRCGMNRKLGYGAQLRANLDPTKGVGRLRQQTVVMEVEIR

SEQ ID NO: 114630 - protein, 148 aa, Glycine max
  Coding DNA Sequence Number=SeqID_22945
  Gene Ontology: Mol. function=C4-dicarboxylate transmembrane transporter activity; Cellular component=integral to membrane; Biological process=C4-dicarboxylate transport
  Homolog annotation: Hit_ID=P0ABP4; Match level="QueryCoverage=87%, HitCoverage=27%, E-value=1e-47, Identity=75%"; Hit description =Anaerobic C4-dicarboxylate transporter dcuC
MSDGQASHDTNCSKDTGEIMLTFIELLIGVVVIVGVARYIIKGYSATGVLFVGGLTLLIISAIMGHQVLPASATSTGYTATDIVEYIKILLMSRGGDLGMMIMMLCGFAAYMTHIGANDMVVKLASKPLQYINSPYLLMVAAYFLACL

SEQ ID NO: 114631 - protein, 199 aa, Glycine max
  Coding DNA Sequence Number=SeqID_22946
MSYHSSSVNSEGTSHKDPLSRILHELSSLKLWKEKLERKEKGKERVEINQDEREQIRKEERRKILKELRKEKYASYSNHDSCKSLSEELCDYYEGRHRSHLRPHSNRREKERNPQEANINLSYFHGKDNVEAYLDWEIRVKQQLRRKSTSKSYRSHSYPKKDQGQGILGAAPSKPKDDKGKTIEKQPPKANMQEKTSCI

SEQ ID NO: 114632 - protein, 362 aa, Glycine max
  Coding DNA Sequence Number=SeqID_22947
  Homolog annotation: Hit_ID=Q0ZCD0; Match level="QueryCoverage=87%, HitCoverage=27%, E-value=9e-08, Identity=22%"; Hit description =Integrase
ASNSQQFSAINDAIVIRGVHEVATNPSASSETKKLEGKLDALVNLVTQLALNQKYVPVARVCGLCSSADHHTDLCPSMQQPGAIEQPEAYAANIYNRPPQPQQQNQPQQSNYDLSSNRYNPGWRNHPNLRWSSPQQKQQQPAPSFQNVAGPSRPYIPPPIQQQQQPQKQPTVEAPPQPSLEEHVRQMTMQNMQFQQETRASIQSLTNQMGQLATQLNQQQSQNSDKLPSQAVQNPKNVNLPLAILIYRSSISLFHSLQEQFPTKKMEEAEKEILETFRKVEELCTNKRKLKGSERISMGRNVSALIGKSVPQIPEKCKDPGPLHSTDVVIHLANRSVAYPVGFIEDVLVRVGELIFPVDFIF

SEQ ID NO: 114633 - protein, 218 aa, Glycine max
  Coding DNA Sequence Number=SeqID_22948
  Homolog annotation: Hit_ID=Q2HW90; Match level="QueryCoverage=88%, HitCoverage=36%, E-value=3e-19, Identity=33%"; Hit description =Putative uncharacterized protein
MDGLVDLAAIDAFLTYHDHKESSVVAMLANLYDTFDRRCEKSSTRIVCCTSALYVWLVSHLFRQEVRHACPLESHHSCTEKGGANWDRLLANKEEASVNWFPRWKEGRTGVLISCGGFPNVPLMGTRGCISYNPVLAIRKLGYPMRGAPLEEELAPVISRGFNKTNVETLQKVRKAWEVVQKKEIELRGSKNGPIGGYRKCLKADVQGLDWLPSFENR

SEQ ID NO: 114634 - protein, 23 aa, Glycine max
  Coding DNA Sequence Number=SeqID_22949
EFTKIQPFFDVLHSFFIVLRSST

SEQ ID NO: 114635 - protein, 78 aa, Glycine max
  Coding DNA Sequence Number=SeqID_22950
MTKGAGDDVSLCASTGSFALGRRKVQIAKECLRVTIGCLRTSPDSWVTVTKGGVVNKSRVFAPTYPQFVMRNSDLRSS

SEQ ID NO: 114636 - protein, 42 aa, Glycine max
  Coding DNA Sequence Number=SeqID_22951
MDKTWNLAHTGGCKDPRDTGAGVQSYYAIYQTKSANQLVRVQ

SEQ ID NO: 114637 - protein, 122 aa, Glycine max
  Coding DNA Sequence Number=SeqID_22952
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQPVTSFKELVAQRTFENRPAS

SEQ ID NO: 114638 - protein, 190 aa, Glycine max
  Coding DNA Sequence Number=SeqID_22953
VKGHLVKFDEDTLNTFLKTAVVLEEGENLCTYSRFALLRPDPQELAAKLCIPGRGFELNADGQPLKILRKNMTMLAQTWSVLSLSNLIRTSHKSDVTLDRAKLIYGIIMKMDMNLGYLISHQISRIAQHDKSRLGFLAVATCPFAGERGEPHGKVDKSGAFAPAYPPSKRKSDLRSSFLSVNQTILFTLK

SEQ ID NO: 114639 - protein, 72 aa, Glycine max
  Coding DNA Sequence Number=SeqID_22954
MSRNFTDCLTMGVKFLEAVKRRLHVIKQWSPDEIRLVGLGSSSSMDSFASWKMNDSGMEKEEREEMPLQGER

SEQ ID NO: 114640 - protein, 60 aa, Glycine max
  Coding DNA Sequence Number=SeqID_22955
MESQITKGKCTYFSRELGVFEGRHKHGPLWVGVRLLEPTQAALQRHFPFVQSWGKDDDLP

SEQ ID NO: 114641 - protein, 378 aa, Glycine max
  Coding DNA Sequence Number=SeqID_22956
  Homolog annotation: Hit_ID=Q2HW90; Match level="QueryCoverage=87%, HitCoverage=71%, E-value=1e-32, Identity=30%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSECLPSLSRIATVVKDSARGLDRIKQTRNGIAGLPQKYLEDKARDLAAIDAFLAYRHSKESPVVAVLADLFDTFDRRCEKSSARIICCLPALCVWLVSHLFQQDTRHPCPLLSHRSCTEKRRMDWDQLLAGIGGRTISWFPRWKEGKEGVLFSCGKYPNIPLVGTRGCINYNPTLAIRQLGYPMRGAPTEESMSPFLVRDLGAQNSKTIQRIHKAWETPLRKDQELRGIRNGIICGYHEWLKVRIRGLDWLAKLKVVSEENFEAPEEDEEVQALKS

SEQ ID NO: 114642 - protein, 101 aa, Glycine max
  Coding DNA Sequence Number=SeqID_22957
MTNRLRILCLNTLEGTSFVVQVEATSTWVVVTENKRGYISCGSVQVEGTSTWLFKENKGGYIPCGSLLVKDFTRLKEISRTGGCLGTGCRHGLLRGHLIQQ

SEQ ID NO: 114643 - protein, 68 aa, Glycine max
  Coding DNA Sequence Number=SeqID_22958
TYQGNPCGVYPDLSSFTGSGVYPDLSSFTGSGVYPDLSSFTGSGIIQKLYSLYQAIRPVRFTSSGIRA

SEQ ID NO: 114644 - protein, 194 aa, Glycine max
  Coding DNA Sequence Number=SeqID_22959
  Homolog annotation: Hit_ID=Q6UUU1; Match level="QueryCoverage=30%, HitCoverage=40%, E-value=2e-18, Identity=78%"; Hit description =Putative uncharacterized protein
TQDLFILRSDLSVTGIYSAQSASAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWRCQEDT

SEQ ID NO: 114645 - protein, 173 aa, Glycine max
  Coding DNA Sequence Number=SeqID_22960
MKDKRDEEEKLEKQKKKKDSKALSSKAKGEEKESKKIVKKENHFATKGDIKKALLLKQSFYLLLSRETSLSTAIPLELEVIPQVKELLDEGLVCKSLNPCALLVPKIGITRHQIPMNGGMMNVLSGATLFCKITHAPNIFMICVHRNSLGSDQGFPMDAKRIKVIPECLLHQV

SEQ ID NO: 114646 - protein, 126 aa, Glycine max
  Coding DNA Sequence Number=SeqID_22961
NGAEKLPAKMSRKDATGEGSSVALQVDVEFDRHRFQSEEHQRGFEAIKGWSFLKERQVQLRDREYTKFQEEIGNGLSWCHPWLSLGSSSSMDSFASWKMNGSGMEKEEGEETPLQGEDESRRSAPP

SEQ ID NO: 114647 - protein, 177 aa, Glycine max
  Coding DNA Sequence Number=SeqID_22962
  Homolog annotation: Hit_ID=Q6UUU1; Match level="QueryCoverage=64%, HitCoverage=95%, E-value=5e-37, Identity=61%"; Hit description =Putative uncharacterized protein
GKPVVPAALMNRPTRGERRFAYWALAECVLAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRVCLIPRLTLSSGRQFAPSWTVCTNPPFSPTAAPI

SEQ ID NO: 114648 - protein, 111 aa, Glycine max
  Coding DNA Sequence Number=SeqID_22963
MWTHNGYIQNEWKDARLSPTFICGKRRKNRRMKPVKIKILSSPGVILRLRKGTGALPPSSPRRTLSEDNTYVVLSGGRICKAQSSFEEVTKTHGGKTPPFDFLALNFTDKK

SEQ ID NO: 114649 - protein, 31 aa, Glycine max
  Coding DNA Sequence Number=SeqID_22964
MTGRQLRITSYYYCIVLHGNAPDAPPPSLFK

SEQ ID NO: 114650 - protein, 135 aa, Glycine max
  Coding DNA Sequence Number=SeqID_22965
MERSMIDDASGGALGDMTPAEARNLIEKMASNSQQFSARNDAIVIRGVHEVATNPSASSETKKLEGKLDVLVNSPNPAGLESPPLYLSQGFVQPGAIEQPEAYAANIYNRPPQPQQQNQPQQSNYDLSSNRYNPG

SEQ ID NO: 114651 - protein, 339 aa, Glycine max
  Coding DNA Sequence Number=SeqID_22966
  Homolog annotation: Hit_ID=Q84VI1; Match level="QueryCoverage=100%, HitCoverage=49%, E-value=1e-125, Identity=71%"; Hit description =Envelope-like protein
MASSPKETSAPGSPAVPSSPHQEQPEFNIQPIQIIPGQASVPEKLIPRRQQGVKIAENPSPATSPREVDTEMDKKIRSIVSSILKDASVPDAEKDVPTSSTPSVSVPDAEKDVPTSSAPNAEALPSPSEEESTEEEDQATEETPAPRAPELAPGDLIDLEEVESDEEPIANRLAPGIAERLQSRKGKTPIKRSGRIKTMAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKEIMDLIKAAGLLKTVTKLGECYESLVREFIVNIPSDITNRK

SEQ ID NO: 114652 - protein, 265 aa, Glycine max
  Coding DNA Sequence Number=SeqID_22967
  Gene Ontology: Mol. function=ATP-dependent DNA helicase activity; Cellular component=membrane; Biological process=signal transduction
  Homolog annotation: Hit_ID=A6T756; Match level="QueryCoverage=94%, HitCoverage=36%, E-value=1e-105, Identity=77%"; Hit description=DNA helicase IV
MSEIAADLLRQQLSEIERASAEGKWLTRQQVADVQDKIRRALTGLPFPESRLDEFDNCRELWRQCQCWLSDIDEARLAHNQAYTEAMLEQYRGFFDKIESSPLNPAQARAVVNGERSLLVLAGAGSGKTSVLVARAGWLLNRGEAAADQILLLAFGRQAAQEMDERIQERLGTDEIAARTFHSLALHIIQQGSKKVPAISKLENDTAARQKLLLKAWQQQCQEKKAQAKGWRQWLVDEMEWQIDEGDFWQDRALLRRLAGRLDRW

SEQ ID NO: 114653 - protein, 68 aa, Glycine max
  Coding DNA Sequence Number=SeqID_22968
  Subcellular localization annotation: CTP_CleavageSite=17; ConfidenceScore=5.10e-01
MAKARQKGVRKVNENKSLQNKWGPPRGRSLPPSSPRQARLLPPEATPFWRDILEGPSGPGCYLHPLFY

SEQ ID NO: 114654 - protein, 343 aa, Glycine max
  Coding DNA Sequence Number=SeqID_22969
  Gene Ontology: Cellular component=plasma membrane
  Homolog annotation: Hit_ID=A8XZZ5; Match level="QueryCoverage=50%, HitCoverage=58%, E-value=3e-16, Identity=24%"; Hit description =Putative uncharacterized protein
MTDPLDESISCFLIRVDPWVLVPIALRGLHVLTIRGLHALAFRGPHVLAFRGPNAHAFRGLHVLTFRGLHVLAFRGLHAFAFRGLHVLTFRGLHILTFRGLHVLAFIWLHALTFRGLHVLIFRGLQRTIRPHIKRTTRPRLQRDTCPRLPRTTHPRLQRATCLRLQRTTRPCLQRATRTRLQMTTRPRLQRARCPGLQMTTRPRLHRAAHPRIQRTTRPHLQRTTDPRLQRATRPHHQSTTCPRLEDYTSSPLEGYMPSPSEDYTSSPSEGHTPSPSANTRAQLKRATRPHLERTTRLAFRWLHAPDIRGLHVLSFRALHVLAFRGLHALARPRLQRTTRPRR

SEQ ID NO: 114655 - protein, 189 aa, Glycine max
  Coding DNA Sequence Number=SeqID_22970
MSLPAPPWPYAFWPARLDLALTGLPPSCKDSAPPLDALRPRFVQAALLGYVLPIAKAALSRDEEKERGKAKYEITGIGLVELDRAIQETIQSKASKRSKKIVKAQGIHHEGKEQLIRQDGIPLLHVFGLSFSCVDASKAAPSPPPPSALPVGVRTGAYTEALALANKREDIPACGRGRGTGLLGRSDKP

SEQ ID NO: 114656 - protein, 87 aa, Glycine max
  Coding DNA Sequence Number=SeqID_22971
MAGCGKGCTYWVLDVFYQIPTLGGIDGDPVLRGTRIRATWEYVNSVEGVQLGMVDLCVICGCGESTCTIARSPPCTTYDGYPIILQA

SEQ ID NO: 114657 - protein, 334 aa, Glycine max
  Coding DNA Sequence Number=SeqID_22972
  Homolog annotation: Hit_ID=A5ASR8; Match level="QueryCoverage=83%, HitCoverage=62%, E-value=1e-10, Identity=23%"; Hit description =Putative uncharacterized protein
  Subcellular localization annotation: CTP_CleavageSite=41; ConfidenceScore=5.42e-01
MAEPSKKRKGSSSTAAAAAHRRHGPSGAPTTPIHPSLTSPRSSTLFLSDDQPLRYLSQFCSRIILDPKYLDIEFFNDETFDCYQVFQNSGLVDFMSLKLPYYPELVKVFYCNLKIQDGIIISEVHGISMVIDQSLFFSLTHLPSQGAPFEGTIVDDWKFDYSSHDARRMVCNDQAEMTGRLLAGILLPRSSNLAQASEEDLIFMWAFLTGRQIDWAHLVRYRMHKALRANAPLPYPHLITLFLRHFQIPLDDEPFVQVTHSFAIGVPAVTSFGYRKDRNGQWLKKDALPPQDECTPSPPPQREDSALMNEVLSELRGLRSYVGDRFDSLDTRFA

SEQ ID NO: 114658 - protein, 56 aa, Glycine max
  Coding DNA Sequence Number=SeqID_22973
MHDAIKEQARGLSGTMPYQNRKTLDEASLSSSESETQHDHRSISSPYVSHGPGYRA

SEQ ID NO: 114659 - protein, 77 aa, Glycine max
  Coding DNA Sequence Number=SeqID_22974
MRDIQLLTHTVTPSILILCEGFTLNPSGIHYAVPDVERDVPAVSASFTMHFVELFVRLGSHHGLAFQPSSVIQVYSL

SEQ ID NO: 114660 - protein, 194 aa, Glycine max
  Coding DNA Sequence Number=SeqID_22975
MIQAEAKEGLRTNITKGKDQQCLQEGTSRGRYEARTTARDFPMQIVDSLATTRKETKDKEIDEPAKRKSEETDVVESTIEEKVQVPESGRISMTFKVTEDKHPKVLEIESPESELQSTKGPTTRAISVEFKEVEQTSAKDKTQKTKLLPPNIQSKETHESNEGGVKQDTIKPKKEKEVEGEQCTYTLKALKRLQ

SEQ ID NO: 114661 - protein, 53 aa, Glycine max
  Coding DNA Sequence Number=SeqID_22976
SMSAKKDDDRSRSKKEESPDDADRTFPNRHRPNIIGGLKRKNISGHWSLNNPD

SEQ ID NO: 114662 - protein, 264 aa, Glycine max
  Coding DNA Sequence Number=SeqID_22977
MRRVHQAMLNPELLMQHLSRRCQTVGGATPVTHHNVPGGIVLVMIDAHNNRQVVVLSGGGDNDAFCATVGDMYRRFFPFSKEAGGLNHHVHADITPRDIRRIAFAEYGDPLPVDLQRAVGRFNGSGQFPQQGVMFQQMGEGLAVRQIVNGHNLQIRVAQRRAQEITSDTAETVNTDLNHGALLISVVWSHCRRQAGWRKRQKRIRLRHFPAVKSLAILARGEVELFLEHAPQINTGAKPALLSNALKGSAGLLKRLAGRSLTCF

SEQ ID NO: 114663 - protein, 316 aa, Glycine max
  Coding DNA Sequence Number=SeqID_22978
  Gene Ontology: Mol. function=sequence-specific DNA binding; Cellular component=intracellular; Biological process=response to DNA damage stimulus
  Homolog annotation: Hit_ID=Q6DAV7; Match level="QueryCoverage=68%, HitCoverage=97%, E-value=3e-74, Identity=66%"; Hit description=DNA repair protein radC homolog
  Pfam annotation: Domain name=HHH; Domain location=50-79; Score=17.9; E_value=0.017; Accession=PF00633.14; Description=Helix-hairpin-helix motif
  Pfam annotation: Domain name=RadC; Domain location=94-218; Score =255.8; E_value=9.3e-74; Accession=PF04002.6; Description=RadC, DNA repair protein
  Pfam annotation: Domain name=Ribosomal_L28; Domain location=241-301; Score=132.9; E_value=8.9e-37; Accession=PF00830.10; Description =Ribosomal L28 family
  Pfam module annotation: Pfam domain module=HHH::RadC::Ribosomal_L28; Domain location=50-79::94-218::241-301
MTELAPREKLTLLGAEALSDAELLAIFLRTGTRGNSVMGLARLMLNEFGSLYRIMTASKEELGQIKGVGSAKMTQLHAIAELGRRFFASQLARENVMENPQVTRHYLQSVLAHQEREIFMALFLDNQHRVLQAQKMFSGSIASVEVHPREIVREALKLNAAAVILAHNHPSGMAEPSRADREITSKVAQACALLNIRLLDHLVIGHGEFTSFAERGWLGVYYATFENLGFGVWASLAEMSRVCQVTGKRPVTGNNRSHAMNATKRRFLPNLHSHRFWVESEKRFVTLRVSAKGMRVIDKKGIDTVLAEIRARGEKY

SEQ ID NO: 114664 - protein, 134 aa, Glycine max
  Coding DNA Sequence Number=SeqID_22979
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
  Subcellular localization annotation: CTP_CleavageSite=50; ConfidenceScore=5.07e-01
MTGTFFLLKQQNSLEIMSGKKEMTPNRVVNRSFRTLCPGDPLVLERPPPRWSSNSPYSESYYNSLAVVLQRRDWENPGVTQLNRLAAHPPFASWRNSEEARTDRPSQQLRSLNGEWDAPCSGALSAAGVVLRAA

SEQ ID NO: 114665 - protein, 231 aa, Glycine max
  Coding DNA Sequence Number=SeqID_22980
  Gene Ontology: Mol. function=transporter activity; Cellular component= integral to membrane; Biological process=transport
  Homolog annotation: Hit_ID=A8GGQ1; Match level="QueryCoverage=35%, HitCoverage=17%, E-value=7e-27, Identity=68%"; Hit description=Major facilitator superfamily MFS_1
MEKRCGIAPGDDFSQRDATAQLPKKGRFSEIWAPAYRQRTLMLVVMNFFQAIGFFGFGNWLPALLSGKGATVTHSLLYAFFHHAGLSARLADLQPLRRPAGKQMADRFFIADDGGVRHAVRADQQPAADGGVRFPDHLQQRLADLQLSRLSDRDLPDAHSSARRRLLLFVQPAVDRFQQYSDWPDSAVCRQSGGDRIYRAEYADGDAVGRDLRAEDAGAGSGEHLNRMGAG

SEQ ID NO: 114666 - protein, 138 aa, Glycine max
  Coding DNA Sequence Number=SeqID_22981
  Subcellular localization annotation: CTP_CleavageSite=33; ConfidenceScore=5.15e-01
VCSHSNPSQKIRVGRRCNPQGDPTNQLPCEPVRVSTRPGVGRLAPVRLLVGFKTGRRGARTADARSVQVLEHFQGRALDPTQSGDETVSRWSRLLSTEKKSFRGATIATDVSGSLTLPVSPPSVGPALTEFNPFRLSE

SEQ ID NO: 114667 - protein, 158 aa, Glycine max
  Coding DNA Sequence Number=SeqID_22982
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=4e-25, Identity=56%"; Hit description =Putative uncharacterized protein
  Subcellular localization annotation: CTP_CleavageSite=52; ConfidenceScore=5.55e-01
MTMITPSSKLTLTKGNKSWYRAPPRGRRGLKNGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114668 - protein, 64 aa, Glycine max
  Coding DNA Sequence Number=SeqID_22983
MDKSLKVGEDEWRERVRRSTKFGASNELWFSPLIQDQVQDSPLSVCLGIMRHVKHEGHAQGVTI

SEQ ID NO: 114669 - protein, 188 aa, Glycine max
  Coding DNA Sequence Number=SeqID_22984
  Homolog annotation: Hit_ID=Q84VH5; Match level="QueryCoverage=52%, HitCoverage=12%, E-value=1e-16, Identity=51%"; Hit description =Envelope-like protein
GVKIAENPSLATSPREVDTEMDKKIRSIVSSILKDASVPDAEKDVPTSSTPDVVVPEADEDVPTSSPRISVPDVEKDVSNIYRQMLRMLTRVPNVDTPELLHDHSYCDNLSAINISKNPVQHEQNQHIANKLDITIIRECLSEESGYLTPGACDQQIPEETNMEQILLSLSIRLPEITAKTSPALAKN

SEQ ID NO: 114670 - protein, 47 aa, Glycine max
  Coding DNA Sequence Number=SeqID_22985
MWDRHRLKGALKPGVFTPKVYTPKSPSKPLPPNSGPLSGSHDNTRPP

SEQ ID NO: 114671 - protein, 56 aa, Glycine max
  Coding DNA Sequence Number=SeqID_22986
MGAKYLEVVKRGSHPNNGRSPDKIRGAGFVSARLSLIERVNDRNWSLHVIGPAASG

SEQ ID NO: 114672 - protein, 158 aa, Glycine max
  Coding DNA Sequence Number=SeqID_22987
GYTPSSFADLVFVGEMIEVGLKRGKSDHHALINEKTGANEEGENERETHVATAVPTWPSFPPIQQCHYSAKNKPSPYPPSSYPQRPSLNQPQSMSTTLPMTNTTFSTNQNTNQEMKFAAKKPVEFTPIPVSHADLPPYLLDTAMVAITPARFPQPPFF

SEQ ID NO: 114673 - protein, 84 aa, Glycine max
  Coding DNA Sequence Number=SeqID_22988
GYLTPPPIYSKIGEELATQLAQASNVASSRSNSLLEEGSGRPKSRDFIYCATKDAKSLKAANQRDKIVLSNSQIPRQVQDRDES

SEQ ID NO: 114674 - protein, 213 aa, Glycine max
  Coding DNA Sequence Number=SeqID_22989
  Subcellular localization annotation: CTP_CleavageSite=100; ConfidenceScore=5.85e-01
MVSLATPKALKTQGPPLVSLTSLSNPRSTLGKSRISKGLSIPRSVLGESCFSTSSSNPRFALGESRFPKGSQNPRSILSESRISKGSLNPRSVLGLSNPRSALGESHFSKGSQNPRSALGESHFPKGSQNPRSILGESHFYKGSQNPRSTLSESRFPKGLQNPRSALGESLISKGSSNPRFVLGESHFSKGLQNPRSILGESHRLVKPKVHPW

SEQ ID NO: 114675 - protein, 23 aa, Glycine max
  Coding DNA Sequence Number=SeqID_22990
MEKNEETTMEEKGFYGGWIFELQ

SEQ ID NO: 114676 - protein, 88 aa, Glycine max
  Coding DNA Sequence Number=SeqID_22991
MPFCGRARQGSWVRFSKVERCAESPPMFICGKRRKNRRKPVIKNIPSSGVVFTLEEGISTSHVDKSGALAPTYPPSKRKSDLRSSFLR

SEQ ID NO: 114677 - protein, 130 aa, Glycine max
  Coding DNA Sequence Number=SeqID_22992
MARIAKVVKISVQELDRVKQNRNGVVGIPRRYLEEKAKALADQGEWVSFIDVLALLILGVILFQNVDGLGNLVAIDAFLAYHHSKESLLFMYGWSLTSFIMKVDPSVPCKVTVCAPRKGRKIRSNSWLVW

SEQ ID NO: 114678 - protein, 26 aa, Glycine max
  Coding DNA Sequence Number=SeqID_22993
MKKNCPRFQKRLEKKGYAKSKETSGK

SEQ ID NO: 114679 - protein, 31 aa, Glycine max
  Coding DNA Sequence Number=SeqID_22994
MSAEKYQSRFYNDRCRLLKMFDRRHPMMLPF

SEQ ID NO: 114680 - protein, 71 aa, Glycine max
  Coding DNA Sequence Number=SeqID_22995
  Subcellular localization annotation: CTP_CleavageSite=54; ConfidenceScore=5.35e-01
MCSRLVPLFPSQLEFIVATPQSSAKFVTAILFLASPLGLLFKGSWSLSSFRMCVAATLNFSLAIFAFPNSL

SEQ ID NO: 114681 - protein, 225 aa, Glycine max
  Coding DNA Sequence Number=SeqID_22996
  Homolog annotation: Hit_ID=A5C365; Match level="QueryCoverage=48%, HitCoverage=13%, E-value=1e-07, Identity=27%"; Hit description =Putative uncharacterized protein
EVKKKGEESSVEIYHQEDGQPLVVKEKCKEVSVSSKRLAKKENHFTIKTNIKETFPLRQPPHFLFCKKTLASNATPLVGLEFIPQVKKLLDEGLVRKSLNPCALLVPKIGIIRHQVPNIGGMMNVLSGATLFCKITRTPNIFMVCVHRDPLGSDQGVPMNPKRIKVIPEWPTPPSIRKIWGFHDLTNFYKGVEEKSPEFEEPRDLRSNPFQGGGNDAILPRKGIG

SEQ ID NO: 114682 - protein, 76 aa, Glycine max
  Coding DNA Sequence Number=SeqID_22997
MYPLCSQYYNQVDVRSTCTTKDVSSNVFRQRILRRVIDYTTTDVGLFSLNEDKHKSFILVRQQPVPTSSSQATCDP

SEQ ID NO: 114683 - protein, 68 aa, Glycine max
  Coding DNA Sequence Number=SeqID_22998
MGVQIAPRPTWALQNIPPEGCCFWRKQPGSPGRAGRCHNLPFGGRATRDSRDACSTKGIRAESPPTFI

SEQ ID NO: 114684 - protein, 117 aa, Glycine max
  Coding DNA Sequence Number=SeqID_22999
MPLPSPSWIFSLYDSLFGLWWDFQAADALHNPLPQHPTNPKPPGLLHKKNITSRLIQDCFNKQSFVSRFTKDQALPQNKVFPRHPRLWVMLKRVLNLNFEPVIDYQIFVIDYQQRNF

SEQ ID NO: 114685 - protein, 60 aa, Glycine max
  Coding DNA Sequence Number=SeqID_23000
SIQTSFTSSRTLFFSVQIRLKKGFLTSEAHLVRVSDIWLSANLALSAEETTASLCKLHTR

SEQ ID NO: 114686 - protein, 117 aa, Glycine max
  Coding DNA Sequence Number=SeqID_23001
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=83%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGRIKRGRVWWLRAA

SEQ ID NO: 114687 - protein, 97 aa, Glycine max
  Coding DNA Sequence Number=SeqID_23002
MYYCSFEQDNTFYFLYKEGILQDLEVTAIPEEDSSFELLVFLQDKILIQIISKTTEAEEPRRGIEDPKIGFKLIGLTIEVFTSFRLNQKFNTSLACH

SEQ ID NO: 114688 - protein, 239 aa, Glycine max
  Coding DNA Sequence Number=SeqID_23003
MRGAPTEESMSPFLVRDLGAQNSKTIQKAWETPLRKDQELRGIRNGIIGGYHEWLKVHIRGLDWLAKLKVVSEESFEAPEEDEEVQALKSELGKAKLAQGEVQVGRYTPLEQETKRARKEEYGRNKFRGALWGSNSELKLRREERDQSRAHSMVLKEELIACSRSKRSLSQRLCETETNMLAIIAKYQEELGLAMAHEHRIADEYAQVYAEKEARGRVIDSLHQEATMWMDRFALTLNG

SEQ ID NO: 114689 - protein, 105 aa, Glycine max
  Coding DNA Sequence Number=SeqID_23004
MLAIISKYQEELNLATAHEHKVANEYAQVYAENEAIGRVIDSLHQEATMWMDRFALTLNESQELPRLLAKAKAMADAYSAPEEIRGLLSYCQHMIDLMAHIIRNR

SEQ ID NO: 114690 - protein, 115 aa, Glycine max
  Coding DNA Sequence Number=SeqID_23005
  Homolog annotation: Hit_ID=A0PAV3; Match level="QueryCoverage=33%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIRVVLSTVRVTSTQGEGV

SEQ ID NO: 114691 - protein, 340 aa, Glycine max
  Coding DNA Sequence Number=SeqID_23006
MAKFDPDIVLEFYANAWPTEEGVRDMRSWVRGQWIPFDADAISQFLGYPLVLEEGQECEYGQRRNWSDGFDEEAITHLLCIPGQDFARTAAGRRVRIMHTNMTTLTQIWMTLLLNNIQPSDHNSDLPLPKCQLVYTILTWMSIHVAQLIADAIYLFAGMAPTRHPLDPDKSNRAMGFPALITGLCQSFGVPVAPSKVIQPPITRAFIEKYCTQRQAQGDVSQAADAPPPHQAGPAGSFDTEQYLRHLVRQQAANHRAHVQTHDCLYQMSLSLQSQGFTSFLCPTPDQFRAEVAWPGDWPEARAGEAPAEAPAEAPDEADEAREDEEMTDLLDFLGGSGAT

SEQ ID NO: 114692 - protein, 228 aa, Glycine max
  Coding DNA Sequence Number=SeqID_23007
MTPAEARNLIEKMASNSQQFSARNDAIVIRGVHEVATNPSASSETKKLEGKLDALVNLVTQLALNQKFVPVARVCGLCSSADHHTNLCPSMQQPGAIEQPEAYAANIYNRPPQPQQQNQPQQSNYDLSSNRDNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQ

SEQ ID NO: 114693 - protein, 162 aa, Glycine max
  Coding DNA Sequence Number=SeqID_23008
  Gene Ontology: Mol. function=DNA binding; Cellular component=nucleus
  Homolog annotation: Hit_ID=A7QAD6; Match level="QueryCoverage=82%, HitCoverage=6%, E-value=3e-33, Identity=58%"; Hit description =Chromosome undetermined scaffold_70, whole genome shotgun sequence
MGMTEQLPTILNCDFIERDHAKKRLDSHHFEPNGSSGLYGQHSVKKLKPTKQSLDNFDNVAPIANSIPSPAASQMSNMSSPSKFIRIISGGRDRGRKAKALKVSVGQPGSGSPWSLFEDQAVCCSIALVVLVHDMGPNWELVSDAINSTREGFRSYDLTRMT

SEQ ID NO: 114694 - protein, 149 aa, Glycine max
  Coding DNA Sequence Number=SeqID_23009
  Subcellular localization annotation: CTP_CleavageSite=53; ConfidenceScore=5.24e-01
MTMQNMQFQQETRASIQSLTNQMGQLATQLNQQQSQNSDKLPSQAVQNPKNVSAISLRSGKQCQGPQPVAPSSSANEPAKLHSTPEKGDDKNLPNNFCAEAAHSPSSIPSKSSFQQKMEEAEKEILEMFRKVEVNIPLLDAIKANSKIC

SEQ ID NO: 114695 - protein, 73 aa, Glycine max
  Coding DNA Sequence Number=SeqID_23010
ERKDIELVNEEEAQIGADRSSATSNKSEIYKEEARNAVQKHKPKRVESVNVDAEAFGDDWKIQTALCILKLNQ

SEQ ID NO: 114696 - protein, 95 aa, Glycine max
  Coding DNA Sequence Number=SeqID_23011
  Homolog annotation: Hit_ID=UPI0000ECBAF8; Match level="QueryCoverage =45%, HitCoverage=50%, E-value=1e-17, Identity=100%"; Hit description= UPI0000ECBAF8 related cluster
GRHRGGAPIRPIVSRITIHWPSFYNVVTGKTLALPNLIALQHIPLSPAGVIAKRPAPIALPTVAQPEWRMGRALVTATLASADVRRVLLPLRHHP

SEQ ID NO: 114697 - protein, 177 aa, Glycine max
  Coding DNA Sequence Number=SeqID_23012
YPMRGAPTEESMSPFLVRDLGAQNSKTIQRIHKAWETPLRKDQELRGIRNGIIGPPPRLTERSSEEILTIARGVHRSPTCSKASYGKQYYDQAFEKLQVCRVYGEENAISTARVSPLFEQELTNCGRKDSAREACLSVVVDRDLADNIVAIILANTTARVWSSCTGHEHIERDLSMP

SEQ ID NO: 114698 - protein, 173 aa, Glycine max
  Coding DNA Sequence Number=SeqID_23013
MGIGEKLSFGGCFHPCWGGGDRVGISFFFSSPTTGALLLLLGAVLEAYSNLPFLSPDSILSSGEDEIRKVSWRVAYQLFIVERRQRIYHDCDHLPLHHGRDDLGCEIPPPLGIFLNGLMFLLGHSLNPPPHNRSHIRIVLVLPLKAVAKSFHDRIWVASRLVYHATAAPAKLS

SEQ ID NO: 114699 - protein, 170 aa, Glycine max
  Coding DNA Sequence Number=SeqID_23014
MDSQRFEAMLQSIHQGQIILLQSLQVVVPPGSIPSIEKFLKRVAWIGAQPSLHREDEGPTTQVPQHVEDASSVAIVPEPFIVEEEAGETQVIQEAVATPERSRKGTSDPPTPVVDLSSPQHTADPSTPILEISEDPTTPVLTLNTSPPTTPVLYLIDKEDVQTQDTQDQS

SEQ ID NO: 114700 - protein, 48 aa, Glycine max
  Coding DNA Sequence Number=SeqID_23015
MNSLPSAVRLSSTVLFGAPLIDCLALFMCPPLSSAEPPKKKKERRKSS

SEQ ID NO: 114701 - protein, 244 aa, Glycine max
  Coding DNA Sequence Number=SeqID_23016
  Homolog annotation: Hit_ID=Q2HW90; Match level="QueryCoverage=72%, HitCoverage=40%, E-value=3e-18, Identity=33%"; Hit description =Putative uncharacterized protein
MGQLQQQAFRKAYGKIWDLARVEVSMEPIASLFQYYDQPLRCFTFEDFQLVPTVKEFEEILGCPLGGRKPYLFSGFYPSTTRVAKYQGSVWRNGQRPWKIKANGLSFIDILALLIFGVVLFPNMEGLVDLAVIDAFLAFHHGKESPVVAILAMYDTFDRGCEKSDTRIFCCALALYVWLVAHPFLQEGRPIYPLQGHRSCVEKGKANWDQLLASMEGRLLIGSLARRKEESGFYLHAKDVQMFS

SEQ ID NO: 114702 - protein, 70 aa, Glycine max
  Coding DNA Sequence Number=SeqID_23017
MPNKNTNHSVPIPHKGHQPHLGHTPFVQPVGEAREEPRNHALGGFAPYPTYAAEGPQFSGMPQPNAVGAP

SEQ ID NO: 114703 - protein, 96 aa, Glycine max
  Coding DNA Sequence Number=SeqID_23018
MSPPPLEPHNHSQTHLMLSDGGLVGACALSATLARLAPISEFWLNAILFAQWMDSSGALSEHAQLILLLDSSSRSAKGVLRSADGSLSQQIGLASR

SEQ ID NO: 114704 - protein, 81 aa, Glycine max
  Coding DNA Sequence Number=SeqID_23019
GPTTSLEKHITGDASKFTHISPKKSGHVTYDNNNKGRILGVGKIDDVSESLEEMHIHEEDHKGKGDGNNEDFQTNAYLPRE

SEQ ID NO: 114705 - protein, 255 aa, Glycine max
  Coding DNA Sequence Number=SeqID_23020
  Gene Ontology: Mol. function=nutrient reservoir activity; Cellular component=extracellular region; Biological process=cell wall organization and biogenesis
  Homolog annotation: Hit_ID=Q9SC38; Match level="QueryCoverage=47%, HitCoverage=61%, E-value=7e-47, Identity=78%"; Hit description =Germin-like protein
  Pfam annotation: Domain name=Cupin_1; Domain location=1-113; Score =34.0; E_value=5e-07; Accession=PF00190.13; Description=Cupin
MLPKGLNAPHTHPQGTMILIVLEGTLYIGFVTSNQDGNRLFNKVLNMGDVFVFPIGLIHFQLNVGYGNVAAIAGLSSQNVGGITISNALFKANPPISSEVLTKAFEVDKSIIDYLEKKSCKDVYMAYLPPAHVFEMATEFVMLVIGCAISYNSIMTLTNSSITNAILPPRTLDKRLQEDWAKDVREGPRVLMSLRWRLQSPFLLLYSAAIDLQEAKDFIGEEDPRPTSFTWSYINYYCLALYFGKEEEHSLCCSS

SEQ ID NO: 114706 - protein, 226 aa, Glycine max
  Coding DNA Sequence Number=SeqID_23021
  Gene Ontology: Mol. function=aspartate-tRNA ligase activity; Cellular component=cytoplasm; Biological process=tRNA aminoacylation for protein translation
  Homolog annotation: Hit_ID=A7QH36; Match level="QueryCoverage=19%, HitCoverage=9%, E-value=9e-13, Identity=77%"; Hit description =Chromosome chr3 scaffold_95, whole genome shotgun sequence
  Subcellular localization annotation: CTP_CleavageSite=79; ConfidenceScore=5.70e-01
MASRTETSSPWRSSRAPRGFSPSRANGSRNLTILVADLLTNAMTTFRHRARMVSSSPSQITSPGWTNYANSVSPSFTVRSNAVTFPIYKSPQIKKTPHNILFFSGFRSNFGIVHKWFFAVTVVVFAIGGQFTNLIEAYYIDCIFFFIITEALISCYYSLPNSKVGRCFRDEDLRADRQPEFTQLDMEIAFTPYKDMLMLNEESIRKSPVDGKPMLLTPEESIFKSK

SEQ ID NO: 114707 - protein, 360 aa, Glycine max
  Coding DNA Sequence Number=SeqID_23022
  Gene Ontology: Mol. function=nucleic acid binding; Cellular component= intracellular; Biological process=regulation of transcription
  Homolog annotation: Hit_ID=A7PWB2; Match level="QueryCoverage=75%, HitCoverage=77%, E-value=1e-105, Identity=68%"; Hit description =Chromosome chr8 scaffold_34, whole genome shotgun sequence
  Pfam annotation: Domain name=zf-C2H2; Domain location=215-237; Score =15.5; E_value=0.2; Accession=PF00096.17; Description=Zinc finger, C2H2 type
  Pfam annotation: Domain name=zf-C2H2; Domain location=287-309; Score =23.3; E_value=0.00093; Accession=PF00096.17; Description=Zinc finger, C2H2 type
  Pfam annotation: Domain name=zf-C2H2; Domain location=313-338; Score =1.6; E_value=7.6; Accession=PF00096.17; Description=Zinc finger, C2H2 type
  Pfam module annotation: Pfam domain module=zf-C2H2::zf-C2H2::zf-C2H2; Domain location=215-237::287-309::313-338
  Subcellular localization annotation: CTP_CleavageSite=62; ConfidenceScore=5.33e-01
MADPYSNFFSPLGSNFFHYPSPSPSSQHHHPYAHNFLNQNGSNIINNNHNTFFHFHNFQTTICSSFSSSSSPPSPPLRVALPLLTLSPKNEEEQEEDDDQEQDQDHEILQDNFCTAMDVEENYNNNRTLLHHLHPKEEEQDQEDGPDETVTVALHIGLPSPSAAEIASVLSSACSTDQEQQQQQQQQDGFLSNRLNKGQYWIPTPSQILIGPTQFSCPVCCKTFNRYNNMQMHMWGHGSQYRKGPESLRGTQPTGCRNNIDHPRAKPLKDFRTLQTHYKRKHGIKPFMCRKCGKAFAVRGDWRTHEKNCGKLWYCICGSDFKHKRSLKDHIKAFGSGHAAYGIDGFEEEEEPASEVEQDR

SEQ ID NO: 114708 - protein, 103 aa, Glycine max
  Coding DNA Sequence Number=SeqID_23023
MKKILGLQAPMELASNVRKKAQAVQKQNTAPHVMSRGGYEYLEKKLMDEKRKKKLEEATQSGSTDTIIDPPSPIKRHVKWKLARTKKTGDMTSEAAKEIADKI

SEQ ID NO: 114709 - protein, 142 aa, Glycine max
  Coding DNA Sequence Number=SeqID_23024
MDSQSEPTDVQIGDRLEDMIRDLGQESFQQAHAPMYDTLQSDLKKALYPRCKKYLTLLSVVLSLLHITSSGGAKSSLHSTLNANIALARDKSNFKGRVSNLEKKISGLEMHTIDAKPLVKVNVEEVGWLWVASSFVVSMCRP

SEQ ID NO: 114710 - protein, 265 aa, Glycine max
  Coding DNA Sequence Number=SeqID_23025
MHCRGGLFAIHDYRHGGCCGATTKELDEDQWIYESIMSKEVNMNEDNGEEPSVFKNIDCFDAFNTSQVFATHEDVLQLTRTIAYDIGFVAVITRSDNDTGKRERTSFILIGCERSGKYRAYKKDLEHNANSCTTMKQVCNARYAYHSSIRGSNNEMQQLMKLLERDQYIHWHRLKDEDVLHLPIWRENVETILSGLLNGFEFHIDKKLKAKCKTLVGQKNAWDYVMEAWGSLVDCPTELEYDDGPMKFEIDCSSWPMFVDYVKQT

SEQ ID NO: 114711 - protein, 176 aa, Glycine max
  Coding DNA Sequence Number=SeqID_23026
  Gene Ontology: Mol. function=DNA-directed RNA polymerase activity; Cellular component=cytosol; Biological process=transcription
  Homolog annotation: Hit_ID=Q9SVY0; Match level="QueryCoverage=61%, HitCoverage=6%, E-value=1e-44, Identity=78%"; Hit description=DNA -directed RNA polymerase I 190K chain-like protein
  Pfam annotation: Domain name=RNA_pol_Rpb1_4; Domain location=1-88; Score=79.4; E_value=1.2e-20; Accession=PF05000.8; Description=RNA polymerase Rpb1, domain 4
  Subcellular localization annotation: CTP_CleavageSite=32; ConfidenceScore=5.16e-01
MTSNLNSRTSSGILKKLLSEGILKPSGKNCISLMTTSGAKGSMVNFQQISSHLGQQELEGKRVPRMVSGKTLPCFPPWDCSPRAGGFIIDRFLTALHPQEYYFHCMAGREGVGSSTAWLECLSIGIKAAAEMLALKGGAMIGTWELWGTWELWGADVAHRVVWDAWWGIKCLVLPP

SEQ ID NO: 114712 - protein, 187 aa, Glycine max
  Coding DNA Sequence Number=SeqID_23027
  Gene Ontology: Mol. function=DNA-directed RNA polymerase activity; Cellular component=cytosol; Biological process=transcription
  Homolog annotation: Hit_ID=A5BD07; Match level="QueryCoverage=80%, HitCoverage=11%, E-value=7e-49, Identity=64%"; Hit description=DNA -directed RNA polymerase
  Pfam annotation: Domain name=RNA_pol_Rpb1_5; Domain location=8-187; Score=-82.4; E_value=1e-05; Accession=PF04998.8; Description=RNA polymerase Rpb1, domain 5
MTSLLRRLVDTAVKTSRSGYLQRCLMKNLECLKVCYDHTVRDADGSIIQFHYGEDGVDVHQTSFITEFGALSTNKELVFSNYCRQLDRSSPYINKLPEALEGKAEKFSKQRNLGSMEQADFLRLMEHKYVSCLAQPGEPVGVLASQSVGEPATQMTMFVRAFTPSNFVSQSFPNSIAEMLDDSNYLH

SEQ ID NO: 114713 - protein, 334 aa, Glycine max
  Coding DNA Sequence Number=SeqID_23028
  Gene Ontology: Mol. function=helicase activity; Cellular component =chromatin; Biological process=protein amino acid phosphorylation
  Homolog annotation: Hit_ID=Q2A9E0; Match level="QueryCoverage=69%, HitCoverage=15%, E-value=2e-70, Identity=56%"; Hit description =Putative uncharacterized protein
  Pfam annotation: Domain name=DUF889; Domain location=205-332; Score =12.5; E_value=2.5e-12; Accession=PF05970.5; Description=Eukaryotic protein of unknown function (DUF889)
  Subcellular localization annotation: CTP_CleavageSite=51; ConfidenceScore=5.09e-01
TYQGNPCGVYPDLSFFTGSGVYPDLSSLTRSGVYPDLSSFTGSGVIQTFIACIKRSAPTQVHIIWSGTMNEPEQAVNKNEGEMFFLYGYGGAGKTFIWKTLAASLRADNKIVIMVASSGIASLLLPGGKTTHSKLKIPVPIFEDSTCNIHQETQLAELLNEASLIIWDEAPMAHKFCFEALDQSLRDVIKAKSSSDKIFGGKVMVFGGDFRQILPVIPRGSRSDILNATINSSYLWNHCHVLTLSKNMRLEANIDATDREETSAFAQWILDIGDGIVRQQNDGYGSIEIPKDLLITEYNDPLYAINVYVSFTIPMAFYAFEKTVPNNAFLCNDN

SEQ ID NO: 114714 - protein, 119 aa, Glycine max
  Coding DNA Sequence Number=SeqID_23029
MENHRFISKSDSAKARSNRKCIRQQKVHVNPQNSVNPVSSHTEDHYNQPKTPPHSVHATVNWASDDAEDHFNVSGSSENESSGSTEVGYPNCESSHHDSTMDTGDIPVKIKLSMVTVMV

SEQ ID NO: 114715 - protein, 246 aa, Glycine max
  Coding DNA Sequence Number=SeqID_23030
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=100%, HitCoverage=20%, E-value=1e-39, Identity=37%"; Hit description =Putative uncharacterized protein
MASSGPVFSFFGTPTISTAKLNWKNYPSWSASVELWFLSQGHHDHLEKASDSIPNDKRPEWEKLGYQLCDVLWQSVEPDILDILRSFKTCRSFWKKAHEIFANDIQSLFDATMKVTTLKQTSHDMIAHVGKARAAVEELRKFLVADSLEEVNRKLDKFYMVLILRSLHSDFDHMRDQVLAGDQVPSMDFLITRFLRVPHVSKDENPAEGVETSAMVASHGREGGRNSRGGRSGRGECLHCTYCKRM

SEQ ID NO: 114716 - protein, 43 aa, Glycine max
  Coding DNA Sequence Number=SeqID_23031
PVSRGFAFGYNHHPVAAIEFHATTSDSDSSSSSVIDLNHTESE

SEQ ID NO: 114717 - protein, 59 aa, Glycine max
  Coding DNA Sequence Number=SeqID_23032
MTRKPRQDFNISKENSEAFLPLSLVAILSSSSTIEAPSKLQPLHTFSAPNRKRKPFPES

SEQ ID NO: 114718 - protein, 123 aa, Glycine max
  Coding DNA Sequence Number=SeqID_23033
LFLSTKFRALLSLSLHSSPSSSKLLSMASYGEAKESIDEEDPRLTSSNGACISLRVPTDLIVSGRQKGVWMTIISLRMPIDLIVSGRQKDADDQGADGHNLSLRANGLDCLWMAKEALIVFEK

SEQ ID NO: 114719 - protein, 333 aa, Glycine max
  Coding DNA Sequence Number=SeqID_23034
  Gene Ontology: Mol. function=nucleotide binding; Cellular component =cytoplasm; Biological process=response to stress
  Homolog annotation: Hit_ID=Q2QZ41; Match level="QueryCoverage=44%, HitCoverage=33%, E-value=3e-30, Identity=40%"; Hit description=Heat shock cognate 70 kDa protein, putative, expressed
MAASDHARPHHPPAHLFPLHSLHTAIHQQLPLSDPSLPFQHTSSPYVHPAQSLGIDFESTRIRLLALCGTTTLQTVQTMPTLPSMDFAVPTETLEHQNTSTSSTIHLPANSKPHMPMPSKEDDPPSNVIVRATYPCIGVWQHDCVESMANNQGHRTTPPDVPFLDTEQLINVAVKDQAAKHSTILMKMKEIAEAYPETTIRNMVVPVPVYFNDPQRQTTKDVSVIYGLNVMRTIHVSTTAAIVYGLDKKAINYAEKNIFIFDPGGVIHGLTSLFALCRRNLAVVMATGAQTSNFTHIPIFSTPTPCICLFLLPNIKDKDIPFFGQLSTVVIAN

SEQ ID NO: 114720 - protein, 112 aa, Glycine max
  Coding DNA Sequence Number=SeqID_23035
MHVGVEGVTVHVDPTIGKVDGPHRKKLRTYLGIFAQDRVDITFANWKKAPTTQKDLIWEDIQFKSILTSKWALAQGKEGEDDKVCEKYDISKEKWNQFCQSCKDPLLDFPCC

SEQ ID NO: 114721 - protein, 124 aa, Glycine max
  Coding DNA Sequence Number=SeqID_23036
  Homolog annotation: Hit_ID=A5B592; Match level="QueryCoverage=61%, HitCoverage=7%, E-value=2e-08, Identity=31%"; Hit description =Putative uncharacterized protein
MPYFGVIEEIWELNYAKFSVCVFKCKWVDSDIGVQTDPCDEKWSVVLHEKTIGINVEHDDSTVDTCVSPFFIQMPSNHMATPPSSPPPPELSTPSPSTRRRQEKQHDSDRWLPDLLGWRDQCFM

SEQ ID NO: 114722 - protein, 62 aa, Glycine max
  Coding DNA Sequence Number=SeqID_23037
MELCIELLQLIIPKLMGKRRKLKLQELEDIRLEAYENSKMYKERVKRFHESTNLSFFMRAPK

SEQ ID NO: 114723 - protein, 84 aa, Glycine max
  Coding DNA Sequence Number=SeqID_23038
MAELVNRRLWLAISEACVLSENHPLSEAFSPLSELGESGGESVKHLHAQCVISSLNESFVFSCAKCAQLTQRKITNSRSERKWR

SEQ ID NO: 114724 - protein, 206 aa, Glycine max
  Coding DNA Sequence Number=SeqID_23039
  Homolog annotation: Hit_ID=A5BLQ0; Match level="QueryCoverage=85%, HitCoverage=33%, E-value=5e-31, Identity=48%"; Hit description =Putative uncharacterized protein
MVGSLHPRPIATFHFLSPHSAVVAFCEEILKHGTAWEALRGDLAAQKAEMTLEEERAATEYKYIDFGSTITYGSYSVHSLRDGSDYQQKIKGRESKVVIWTRRNPREIYFRKFASWILSSQDHSYSLLNLVIMSPNEAGSPVYDDGYIPKHSVLELQKAWPGSEVRWVTGGHVSSFFTMVNLEGLLSTALIDYRGRSLHCDRDIAQ

SEQ ID NO: 114725 - protein, 110 aa, Glycine max
  Coding DNA Sequence Number=SeqID_23040
MTLRSGGERALGGYLAIGAGLELDKVLVLVSLHLEVEDLGVTGGGGGDEAGVEELEDYVADVGELGLDLGAVVTDDGDVVLIVATSASSKGSKYGGQGAVEGSDGACGFV

SEQ ID NO: 114726 - protein, 139 aa, Glycine max
  Coding DNA Sequence Number=SeqID_23041
MYQMAEPSKRKGSTSTTTAIGQHRHDTFDDPPTPPNPSLSLPHSLTLFASNEQRQRYRKDMDCQWVPKQDLPPLISDERTPSPPPQRDSSSSLLNDVLTELRDLQEFVGNHFDAMDSQITHLEDDMRFIRRCFDPPSDP

SEQ ID NO: 114727 - protein, 219 aa, Glycine max
  Coding DNA Sequence Number=SeqID_23042
MGYTPTWKMPNHIGNEESPKCNGSLEASQMRRSFLIAEGNIGNTTCLVKTEEHQKPSTSGSRNKISGDGEGPNGIALAQSLRFGFKVTCNQAEYEALLDGLRLAKEVSGQRVQCQSDSKEEFEEVQSQALLANFEDELLKLCKKMHLMPKAWKFDTLVNQRITSHGLPMVVCYLGNVNSDANPRVTLKGETYPSARGDARLKGASSKEGKCVEPPPTFI

SEQ ID NO: 114728 - protein, 171 aa, Glycine max
  Coding DNA Sequence Number=SeqID_23043
  Homolog annotation: Hit_ID=A7Q5C4; Match level="QueryCoverage=46%, HitCoverage=10%, E-value=4e-07, Identity=43%"; Hit description=DNA -directed RNA polymerase
MTPSLPKIFLPSPPEALLVLLDGSIVSCIASNEVEKVVAHIRELKVPSAIVTALRPSIEPFSIEPYRQPCNLLLNPSPFSFDCYEPYLLFQFQALKPIDIEPLPLNLIDKEALHIEVDEVQSSRLALAVKLRRYGVVREARSRGRRVQLTELLLKKLEPCLLGCKRVSGHF

SEQ ID NO: 114729 - protein, 307 aa, Glycine max
  Coding DNA Sequence Number=SeqID_23044
  Gene Ontology: Mol. function=oxidoreductase activity; Cellular component=cytoplasm; Biological process=gibberellin metabolic process
  Homolog annotation: Hit_ID=A7P7J0; Match level="QueryCoverage=100%, HitCoverage=100%, E-value=2e-96, Identity=56%"; Hit description =Chromosome chr9 scaffold_7, whole genome shotgun sequence
  Pfam annotation: Domain name=2OG-FeII_Oxy; Domain location=164-265; Score=78.9; E_value=1.7e-20; Accession=PF03171.11; Description=2OG -Fe(II) oxygenase superfamily
MGSEGKPMLPVLDFTIEDLKPGTNSWLSTCTSVRQAFEENGYFVAVYDKASIELQNGVFGSMKELFDLPTETKRRNIFEGMPLKGYVGQHPKIPLHESMGIDPGTTLEGIQSFAEKMWPHGNDQFCKYIFEYAKVAEVLNRMVVRMIFESYGLLEHYDTFIGSTNYLLRLLAHKALEQNEPQLGFVAHTDKSFTTILHQNHVNALMVETTNGNWIDVDFSSPTSFVVMAGDALMAWSNDRIKSPNHMVMMNGNETRYSLGLFAFYRGILKVPEELIDEEHPLQYKPFDHLALLNFTYSANMKAYCGV

SEQ ID NO: 114730 - protein, 199 aa, Glycine max
  Coding DNA Sequence Number=SeqID_23045
  Homolog annotation: Hit_ID=Q84VH5; Match level="QueryCoverage=79%, HitCoverage=42%, E-value=2e-24, Identity=77%"; Hit description =Envelope-like protein
MWKFVYQRRLALERELGRAALDCKEIMDLIKAAGLLKTVTKLGDCYESLVREFIVNIPSDITNRKSDEYQKLMLLVLSIKLPRKRESPLSLHYKLFEGTHVPDIVSTSGKAAASGAVSKDALIAELKDTCKVLEATIKATTEKKMELERLIKRLSESGIDDEEAAEEEEEAAEEEDDAAEEEEDAAEDTESDDDSEATP

SEQ ID NO: 114731 - protein, 183 aa, Glycine max
  Coding DNA Sequence Number=SeqID_23046
MAQIISNYEGEARPGKLELTLDDLQLGTEQIVNGRPSIPWIPMEMELSNRKGSPRMNLWFVEPWTRDVFALGFVKLVELRRGLPRTGLGFCELVRITKCGAWDSPRPDLEFCEPFGGLTREWSDQGFGCRALAYMPLAIGGTYWRRSGMLLHTCHSSWVACTGVIILCSCVHLTHYGWHVLET

SEQ ID NO: 114732 - protein, 121 aa, Glycine max
  Coding DNA Sequence Number=SeqID_23047
MWTKERLIFLLSWDFGIELAHTCDCPKTVRFALARLRRKLIRPGARGRCPKTIDSKGSLRYINSLGHQVSVGLTDCHTLISSGDHRLVACNFRLTTSRYLVPIVRQFVKFRDMTEAKRKAL

SEQ ID NO: 114733 - protein, 87 aa, Glycine max
  Coding DNA Sequence Number=SeqID_23048
  Pfam annotation: Domain name=zf-CCHC; Domain location=67-84; Score =34.2; E_value=4.8e-07; Accession=PF00098.14; Description=Zinc knuckle
MIRCDYWRYSLKIFSEEEEEEEEEEYDDEEDFSLFVKKFHKFIKNRRMERSHNFNNGKRSQEVSPTLKCYKCNQPGHIKANCPSNES

SEQ ID NO: 114734 - protein, 292 aa, Glycine max
  Coding DNA Sequence Number=SeqID_23049
MEFGLRHQETPSRVTFLEVEVSKWRATAPTVWRVDHPKVASATIAFAEIVRSNHQLSSKVGSVLANLLCTRLDDDELFKCCKDLQEEKKDLAGRVEDIATEKDELAKKVADLKAQLKESESRLEEFALRTAREREDGKELEEKLLIYMKKAIEQHEKGFNKAVRHTEFFVKDLDLGLFDPFKDVKDNVLLDKEEIVMKEEAFGEEQGAEEKQDLVDVEVGPWWSSSPLMLLRSMFDLPLVEGLANQSEDRLLDLLSFSSDGYEDMVVVHFVELGPLTVVVVVAANKQAMGMP

SEQ ID NO: 114735 - protein, 370 aa, Glycine max
  Coding DNA Sequence Number=SeqID_23050
  Subcellular localization annotation: CTP_CleavageSite=51; ConfidenceScore=5.44e-01
MTEPSKKRKGVATSSAVTGTQSHGTSKVQTSQIPSSISSPTLFSIEEHRIRYNSLFSSHSIIDPKFVDLAFFDDEVSDCFQAFQNSSLIQFISMKLPFYPELVKDFYSNLEIQEDSLISEVYGIKMIIDQSLFFDLTQLSSDGVSFEGSFDDEWKFDFSMSDSLQMFNVPLDSEPFVKVKRSFSIGANVVSSFGYRKERDGSWVKKDAPVQAAKDHSPSPYSQRDDSSSLMNNILERFNGLQTYVGERFDSLECQVDTRFEEMNSRIAKVEEDDCHHKKEGDCGSNNFQDYFDDAKESRVKQVPKNQESKSFKNQVSKNQDSRIIKFQDSIKFQESRFKNNQDQDSRLKIQESREDSIKISTKKAFQNIE

SEQ ID NO: 114736 - protein, 116 aa, Glycine max
  Coding DNA Sequence Number=SeqID_23051
MNFLLKCKTRNMDSTLRRIKCTNNLKTLDEEQMKNPSVERQWILEDEGSHSEHFDIYIAYFRKRAPMGVEKREELEPERRHANRGRILASKKVQFFLLVAEYEVTSREKGGPFCST

SEQ ID NO: 114737 - protein, 66 aa, Glycine max
  Coding DNA Sequence Number=SeqID_23052
MQVNKPPMKGLYDLDLWPLFFANTLLLTDNVIVLLLALCQSPFGGYWIEDSKKIGPEMQEKALGFL

SEQ ID NO: 114738 - protein, 245 aa, Glycine max
  Coding DNA Sequence Number=SeqID_23053
DCFFKVLAADVVADGLPLMIDKAILEQLPTSLYARAILSLPSADDPFAALDGIMGGFSWRLLVKQDGPAGRTMALFVVIPVAEVGPTIDVAKVTPGVPSSILAKRKRDNDAWVSGLSIPVAAIVVPSPPPPSTMLFQEVASVAEVSALATLVGPVVAPTSIVIAPLLSVSVTTTSAPEMSYPPSLARRGCYSLWGVGYKLDQKTPVGFVSTFNKNLIRSVRVQNATNSAKIFLQRSLAILKENEQ

SEQ ID NO: 114739 - protein, 330 aa, Glycine max
  Coding DNA Sequence Number=SeqID_23054
MIPVEVKEPLTRRLLFQQQQNKENMRIELETTDEVQEMAIIKEEVTKLRASRRYNTKRLVKPKVRPCSRGSSNPRFILGESHISKGSSNPRSTLGDSHKLVQPKACQTQGLPLVSLTGLSNPRYILGESCISKGSSNPRSPLVSLASPKAHQTQGPPLVSLASPKARQTQGPPLVSLTGSSNPRFVHGESRISKGSPNPRSVLGESRISKGLSNPRFALGESYRLVKPKVCPGESHISKGSSNPRSALGESHFFKGASNPRFTLGESRFSKSSSNLRSTLGESCFSKSSSNLRSSLGEPRHNSTGLLNSWSSLGEPRQNPGRTCFLSKAR

SEQ ID NO: 114740 - protein, 99 aa, Glycine max
  Coding DNA Sequence Number=SeqID_23055
MESDDEWITEEGDDIFDEDNLQVEQEQPLGENGSGSNIDLVGGSLTDPTLDAFDIDNLVLNENVEDHFSTEEELEDDGDEDNGGDGDIGDDFIRGLMDI

SEQ ID NO: 114741 - protein, 300 aa, Glycine max
  Coding DNA Sequence Number=SeqID_23056
KGYIQMEEMFRFKNEPDKCQPLPKGPMYERYTPLTANCTTILEEAFNAEELDLEDIKRIDIGITTQTKEGIEQKIEEDRDTTNKDVIDNLRKNEKMSLPSKSESSQSRKHHLHAIRDIDINYVNTPSPQSLPSITFTDRDFKGINPINQDDPIIANFMVHRLHTASEDEVPHLDGKDRDYQGRSKAGTKVLHRKPESGTHPPTREPAKSHPIANDTTQVKSVDKGSPVRALTVYQASLDNVFDVHPHNDTSNKGPKPIEELVKLQLKLKPGFDDNKGDDKKLKGQEHFMITKMMISRIKE

SEQ ID NO: 114742 - protein, 96 aa, Glycine max
  Coding DNA Sequence Number=SeqID_23057
MGKGVRVRASGGFEVRGKIEIWENIVVDEVIVKMGVVIGINKGRVREVEIGGVDERREVEASVTIMVETRVGLVWMAKVVEGSLDLRLATNVVMEA

SEQ ID NO: 114743 - protein, 157 aa, Glycine max
  Coding DNA Sequence Number=SeqID_23058
MTVCPNDEGRWVMKSKALSNKLFGVFVQPRPKEKSNKVSHISLDAKVSNCRSGMELMDEIMAHQGRDYEQKGNQFRDVRKSIINLVMFIRAIAYGGTGSMWVGEKLVVGVEKDERSHGCEFKANEVDRMTLVNKRNLGKGKISLYRTQDLGQHQLPP

SEQ ID NO: 114744 - protein, 95 aa, Glycine max
  Coding DNA Sequence Number=SeqID_23059
  Homolog annotation: Hit_ID=A7PX93; Match level="QueryCoverage=62%, HitCoverage=10%, E-value=2e-08, Identity=44%"; Hit description =Chromosome chr12 scaffold_36, whole genome shotgun sequence
MVWLMSTCYINSTTKDFASNPMSIKDVDVYNGKVSEDTLRFGAPWRHRPQIDDPKLCMEWAKVYVENNSSPTLTESNFTLEYISERQSLSLEFKG

SEQ ID NO: 114745 - protein, 140 aa, Glycine max
  Coding DNA Sequence Number=SeqID_23060
MAIGRDLTPTLGHIVRSEERSNIYGGDQVVSMLWQRELLQDSVFLVEHATEVERGATEGEVSMGDNSIWGIRVLVKRERVSSMQEQNKSCMCKSCVQELEKKESHEDSTSGGFNLFSVSLTFGNSIGVVGGITEGILGNR

SEQ ID NO: 114746 - protein, 69 aa, Glycine max
  Coding DNA Sequence Number=SeqID_23061
MEDDYFNQMFGEVDMDMDDTVKNEDWGVYLALASHLKEVSLAIRELLKEVFSKKLLKKVFSRKLLKEAT

SEQ ID NO: 114747 - protein, 278 aa, Glycine max
  Coding DNA Sequence Number=SeqID_23062
  Homolog annotation: Hit_ID=A7UQU7; Match level="QueryCoverage=84%, HitCoverage=50%, E-value=1e-21, Identity=29%"; Hit description=IMP dehydrogenase/GMP reductase, putative
  Pfam annotation: Domain name=DUF1723; Domain location=42-92; Score =19.0; E_value=0.003; Accession=PF08330.1; Description=Protein of unknown function (DUF1723)
MQVEPVEHVDKVQVVEEVKPDEHECGELKLVSYGRKLQSEIALHEQIHNMVKGWHKEANTFHMPVAEMTLTVTLDDVASLLGIPITGIFYNYEHMDKEVVIPMLVGLLGVEYKDERCKEERWDEATRAYLFHLVGCTLSSNKSATYVEFCWHKANWWLCHFSSRWICEHFVTIGARNDVLGYEETSTRVSRWSNKLSLSIIHYRKLIDELTIKGVRWTPYEMHKTYRSFENISLFSGYIHLGPDLHLHFPKRVLCQYEYHQDIPRHPAVLTDEIPTPQ

SEQ ID NO: 114748 - protein, 85 aa, Glycine max
  Coding DNA Sequence Number=SeqID_23063
MAETCQHLFFSCCEIKLVWEKILRWIGYVRTPTMWDDELGWIVENTKGKGCKRSLMKLVVAETVYRVWFVRNRIIFQGGRKEELH

SEQ ID NO: 114749 - protein, 53 aa, Glycine max
  Coding DNA Sequence Number=SeqID_23064
MTGTDSHTTMIDGHGCCWMGSFAPKSINFLEQTHSRVNLEYLGRVVFNTNDGN

SEQ ID NO: 114750 - protein, 176 aa, Glycine max
  Coding DNA Sequence Number=SeqID_23065
MEGSILAQKDILRVMVTSQDWTSSTYGKEVKTKKFMEQVLESGFWSKCVDVVKLLERLVRVLRMVDTQDKPVMHFLCRAMKKRQQNYDPINLETLDDHVDWVMEDSPLFLTNEEVDALGKVLANMTIQSLSNNIGPLNLDDHVGETQGNPMENMNLNESNIDHEVTMGDSSEFFNE

SEQ ID NO: 114751 - protein, 215 aa, Glycine max
  Coding DNA Sequence Number=SeqID_23066
  Gene Ontology: Mol. function=transcription regulator activity; Cellular component=nucleus; Biological process=regulation of transcription
  Homolog annotation: Hit_ID=A2Q3E9; Match level="QueryCoverage=57%, HitCoverage=37%, E-value=3e-43, Identity=72%"; Hit description=Helix- loop-helix DNA-binding
MTMFAIQISGTALVLDKIINHVQSLQNEVEILSMKLAAVNPVIDFNLDSLLATEGVTPMDCNFPPTVAPVMWPEIPQNGNRQQYQQPWQFDAFHQPLWGREEDNTNMTPENSLWSYDSSANSVLAISHDLSSLNIHQVFPVSILSEPVGKPGFYSASKEEELLQAFQMLQMMNLKRIYIKLNLFSIFLFSKMMLLSRCCLLYSLFESITLVMGDP

SEQ ID NO: 114752 - protein, 81 aa, Glycine max
  Coding DNA Sequence Number=SeqID_23067
MEFHFHVSSLSHLLPLLNNNKHHCGALAECDGGGRRQQRSAKMLQCAVAARDEKVKSGGMRDSEAKKKEGGDGEREKKELR

SEQ ID NO: 114753 - protein, 233 aa, Glycine max
  Coding DNA Sequence Number=SeqID_23068
MKSLRDSHVDIFDEITIKESIVDIKLLQVPIFYGSNGYNNMDGGHFNNKRENLQIINALNLGARISAFMASCQQGWVAASRECITRASMAFIVSKINKGLMGAMRTTERLGLLGGWGTSVSKGRRWGVSGCRSRCWNRCRGRWRSRCRSGLKRNGLGIIRLKIGVGEIKIRGVNIIGLRNSGSGINGLGTSFVVQVEGTSTWVVVTENKRGYISCGSVLVEGTSTRLFKENKG

SEQ ID NO: 114754 - protein, 66 aa, Glycine max
  Coding DNA Sequence Number=SeqID_23069
MLNPTQFQAKEEKVQVVDDSLSEWHSLSEAYNSLSRLGNPRRGSSKDVLAQHPASLPSKVVVSSRA

SEQ ID NO: 114755 - protein, 317 aa, Glycine max
  Coding DNA Sequence Number=SeqID_23070
MSTSGPVLSVSWTSSIGLLKKDCFYHACKVFEVIPSSFVSLNPLLCSSIVSWFDLVKNPILGHLLILLSRNCFLVFVLEAIAVPRVQSVLITLKSSPAASAAFVSGNSLFPSSSPATSFELGTSAPSSPPTKSAFGSTFSTSSSSTASVTSASSPSIINYIRREPFPVWQSTEFQSWVSIKQSSFTAASNLEEESFLCFSSCSNGSEGVLDLEAFKGFFVGPGFDGEIGLGVEAHAEDDDGEEAGDVAGELPVLPLAGLARGRRRPVEEVTLGPFFVARARPPARPGLRAAAGAEGLLQPPTERGGGAAQGRGRRHR

SEQ ID NO: 114756 - protein, 134 aa, Glycine max
  Coding DNA Sequence Number=SeqID_23071
  Homolog annotation: Hit_ID=A5BP71; Match level="QueryCoverage=55%, HitCoverage=19%, E-value=7e-11, Identity=45%"; Hit description =Putative uncharacterized protein
  Pfam annotation: Domain name=zf-CCHC; Domain location=107-124; Score =16.2; E_value=0.0054; Accession=PF00098.14; Description=Zinc knuckle
MKDKYIVQSLLRNLGKIKNKLVRTSFASCGYMSMNYYQYIDVVYTNEHILKAYSAQWWPLGNEAAIPPSDAAWKLIPDPTTIRAKGRPKSTRIRNEMDWVEPSEHRQKCSRCGAKGHNRRRCPMQSERGSCSNH

SEQ ID NO: 114757 - protein, 247 aa, Glycine max
  Coding DNA Sequence Number=SeqID_23072
  Homolog annotation: Hit_ID=A5ARR6; Match level="QueryCoverage=84%, HitCoverage=28%, E-value=1e-39, Identity=41%"; Hit description =Putative uncharacterized protein
MYLLELEGNDRGSRGCVVARCLIAVCNSEGHVKIYRPPFCDYCAEWIEGRQYILIWAWKNYVVDITKRLYDYFQCTEFRGTRFASLDVSDKNSSDQTDSMYEENGKLLSADQYASRSAMLCSLVVSWSPLLRLASELYPVCDSVSLLAVGGKSGKISLWRFHPPECYTIEDREVPTTVKFVGLLQAHNSWVTTISWLLFAFDSSNPQILLASGSSDGSKNIYFVLDEYQRYKITVRDAKVMVPDQTW

SEQ ID NO: 114758 - protein, 736 aa, Glycine max
  Coding DNA Sequence Number=SeqID_23073
  Homolog annotation: Hit_ID=A2Q4W6; Match level="QueryCoverage=44%, HitCoverage=49%, E-value=4e-12, Identity=21%"; Hit description=RNA -binding region RNP-1
  Pfam annotation: Domain name=RRM_1; Domain location=54-124; Score =36.7; E_value=8.4e-08; Accession=PF00076.13; Description=RNA recognition motif. (a.k.a. RRM, RB
MRESERERERERLRESKRVGETKRAREKVRMGGQGQGQSYGRANWRSRKNITSFYFTRFPDDTTEEELWYHFKVFGAVREIFIAKNRNKHGRRFGFVRFEGVENAQKLEWTLDNIVFGGLKMHVNIPKFGRNKVVKPISVTNKVRQDVHKEEAIPRYVQPISTTHHGSYAEVVARNNTGPGLRRIAGNASGHNGTSWSSVYLDIPEPLMKRAKEAWVGRLKNLAMFDRIEDDLYWDISADISPKYMGADMVLLQGLSDEGAELMMQEETEGGSTPFHSLEKWSPKLRLGYRLTWVYCWGLPLTAWDPHQIRKIVAAIGDMVDVDDAVELVRRMDRVRVLVKTPRQPYIQHAVNVHIHGEVYTVHVVEENGNSFDNCYGRKGSVYGSSEEVESDDSEVGTLNGISNIEWMAGKEVEVTAVEPNAEGQNPYSFTSTASPDFRMQGQGLHEDMMDGAPTAVTTTVGDQASLPGTQNPVGASLSSRQKKNVPPKDKAIIRCANSPTVNGQPSNSGTCPLDSVVTYLACERQGDFHEKGTAGTTGIPTSDAKDVLESGRGKLEEERQHETLETHISNSNGSCDQEGDFADGLDHAIHTPHVTHPKQNLSPPATKWQVYSRKRSSKRKSISGLTHGLNLIDEMDPEPNNQTSSQPVEGVEDNHGPEQLVSTKNNDIRPTQIQHAETDFLPSNMQEAANMWELVKSLGVTSGSSQGDPATKIMDMETRDREEAHRLGCRRVSQ

SEQ ID NO: 114759 - protein, 77 aa, Glycine max
  Coding DNA Sequence Number=SeqID_23074
MEKVKRFHDSRILRKDFHIGQKVLLFNSCHKLIFVIGKVFKVNGHQLKLLHESPQVEEEFVGDLSYLVLPILCDDVP

SEQ ID NO: 114760 - protein, 283 aa, Glycine max
  Coding DNA Sequence Number=SeqID_23075
  Pfam annotation: Domain name=DUF1723; Domain location=33-79; Score =14.0; E_value=0.012; Accession=PF08330.1; Description=Protein of unknown function (DUF1723)
MVRTRGFSRALGRVLGRALGRHDVDHVDHTADEVHEEPQKPVTDDETSIFHLPVGEVSITLDDVASLLHLPITGASLTFDALNVDQVVDLLVELLEVSTQEAKDETFQYRGAYVAHSLLTRVSHMSVWYSLTHFVTSTNLEVIHGGVDELVYIYDTLNYASKNTRKHLPGYVTLLQHFPTIASIVTDEDYHERKPHACRWKSGKTLPVLTYCKHLDRLTSDVTIPPHPAAPSLSIKEIDDRRLQFSKYHAPPRKPPRHPLVVHDDTFIVPDPPQQAVNIVAMP

SEQ ID NO: 114761 - protein, 119 aa, Glycine max
  Coding DNA Sequence Number=SeqID_23076
MAVMEYRFIGEQRGPGIRVGAIDFLKREFDGGEVAMGLGVEREEGVGDVGVGPEPGPDGEGVELGPEGGAARVGGGGYGRGEDVVVGGEGGVGVDEEFEGLGVLVGASQGCEHVVQLDV

SEQ ID NO: 114762 - protein, 140 aa, Glycine max
  Coding DNA Sequence Number=SeqID_23077
MDNMMMLQHTKIKTSFETKKVKAKGAQKKPMTMQQRSTERDLSYWEYIDALHSIQNTDGNYGYRLIVVLLDMGEDSWSLVRNHLLKELTKWSDEYMNLLDGINKFEELKRSLLVDELSMVTMGKWMNITDMRYVIASSYF

SEQ ID NO: 114763 - protein, 184 aa, Glycine max
  Coding DNA Sequence Number=SeqID_23078
  Gene Ontology: Mol. function=protein serine/threonine kinase activity; Biological process=protein amino acid phosphorylation
  Homolog annotation: Hit_ID=A7PWA8; Match level="QueryCoverage=54%, HitCoverage=18%, E-value=5e-25, Identity=56%"; Hit description =Chromosome chr8 scaffold_34, whole genome shotgun sequence
MESSGKMEDYEVVQQIGRGALGATFLVLHKIENKSSDKNGDIVSLSLCAFQMDLIAKLHYPYIVEYKDAWVEKDDYICIITGYCEGGDMAANIKKARGSYFSEERVPSSAGNRHFRPSFSPANLGFEPPWNTRPNLAGCVTIGVVTRRHAPPQLLAFSGACVSRAAVPTSEARPACSGSFVVLL

SEQ ID NO: 114764 - protein, 58 aa, Glycine max
  Coding DNA Sequence Number=SeqID_23079
MWYHGDQSGSRCFARMLQPYGINIGLKEHSNRVTPKAYTPKSPSGPLPPNSGPTQKIF

SEQ ID NO: 114765 - protein, 108 aa, Glycine max
  Coding DNA Sequence Number=SeqID_23080
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=P29685; Match level="QueryCoverage=53%, HitCoverage=10%, E-value=2e-18, Identity=75%"; Hit description=ATP synthase subunit beta, mitochondrial precursor
MAFLSLQSKPGGSRSWLSSFGSERERTGKERKGWSITLPWSRLLPLHPVQTDEFTGKGTIRQVCQVIGVVINVRFDEGLPSMMTTLEVLDHLSRLVLEVAHHLGEGIV

SEQ ID NO: 114766 - protein, 107 aa, Glycine max
  Coding DNA Sequence Number=SeqID_23081
  Gene Ontology: Mol. function=carbohydrate binding; Biological process= fructose 2,6-bisphosphate metabolic process
  Homolog annotation: Hit_ID=A7NYC1; Match level="QueryCoverage=61%, HitCoverage=8%, E-value=4e-11, Identity=55%"; Hit description =Chromosome chr6 scaffold_3, whole genome shotgun sequence
MPLEKKVPRTIENTRELGKIVCKSNDDEDARLALFRLDSGEVLEYQVFAKADKASTFDLAASWRVYQDNFCPSMRWISDVGLLPEWYSGFRLPLSLEPETLQRRKKI

SEQ ID NO: 114767 - protein, 297 aa, Glycine max
  Coding DNA Sequence Number=SeqID_23082
  Gene Ontology: Mol. function=transition metal ion binding
  Homolog annotation: Hit_ID=A5AWV0; Match level="QueryCoverage=76%, HitCoverage=14%, E-value=3e-19, Identity=28%"; Hit description =Putative uncharacterized protein
MRVLLKIKILSYWVKSQCLHLEGICINNYSFYTKSQDDKSSMRNSEWVNGNTGVQQDEMRFTLVDLDKVVYKDKSFIMAEQARQVFYVHDPCDSKRVMATPPRSPPYTSNHSECMSRRSRQSTRLSSLIVRDLDQPKPMVNINPSTGRGSGPYKEKFYNYLGVVAREKIPIVHSNWKVVPKSLKNPIWDDILGKFDIPEASNAKKMVMPSVVTGWRQFKSSLTTKYVYENNKGQDDQAPCFKYGLDPQTWEEFVASRKTPNWQNLMEEKRQEEAMLTEDSTMIVDPPSPIERHVKWS

SEQ ID NO: 114768 - protein, 202 aa, Glycine max
  Coding DNA Sequence Number=SeqID_23083
  Pfam annotation: Domain name=Transposase_23; Domain location=37-107; Score=-6.1; E_value=0.0056; Accession=PF03017.5; Description =TNP1ENSPM transposase
MQSQGLALPPELEVGPSVARVSTKESCVDPSGNDLDTSDTEKCRLYIEENPPRLVTLGRLYEGLTTVHNIPLRHDQVKVGVEEVTDVDALIPVPTQEVQLVGQALNTFVAWPTHLVKRLSKQGAVEPAKPTDRSDHDVDDPLYLMTLTIPQLFLKPLQVMWDATVFWVFNDNFPLYIKHEDLFEIAHDDQCLNISVIQLWIL

SEQ ID NO: 114769 - protein, 142 aa, Glycine max
  Coding DNA Sequence Number=SeqID_23084
  Homolog annotation: Hit_ID=Q0KIL1; Match level="QueryCoverage=41%, HitCoverage=6%, E-value=3e-08, Identity=49%"; Hit description =Gag/pol polyprotein, 3'-partial, putative
MQPDGCSEPQEDLPVPLPSMVQSQCNLRLSRGWIFAALELPVRSKDPKGKAKTDVMESDKVGLTSNDEFLIGRFVEEGDDFSKKGISTEEATKFLRIIQQSEFKVIEQLNKTTARISLLGLLMNSKPHGALLVKILNEAHVA

SEQ ID NO: 114770 - protein, 99 aa, Glycine max
  Coding DNA Sequence Number=SeqID_23085
  Pfam annotation: Domain name=zf-CCHC; Domain location=27-44; Score =31.2; E_value=3.8e-06; Accession=PF00098.14; Description=Zinc knuckle
KFVKRRRIKRRQNFNNGRRSQEDSQVLRCYKCNQLGHIKANCPSNEEWPEKSGKKRYDERRTKKAYIAWDDNDSSDGSEKEINLLTKDYERDENFSQEV

SEQ ID NO: 114771 - protein, 344 aa, Glycine max
  Coding DNA Sequence Number=SeqID_23086
MAPKKLFSKKARKEAIGEGSSMAPQADMEFDGHPFRSKEHQHRFEAIKSWSFLKEGQVQLREGEYVEFQEEIARRRWTQLVGPMAKYDLEIAMEFYSNACPIEEGVKDKRSWVRGQWVSFDEDDINQFLGHPLVLEEGQRCEFSERRSQALGFHEEAIGQLLCVPGHDLARSVTGRRCQLVYAILTQVSVHVAQLISDAIYQFARITPPRHPVDQEKSNRVLGFMALITSLCQFYGVPVTPTKLIQLPINRTFIEKYCMPRQAQQQGEDQQQPAMDAPPPPLQQPPSLESISAHMRRMELQMHAYMQHVIDQQATNHRVVWPGDRSNFQAEAGPIGTPEDEDGA

SEQ ID NO: 114772 - protein, 174 aa, Glycine max
  Coding DNA Sequence Number=SeqID_23087
  Homolog annotation: Hit_ID=A5BHW7; Match level="QueryCoverage=91%, HitCoverage=21%, E-value=1e-08, Identity=28%"; Hit description =Putative uncharacterized protein
MGKFSHNLWSWDLKWRRRLFDHEYEMAVAFMEEIFDISIQQQVQDKMLWKTDCSGVYSTKSTYRLLMPSNSPFPSRRNFQILLLLKIPPRAAHEEAGHLFFHCKMTKGLWWESMCWIQAIGAFSADPANHFIQFCDGFGAGRNLSRRGGWWIALSITIWQHRNSLLFHGIPFEP

SEQ ID NO: 114773 - protein, 303 aa, Glycine max
  Coding DNA Sequence Number=SeqID_23088
  Homolog annotation: Hit_ID=Q84VI1; Match level="QueryCoverage=100%, HitCoverage=51%, E-value=1e-109, Identity=62%"; Hit description =Envelope-like protein
MATSPKETAAPSSPAVPSSPHQEQPEFNIQPIQIIPGQASVPAKLIPRRPQGVKIAEKPSLATSPREVDTEMDNKIRSIVSSILKDASVPEADEDVPTSSNPNVSVPDVKKDVPTSSAPNAEALPSPSEEESTEEEDQASEETPAPRAPEPAPGNLIDLEEVESDEEPIANRLAPGIAERLQSRKGKPPLRDVSTSKRAKTSGKKVPGNVPDAPLDNISFHSIGNAERWKFVYQRRLALERELGRAVLDCKEIMDLIKAAGLLKTVTKLGDCYEGLVREFIVNIPSDISNRKSDDYQRVFVRG

SEQ ID NO: 114774 - protein, 84 aa, Glycine max
  Coding DNA Sequence Number=SeqID_23089
MATARWVLKHPVYGIVILRLGIYTGRHSLMKNLHGSDISTNTIDNNEVSTNAIVQTTYKRGNIKENMNLGIPWSYGSTPSQETE

SEQ ID NO: 114775 - protein, 125 aa, Glycine max
  Coding DNA Sequence Number=SeqID_23090
  Homolog annotation: Hit_ID=Q6UUU1; Match level="QueryCoverage=48%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKFAPKLDCMHEPPVQSRPLRLI

SEQ ID NO: 114776 - protein, 351 aa, Glycine max
  Coding DNA Sequence Number=SeqID_23091
  Gene Ontology: Mol. function=succinyl-diaminopimelate desuccinylase activity; Cellular component=cytoplasm; Biological process=lysine biosynthetic process via diaminopimelate
  Homolog annotation: Hit_ID=A8GHK9; Match level="QueryCoverage=63%, HitCoverage=59%, E-value=1e-121, Identity=94%"; Hit description =Succinyl-diaminopimelate desuccinylase
  Pfam annotation: Domain name=ArsC; Domain location=13-124; Score =167.3; E_value=4e-47; Accession=PF03960.6; Description=ArsC family
  Pfam annotation: Domain name=M20_dimer; Domain location=291-346; Score=4.5; E_value=0.073; Accession=PF07687.5; Description=Peptidase dimerisation domain
  Pfam annotation: Domain name=Peptidase_M20; Domain location=178-351; Score=73.2; E_value=8.3e-19; Accession=PF01546.19; Description =Peptidase family M20M25M40
  Pfam annotation: Domain name=Peptidase_M28; Domain location=175-329; Score=-61.8; E_value=0.096; Accession=PF04389.8; Description =Peptidase family M28
  Pfam module annotation: Pfam domain module=ArsC::M20_dimer::Peptidase_ M20::Peptidase_M28; Domain location=13-124::291-346::178-351::175-329
MANKPQQTTLTMYGIKNCDTIKKARRWLEDQGVTYHFHDYRADGLTEQQLRGFVAQLGWEPLLNTRGTTWRKLDEAQRNACDNADAAIALMLAQPAIIKRPLLDDGNGHALLGFNADAYQQFIAEVALIKRPSLSPNDEGCQQLMIERLQAIGFTVEAMDFEDTQNFWAWRGEGQTLAFAGHTDVVPTGDEKRWDNPPFEPAIRDGMLYGRGAADMKGSLAAMVVAAERFVATNPDHRGRLAFLITSDEEASATHGTVKVVEALMARNERLDYCLVGEPSSTERVGDVVKNGRRGSITANLHIHGVQGHVAYPHLADNPVHRAMPALNELVAIEWDRGNEFFPPTSMQIAN

SEQ ID NO: 114777 - protein, 70 aa, Glycine max
  Coding DNA Sequence Number=SeqID_23092
GQDHLELPSGVGTKCGQQKPIKVLRDGCKWGWGHDRPIVAPSLRETSRERRCKAAPYPLYSQFSFTICLF

SEQ ID NO: 114778 - protein, 320 aa, Glycine max
  Coding DNA Sequence Number=SeqID_23093
  Homolog annotation: Hit_ID=Q9AL89; Match level="QueryCoverage=46%, HitCoverage=38%, E-value=7e-09, Identity=29%"; Hit description =Putative uncharacterized protein
NGDHAESRNALHKQQEQRGEAAIILAIHHLRDSHQGDLAAETGHMHADKRKQIGQQQHKQRRQRIAGGTFTRFVPVSHQRGVTARTARTAAHRYGGQFYALPALPTVQRSPDGSSAPAAHRYASPAAPAFAAAVPVHAFGLLVSGALLLRIMVATDEGTDLAVAFKDPAFGHGVIHKLTIVAHQQYGSLIAIHQLFQQLERFDVEVVGRFVKDQQVAGLEEQTRQQQAVTLAAGQRTHRRHGAFRVEQEVLQIAEHVARLAVDHHFLFAFRQVVHHGFIRIELRAVLIEVGDFQFGATVHATGICLQLAEHQRSSVVYHS

SEQ ID NO: 114779 - protein, 220 aa, Glycine max
  Coding DNA Sequence Number=SeqID_23094
  Gene Ontology: Biological process=transposition, DNA-mediated
  Homolog annotation: Hit_ID=Q6UUU1; Match level="QueryCoverage=27%, HitCoverage=40%, E-value=2e-18, Identity=78%"; Hit description =Putative uncharacterized protein
MVKVEPSYVPINVSFSPKVGPGLPRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGDT

SEQ ID NO: 114780 - protein, 121 aa, Glycine max
  Coding DNA Sequence Number=SeqID_23095
  Subcellular localization annotation: CTP_CleavageSite=61; ConfidenceScore=5.22e-01
DRAHKTLSGPGGVQQGPGVSSFGHGPLSVLHGARPPSKGSGLQDTQWTFISSKECPSPPTRQAQGETPQQPEDAQQLAVDAPPPPPESSLAHFQRLEHCLRYMANQQAPNHRNSRTHLVAS

SEQ ID NO: 114781 - protein, 22 aa, Glycine max
  Coding DNA Sequence Number=SeqID_23096
MTRTKKIGQMTSKAIKEIAEKI

SEQ ID NO: 114782 - protein, 131 aa, Glycine max
  Coding DNA Sequence Number=SeqID_23097
  Gene Ontology: Mol. function=nucleoside-triphosphatase activity; Cellular component=chloroplast
  Homolog annotation: Hit_ID=Q2PMM5; Match level="QueryCoverage=45%, HitCoverage=2%, E-value=7e-25, Identity=93%"; Hit description =Protein ycf2
MVLRTWNEYEKINDTSLPFELSAGSVAQDLWSLPGPDEKNGITSYGLVENNSDLVHGLLEVEGALVGSSRTEKDCSPMNWDFPIGPGHFGTSGSFMMKRMSFKRMIQSSCRVEPCSTRHEIDLPKNRAFFE

SEQ ID NO: 114783 - protein, 61 aa, Glycine max
  Coding DNA Sequence Number=SeqID_23098
EELATQLAQASKVASSMSYTDFVRGPLLDDMQLLFGPCEKAVASGGSNPARLGEMSSPGRA

SEQ ID NO: 114784 - protein, 170 aa, Glycine max
  Coding DNA Sequence Number=SeqID_23099
  Gene Ontology: Biological process=transposition, DNA-mediated
  Homolog annotation: Hit_ID=Q1J7G7; Match level="QueryCoverage=22%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGTRARCRKISSEVAKKAGTGSRIQGSIKLIDTVDLEGGPVGKPVVPAALMNRPTRGERRFAYWALAECILAYYVGTDEGVSEVLHVAGEKRLH

SEQ ID NO: 114785 - protein, 77 aa, Glycine max
  Coding DNA Sequence Number=SeqID_23100
MKDCDNCERLIKSKTIRYRLFNHKPRLRDSGCCFNKELALCTFDDEIKVFGFRGEYVARLKLKGIDGRAPPGVEPAA

SEQ ID NO: 114786 - protein, 107 aa, Glycine max
  Coding DNA Sequence Number=SeqID_23101
  Subcellular localization annotation: CTP_CleavageSite=96; ConfidenceScore=5.57e-01
MSADVTFFEDISFFSSSIDYSSSLQQVLLVPSFGPMSNFNQSVSGTPSDPPSSTEVAPPHLITYQRRTRQVSSIVLESSSRDSDPPLTDPQTMDPSSSIPSHNSDSN

SEQ ID NO: 114787 - protein, 199 aa, Glycine max
  Coding DNA Sequence Number=SeqID_23102
  Homolog annotation: Hit_ID=A5BSR3; Match level="QueryCoverage=61%, HitCoverage=39%, E-value=8e-11, Identity=35%"; Hit description =Putative uncharacterized protein
MTSAGKVVQFADCRDLLGRMCTRRHRPSKSKILPPTFCLVGTKKKLEEAIQSGSVDGVIDPPSPVRRHVKWKMACTKKIGEMTAEAAKEIVEKIDSFEEKATQGSFVPRGRQDVLAAAIGRPEHPGRVRAAGAGVTIKKYFGSAPRTSRSASSLPLDEMQQLTQQIRDQLEESITEKVTRQVMASFSHMQSQLQSQMQS

SEQ ID NO: 114788 - protein, 98 aa, Glycine max
  Coding DNA Sequence Number=SeqID_23103
  Gene Ontology: Mol. function=structural constituent of ribosome; Cellular component=ribonucleoprotein complex; Biological process =translation
  Homolog annotation: Hit_ID=P61841; Match level="QueryCoverage=41%, HitCoverage=26%, E-value=2e-14, Identity=95%"; Hit description =Chloroplast 30S ribosomal protein S7
  Pfam annotation: Domain name=Ribosomal_S7; Domain location=1-56; Score=-83.9; E_value=0.041; Accession=PF00177.12; Description =Ribosomal protein S7pS5e
  Subcellular localization annotation: CTP_CleavageSite=52; ConfidenceScore=5.09e-01
MKKIQQKTETNPLSVLRQAIRGVTPDIAVKARRVGGSTHQLFASCRKRISTRAFLRCRFLGHPEDLSSFENAMISKTEKKFGGEQLGFFQGDGAVTNS

SEQ ID NO: 114789 - protein, 143 aa, Glycine max
  Coding DNA Sequence Number=SeqID_23104
MAAQIIHDRVEMECLEGAWETLEGNMRCRFRGTIRFTATSLVHPNEPARTLQRTVEWILSTPTPYRLVEPVQVIEVTSSEEDPEEDLEELPLEPAGDALDFLEGDEDPLPEVDSPEEVMSASEADSTEDSGPREMATSGGSSS

SEQ ID NO: 114790 - protein, 116 aa, Glycine max
  Coding DNA Sequence Number=SeqID_23105
  Subcellular localization annotation: CTP_CleavageSite=39; ConfidenceScore=5.06e-01
MCADVLYLPLYIPVNSPKFGANCLEPSSLLESKQGFFVRACTLSATLNRLARISEFRLSACLLAQWMDSSGALSRMNPHSANMHNSSFFHDRRMKQNALITCLSQSMQLFKEKNKM

SEQ ID NO: 114791 - protein, 177 aa, Glycine max
  Coding DNA Sequence Number=SeqID_23106
YPELRRSEFLIGGYVGARASLLSTTPPFVAMTQELANVVICALSGDEQEPAFVGRPIIFGILTLRSCDMHPCVIPEAAGPMIRGDTLRLSAPFCHPEAAGPMTSRDKIWSFCTLVSSRGGGPDDTRRYLTVIRTLVSSRGGGPDDTRRYLTVIRTLLSSRGVEPDDKQRQNLVILHP

SEQ ID NO: 114792 - protein, 101 aa, Glycine max
  Coding DNA Sequence Number=SeqID_23107
  Subcellular localization annotation: CTP_CleavageSite=48; ConfidenceScore=5.32e-01
MPISPCGSISWSVPSRHRGRAHKTPSGPGEVQQGPGVSNFGYEPLSVLQGARTPRKVMPARHSSTECPSPPTKSSGPLLIELSSRGTAPPGRHKAKHRGIL

SEQ ID NO: 114793 - protein, 119 aa, Glycine max
  Coding DNA Sequence Number=SeqID_23108
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=82%, HitCoverage=75%, E-value=3e-24, Identity=65%"; Hit description=LacZ protein
  Subcellular localization annotation: CTP_CleavageSite=32; ConfidenceScore=5.07e-01
MTMITPSSKLTLTKGNKSCPGDPLVLERPPPRWSSNSPYSESYYNSLAVVLQRRDWENTGVTQLNRLAAHPPFASWRNSEEARTDRPSQQLRSLNGEWDAPCSGALSGGGCGGYAQRDR

SEQ ID NO: 114794 - protein, 18 aa, Glycine max
  Coding DNA Sequence Number=SeqID_23109
MSWTWIQASLQQNSKINY

SEQ ID NO: 114795 - protein, 194 aa, Glycine max
  Coding DNA Sequence Number=SeqID_23110
  Homolog annotation: Hit_ID=Q6UUU1; Match level="QueryCoverage=44%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRVSFRCYGPRLSHSTPDTQFRGRQFAPSWTVCTNPPFSPTAAPYPGNYRLEVQPGKTCKSTTGSSH

SEQ ID NO: 114796 - protein, 147 aa, Glycine max
  Coding DNA Sequence Number=SeqID_23111
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLLERSPVPAFGLPVSFRCMAALSHSTPDTQFR

SEQ ID NO: 114797 - protein, 106 aa, Glycine max
  Coding DNA Sequence Number=SeqID_23112
  Homolog annotation: Hit_ID=O48791; Match level="QueryCoverage=66%, HitCoverage=14%, E-value=4e-15, Identity=65%"; Hit description =Putative uncharacterized protein At2g26770
METKDSPKVLSMKEVVARETAQLLDQQKRLSVRDLASKFEKGLAAAGEGRATVKGKMVTGVRDMVGLDKSRISFFIASFSLIWNPEKNHSLSLSHFRGCSTWESGA

SEQ ID NO: 114798 - protein, 106 aa, Glycine max
  Coding DNA Sequence Number=SeqID_23113
MGRKKRKKDSSKKIVMKENHFVTKGDIQIAPLLKQSFYLLLSRETSFSITIPLKLKVIRQVKKVLDEGLVRKSLNPCALLVPKIGIVRHQIPMIGVIKGFPQTLRE

SEQ ID NO: 114799 - protein, 120 aa, Glycine max
  Coding DNA Sequence Number=SeqID_23114
  Gene Ontology: Biological process=transposition, DNA-mediated
  Homolog annotation: Hit_ID=Q1J7G7; Match level="QueryCoverage=26%, HitCoverage=45%, E-value=3e-11, Identity=100%"; Hit description =Transposase
MPQNVLYDAIGYINGGISSDFFSILASLAPENLDNSKNTPGSDPYFIMVKVGTSYVPINVSFSPKSWPRASPVLQWLLFLSAVPPVQLLTGWCVTAKAPPDISAGKCSGHAARNHHTRRA

SEQ ID NO: 114800 - protein, 201 aa, Glycine max
  Coding DNA Sequence Number=SeqID_23115
MAPRKLASKRSRKDKAAEGTSSAPEYDSHCFRSAEHQQRFEAIKGWDDEYINFQEEIVRRRWASLVTPIAKFDPDIVLEFYANAWPTEEGVRDMRSWVRGQWIPFDADALNQFLGYPLVLEEGQECEYGQRRNRADGFDEEAIAQLLCILGQDFARTVAGRRARIMRTNMTTLTQIWMTLLLSNIQPSDHNSDLPLPKCQL

SEQ ID NO: 114801 - protein, 54 aa, Glycine max
  Coding DNA Sequence Number=SeqID_23116
MGGANTVLGEKNCFREENQSRGASVTLPRGFRKQIREGFPPLFIVLHSFFVLQW

SEQ ID NO: 114802 - protein, 98 aa, Glycine max
  Coding DNA Sequence Number=SeqID_23117
MGKAKEVQEQMEADMEAMKEQMAAMMEAMMSMKKIMEANAVAVATTSAVAKVNPTSPSGINPMNHPTSDMIGKDFGSMAAPIMRKFKQACLPTIHHPM

SEQ ID NO: 114803 - protein, 35 aa, Glycine max
  Coding DNA Sequence Number=SeqID_23118
MAASERNSMVHSNKLKVLDFLRAERAFKGPRLLPK

SEQ ID NO: 114804 - protein, 236 aa, Glycine max
  Coding DNA Sequence Number=SeqID_23119
  Subcellular localization annotation: CTP_CleavageSite=38; ConfidenceScore=5.65e-01
MEESSKKRKGSSTSASASRAHCFGATSTSTTPIPPSLSSSTLFSSEEQQTQYSNLFSSRSIIDPKFIDMDFFSAESFDCIQAFQNLGLIPFMSLQLPVYSELVKAFYCNLEIQESTLISEVFGIKMVIDQSLFHNLAQLSNDGVPFEEHDGSWVKKGDQPADDEGNLPVEDNSSLLRRLLDKFDGLQTFVGNKFDAMELQVDMRFDAMDSRITKVEEDVSFIRTCFDPPPPPPSSS

SEQ ID NO: 114805 - protein, 33 aa, Glycine max
  Coding DNA Sequence Number=SeqID_23120
MAYVRMNGSGIEKEERDEMPLQGEDEFRRSSPP

SEQ ID NO: 114806 - protein, 38 aa, Glycine max
  Coding DNA Sequence Number=SeqID_23121
MKKIQGLQLLHGATSLSHGGGRVGWSKEVSSTTTSTKE

SEQ ID NO: 114807 - protein, 61 aa, Glycine max
  Coding DNA Sequence Number=SeqID_23122
MSLHVLYLYVFSGFPPGGQDHLELPSGVGTKHEQQKPTKVLRNGCKWGWGHDRLIVTLSLR

SEQ ID NO: 114808 - protein, 90 aa, Glycine max
  Coding DNA Sequence Number=SeqID_23123
  Subcellular localization annotation: CTP_CleavageSite=50; ConfidenceScore=5.47e-01
MNSDSDSEVRIFGCFVLDPCGSACWATSLNQTSPRRSSTRSTALAASCPVASYSAGSPSKQRAGAPTVPAPASTLAPFGLEDHQVPSNSL

SEQ ID NO: 114809 - protein, 130 aa, Glycine max
  Coding DNA Sequence Number=SeqID_23124
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=67%, HitCoverage=75%, E-value=3e-24, Identity=67%"; Hit description=LacZ protein
MKHFTDTLISANITTGLNYLSNSCSPGDPLVLERPPPRWSSNSPYSESYYNSLAVVLQRRDWENPGVTQLNRLAAHPPFASWRNSEEARTDRPSQQLRSLNGEWDAPCSGRIKRGGCGGYAQRDRYTCQR

SEQ ID NO: 114810 - protein, 237 aa, Glycine max
  Coding DNA Sequence Number=SeqID_23125
  Homolog annotation: Hit_ID=Q2HW90; Match level="QueryCoverage=84%, HitCoverage=45%, E-value=6e-18, Identity=30%"; Hit description =Putative uncharacterized protein
AVDGTPPNANLPQDLRKDLRVDHSRGVHRSHCITYPYYDQPLRCFTFGDFQLVPTIEELRNSRMSSRGKKPYLSSGYLEDKARGMANQGDWVPFMDVLALLIFGVVLFPNVDGLVDLAAIDAFLAYHHSKESPVVAVLADLFDTFDRRCEKSSARIICCLPALCVWLVSHLFQQDTRHPCPLLSHRSCTEKRRIDWDQLLAGIGGRTINWFPRWKEGKEGVLFSCGGYPNIPLIGTR

SEQ ID NO: 114811 - protein, 108 aa, Glycine max
  Coding DNA Sequence Number=SeqID_23126
  Homolog annotation: Hit_ID=Q6UUU1; Match level="QueryCoverage=74%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCPHSTPDNSVPGRQFRFQAGL

SEQ ID NO: 114812 - protein, 65 aa, Glycine max
  Coding DNA Sequence Number=SeqID_23127
  Subcellular localization annotation: CTP_CleavageSite=43; ConfidenceScore=5.08e-01
MWYHPQGNSLSVSTRHSYLGKLDRTSDKVNAPPTNIHNMHNLNAFPTSSTFHFNITLNINIFSSQ

SEQ ID NO: 114813 - protein, 64 aa, Glycine max
  Coding DNA Sequence Number=SeqID_23128
  Subcellular localization annotation: CTP_CleavageSite=53; ConfidenceScore=5.30e-01
MSRASSSSAFVLPGNTQDLEQAINSSRMGAVIPVPIFTSFFPLPVPKSTSFISSDEAPSLGPHG

SEQ ID NO: 114814 - protein, 226 aa, Glycine max
  Coding DNA Sequence Number=SeqID_23129
  Gene Ontology: Mol. function=hydrolase activity, hydrolyzing O -glycosyl compounds; Cellular component=cytoplasm; Biological process= carbohydrate metabolic process
  Homolog annotation: Hit_ID=A4WBW5; Match level="QueryCoverage=34%, HitCoverage=15%, E-value=3e-39, Identity=94%"; Hit description =Glucan 1,4-alpha-maltohexaosidase
  Pfam annotation: Domain name=FliT; Domain location=22-138; Score =108.2; E_value=2.5e-29; Accession=PF05400.4; Description=Flagellar protein FliT
MVRRLLHANVNNDASAIEEVETLLRNIADGWKEVAGTPQLMQDAGLWDDLIICETDYVNAVHSLARLTQESEPSMQIQEQLRPTLRVILDNEGQVKTLLQARMDELAKLVGQSSIQKTVLSTYALTVSYASISAKPAPYLSLATSWRWCMRNPTLLQCFHWYYPAGGELWREVTALAPNLNEIGINMIWLPPAYKGASGGYSVGYDSYDLFDLGEFDQKGSIATKY

SEQ ID NO: 114815 - protein, 134 aa, Glycine max
  Coding DNA Sequence Number=SeqID_23130
  Homolog annotation: Hit_ID=Q84VH5; Match level="QueryCoverage=52%, HitCoverage=10%, E-value=4e-18, Identity=71%"; Hit description =Envelope-like protein
GETAAADKDDLMVRPTEDEHGQDRGTFCRKADSHVKYASCTRKRLATCRICWYPPITSAVPGTHVPDIVSTSGKAAASGAVSKDALIAELKDTCKVLEATIKATTEKKMELERLIKRLSDSGIDDVKQLRERSS

SEQ ID NO: 114816 - protein, 86 aa, Glycine max
  Coding DNA Sequence Number=SeqID_23131
  Homolog annotation: Hit_ID=A2Q4B2; Match level="QueryCoverage=73%, HitCoverage=14%, E-value=3e-16, Identity=68%"; Hit description=Zinc finger, Dof-type
MVLSFSVQHNTINIIINNNNNSNMSQTEKDPGIRLFGRKIPVPECQIPANSGPKDACSSIMKTELGIPSECGENPEQQENSSDSRD

SEQ ID NO: 114817 - protein, 66 aa, Glycine max
  Coding DNA Sequence Number=SeqID_23132
MESHQVKLQFGIHQDIPVDLMNLDRLHQIDMQGWINIWKNKHNDVLIGQWVEGSVTRTPEYMEWYR

SEQ ID NO: 114818 - protein, 90 aa, Glycine max
  Coding DNA Sequence Number=SeqID_23133
MMRDASKFTHISPKNSGHVTYGDNNKDKKPNHAQCFLSKDDEPWLWHMRISSVNIAYYMSQPTLRREGDARLTGASSKKGIRAESPPTFI

SEQ ID NO: 114819 - protein, 200 aa, Glycine max
  Coding DNA Sequence Number=SeqID_23134
MDAHPCQDGVHQLALRHGEIGIMIGGQDVAEEQRHPYLGQGGHIGAHDSHSPPCSSPGKILPRPVPPLAILAFLALFQHHRISQELADSVGIERDPLTPNPGSHVTHALLCWPSIGIKFKDYFWIKLGHRSNQWCPPPAPYFLLKISILVVPELDASLPEKRPSLDGFEALLVYNAPKAVTVVLRGGTSSFGRLVLPGPL

SEQ ID NO: 114820 - protein, 276 aa, Glycine max
  Coding DNA Sequence Number=SeqID_23135
  Homolog annotation: Hit_ID=A5AMK2; Match level="QueryCoverage=30%, HitCoverage=11%, E-value=3e-08, Identity=39%"; Hit description =Putative uncharacterized protein
  Pfam annotation: Domain name=zf-CCHC; Domain location=140-157; Score =20.0; E_value=0.0014; Accession=PF00098.14; Description=Zinc knuckle
MVKINLDEREQIREEERRKILKELRKEKHVSYSSHNSCKSLSEELRDYYEGRHRSHLRPHSYRREKERKPQEANLDWEIRVEQQLKRKSTSKSFDSHSYPKKDQGQCILGVTPSKSKDDKGKTIEKQPLKASMQEKTSSMKCFKCLGGGHITSQCPTKKTMIMTGQDIYSSLDEAITSPYSSESEEAKGEESSEEIYPQEEGQPLMVKEECKEVSVSSKRLAKKEWHFEIKTNIKEISPLRQPPHFLLCKKTLVSIATPLRLEFIPQVKELLDEGL

SEQ ID NO: 114821 - protein, 57 aa, Glycine max
  Coding DNA Sequence Number=SeqID_23136
MRCTRGDTWYCKDRKIKKCWEILPLEEDFVHFQIDRRIFLFWLEGENCSVSSEKDKV

SEQ ID NO: 114822 - protein, 93 aa, Glycine max
  Coding DNA Sequence Number=SeqID_23137
MDERSRGPGMAPTRHPLDPEKSNRALGFPALITGLCQFYEVHVTPSKVIRPPITRAFIEKYCTPMQVRGDAHQAVGAPPPPQQADSAGPLSVE

SEQ ID NO: 114823 - protein, 132 aa, Glycine max
  Coding DNA Sequence Number=SeqID_23138
  Homolog annotation: Hit_ID=Q5QJQ3; Match level="QueryCoverage=57%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLKSCAVRLTEGQFW

SEQ ID NO: 114824 - protein, 74 aa, Glycine max
  Coding DNA Sequence Number=SeqID_23139
MGALFQRRKRCAESPPNFYLWKNVGKTRRKIGQKGKILSSGVIFPLEEGISSSHVDKSGTFAPTYPPLERKSDL

SEQ ID NO: 114825 - protein, 377 aa, Glycine max
  Coding DNA Sequence Number=SeqID_23140
  Gene Ontology: Mol. function=binding
  Homolog annotation: Hit_ID=A4W4W3; Match level="QueryCoverage=99%, HitCoverage=9%, E-value=5e-64, Identity=37%"; Hit description =Filamentous haemagglutinin family outer membrane protein precursor
  Pfam annotation: Domain name=Fil_haemagg; Domain location=38-91; Score=18.9; E_value=0.019; Accession=PF05594.5; Description =Haemagluttinin repeat
  Subcellular localization annotation: CTP_CleavageSite=44; ConfidenceScore=5.36e-01
MHGYQTGGSNGKGNGHTEYRPYTTLAPKLSTAVRKFLVSSTTVTASATDGAGRIAANRNLVVTADALDNQASNLLAGQDIVLTGNNLNNQSWENSIQSQYLVYKYGNPNTGRIDTNLYGEEDTAPSIIADLRNGNSHGVKYESGLGSEVVYTLQGAPVYETSQTGEGLRAVIQAGGNVSARFTNNLSNTDTVANAGSMVHAISKPGIAGTAPLQSVGGVQNQQLAAGQTIAVGSPQWKDALTGALQQIGNQGAALTDYPLPAGNNGLFVASKDPASPYLITTNPQLAEVGKTDGSLFDGLNTFLRNPTSGAVQQSAQAVTQPALSSSPRVETAAIYTDKDKFLGSAYLLNRLQLTPDKDYKFLGDAAFDTRYVSNAI

SEQ ID NO: 114826 - protein, 163 aa, Glycine max
  Coding DNA Sequence Number=SeqID_23141
MYEYPRRTRTLTCKHSFQNSYGYSCFVGKREMAPKKLSMKSAEHQQRFEAIKGWSFHRERRVQLREDEYTDFQEEIARRRWTPLVTPMAKFDPKIILEFYANAWPTEEGVRDMRSWVRGQWIPFDADALSQFLGDLLVLEEGQQCEFSQRRNKADGFDEEAIA

SEQ ID NO: 114827 - protein, 222 aa, Glycine max
  Coding DNA Sequence Number=SeqID_23142
  Homolog annotation: Hit_ID=Q6UUU1; Match level="QueryCoverage=27%, HitCoverage=40%, E-value=2e-18, Identity=78%"; Hit description =Putative uncharacterized protein
  Subcellular localization annotation: CTP_CleavageSite=47; ConfidenceScore=5.46e-01
LIVEGAGPPRGSSVRSGSSAVSTGTASCGVDDSSAGPRRAESELRSRSSMPPVTCRAPPARCLSHRESWTGRDRPVADAAHHRRPRPPVRLRRGRRPAGRARRSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 114828 - protein, 177 aa, Glycine max
  Coding DNA Sequence Number=SeqID_23143
  Homolog annotation: Hit_ID=A0ST23; Match level="QueryCoverage=14%, HitCoverage=51%, E-value=4e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPGNLTKHDINIKPMTVSNHLHANFRVGDRPTTSKVNFELGVIMVIAVSFGKPVVPAALMNRPTRGERRFAYWALAECILAYYVGTDEGVSEVLHVAGEKRLH

SEQ ID NO: 114829 - protein, 61 aa, Glycine max
  Coding DNA Sequence Number=SeqID_23144
MRLRMPPVSWDTVTKSGVVGIMVAGLDVVEQQSHPDLSQGGHVGAHDPHPSPGSSPGKILP

SEQ ID NO: 114830 - protein, 136 aa, Glycine max
  Coding DNA Sequence Number=SeqID_23145
  Subcellular localization annotation: CTP_CleavageSite=42; ConfidenceScore=5.05e-01
WNLYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSINDPPLRRHPTAQRLRAQNGAGVNINDRLIDEE

SEQ ID NO: 114831 - protein, 76 aa, Glycine max
  Coding DNA Sequence Number=SeqID_23146
MALPSGGCVYRFLEAEWRRKRERRRHFKEKMSLEEAHHHRRPWIRAWRKKEMNEGRGREEHEILCSKRALKSEVNI

SEQ ID NO: 114832 - protein, 205 aa, Glycine max
  Coding DNA Sequence Number=SeqID_23147
  Homolog annotation: Hit_ID=A5B939; Match level="QueryCoverage=44%, HitCoverage=64%, E-value=1e-24, Identity=61%"; Hit description =Putative uncharacterized protein
MESRAPSGPFLSILRDGGSPSDSALCAYSERESGLKFLNRDVAADGNVRESGDVGGGPGKELSFLFNSLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 114833 - protein, 79 aa, Glycine max
  Coding DNA Sequence Number=SeqID_23148
MTCDHSLVLVRCLAPIIRQFVKFQDMPENQKILMHNPPIWALQKVPPEGGCFWRKQPCSPGRTELAWASWAASISPILL

SEQ ID NO: 114834 - protein, 96 aa, Glycine max
  Coding DNA Sequence Number=SeqID_23149
  Homolog annotation: Hit_ID=Q6W6R6; Match level="QueryCoverage=33%, HitCoverage=6%, E-value=6e-08, Identity=84%"; Hit description =Putative serine carboxypeptidase
  Subcellular localization annotation: CTP_CleavageSite=89; ConfidenceScore=5.61e-01
MAFSIPPPLLPILTTTGSGLVSKQCSFVASANGKEGNTNFSSSQVGGYVVKYKGVTFVTVRGAGHLVPSWQPSRALTLIFSFLYGSLPPASPWKGF

SEQ ID NO: 114835 - protein, 60 aa, Glycine max
  Coding DNA Sequence Number=SeqID_23150
MIQVEVQVEGTSTWVFKENKGGYIPCGSLACKGFYKVERNLKNRRLLGDWMYARFVAEPV

SEQ ID NO: 114836 - protein, 104 aa, Glycine max
  Coding DNA Sequence Number=SeqID_23151
  Homolog annotation: Hit_ID=A5AZ88; Match level="QueryCoverage=69%, HitCoverage=6%, E-value=2e-08, Identity=44%"; Hit description =Putative uncharacterized protein
  Pfam annotation: Domain name=Retrotrans_gag; Domain location=6-73; Score=-0.8; E_value=0.064; Accession=PF03732.8; Description =Retrotransposon gag protein
MITRSRIAIQAEESRADQKMEGNKVAHNSSFHQFPNESLSEALERFKGLLRKTPTHGFSEPIQLNIFIDGLRPQSKKLLDASVGGKIKMKTPEEAMDLIEKHGC

SEQ ID NO: 114837 - protein, 209 aa, Glycine max
  Coding DNA Sequence Number=SeqID_23152
MSSSINTHEIRAAAQPKPPPRFPPYLELQTFDSHSILHQIIAIEEEKGIISTAAAAAHRRHGPSGAPTAPIPPSLSSPRSSTLFSSDDQRLRYLSQFSSRIILDPKYLDVEFFNDETFDCYQVFQNSGLVDFMSLKLSYYPELVKVFYCNLKIQDGIIMSEVHGTSMVIDQSLFFSLTPYLLRAPLLMTGNSIIRVMMLVAWYAMIKLK

SEQ ID NO: 114838 - protein, 64 aa, Glycine max
  Coding DNA Sequence Number=SeqID_23153
MVLLTRHEESIKARGYIYLGLTENKRRYISCGSVLVEGTSTRFKENKGGYIPCGSLLEKGFLQG

SEQ ID NO: 114839 - protein, 226 aa, Glycine max
  Coding DNA Sequence Number=SeqID_23154
NNGPIGGYRKWLKAHVQGLDWLPRLRTAKREEVEAPEEDEEVQALRAELEQAQTVKERFKSAALMIRKENAKLRDINVATTKALEQETKRACREEHGRNKFRGALWGSNSELKLWREERDQSRVDSLILKDELKTNMLAIISKCREELNLATAHEHRVADEYAHVYAEKEARGRVIDSLHQEATMWMDRFALTLNGSQELPRLLAKAKVMADTYSAPEEIHELLGY

SEQ ID NO: 114840 - protein, 226 aa, Glycine max
  Coding DNA Sequence Number=SeqID_23155
  Gene Ontology: Mol. function=transferase activity, transferring groups other than amino-acyl groups; Cellular component=1-2nm peptidoglycan-based cell wall; Biological process=lipopolysaccharide core region biosynthetic process
  Homolog annotation: Hit_ID=A8GK79; Match level="QueryCoverage=96%, HitCoverage=71%, E-value=8e-84, Identity=68%"; Hit description=Lipid A biosynthesis lauroyl (Or palmitoleoyl) acyltransferase
  Pfam annotation: Domain name=Lip_A_acyltrans; Domain location=4-226; Score=194.5; E_value=2.7e-55; Accession=PF03279.4; Description =Bacterial lipid A biosynthesis acyltransferase
MKKTGQFCSKLLHPRYWFTWFGLAVLWLLVQLPYPLLIRLGATAGRLSRHFLKRRERITRRNIELCFPHINEDEKEVMIAGNFESLGMALAETGIAWFWSDARVRQLFQVHGIANLQLAQSQQRGVMVIGVHFMSLELGGRITGLCQPMMAMYRPHNNQAMEWAQTKGRMRSNKAMIDRRDLRGMVQALKQGEAVWFAPDQDYGPKGSVFAPLFAVEKGGHHQWHL

SEQ ID NO: 114841 - protein, 176 aa, Glycine max
  Coding DNA Sequence Number=SeqID_23156
MEAMKEQMATMMEAMMSVKKIMEANAVATAATSTVAKVNPMPPSGLNQMHHQTSTMVGKDLRSTGGPHYAQSQNKHAFPPHGFPPNCTPPNVAYTPSENVNNSTPILIESRQPQTDHAHVSQPMGETHEMPHHNLADFEPCLGYATEGQEISGIPLQNPLEGPQYHPQLHLLHSTT

SEQ ID NO: 114842 - protein, 172 aa, Glycine max
  Coding DNA Sequence Number=SeqID_23157
  Homolog annotation: Hit_ID=A6H5B3; Match level="QueryCoverage=38%, HitCoverage=84%, E-value=9e-28, Identity=88%"; Hit description =Putative ribosomal protein S3
HPETRKGVVSDEMLRGVENKRRSGDSRYRGKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 114843 - protein, 229 aa, Glycine max
  Coding DNA Sequence Number=SeqID_23158
  Gene Ontology: Biological process=transposition, DNA-mediated
  Homolog annotation: Hit_ID=Q1J7G7; Match level="QueryCoverage=13%, HitCoverage=42%, E-value=6e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILEVNRESIQDQRGGWGIKYFLGALNKRSSLSIPSTSRGGPVPAFVPFSEVGKPVVPAALMNRPTRGERRFAYWALAECILAYYVGTDEGVSEVLHVAGEKRLH

SEQ ID NO: 114844 - protein, 91 aa, Glycine max
  Coding DNA Sequence Number=SeqID_23159
MDLPGCSNRRRCLLVEATQLAWASWGKEGRANSFNPLDIKDSLEISEKNCFREENPSRGASVTLPRRFRERFREDFPPFFIVLRRSSVFNR

SEQ ID NO: 114845 - protein, 149 aa, Glycine max
  Coding DNA Sequence Number=SeqID_23160
  Homolog annotation: Hit_ID=Q6UUU1; Match level="QueryCoverage=57%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMGRVCLIPRLNTQFR

SEQ ID NO: 114846 - protein, 355 aa, Glycine max
  Coding DNA Sequence Number=SeqID_23161
  Pfam annotation: Domain name=zf-CCHC; Domain location=170-187; Score =23.2; E_value=0.00046; Accession=PF00098.14; Description=Zinc knuckle
MSLQSSSSVNGEGSTPMDPLYKILDELRSLKLWKEKQERKEKGKKREEEISQDEKEKIREEERRKIMKEMKRKKHTSYSSHNSCKSLSEELRDYYEGRHKSHVRPHSHRRENERKPQEANINLPYFHGKDNKDQGLGILGATPSKPKDDKGKTIEKQPPKASMQEKTSSIKCFKCLRRGHITSQCPTTKTMIMRGQEIYSSQDKATTSPSSSESEKAKGEESSEEIYPQEEGQPLVVKEKCKEVSVSSKRLAKKETHFTIKTNIKETFPLRQPPHFLFCKKTLASIATPLGLEFIPQVKKLLDEGLVRKSLNPCVLLVLKIGIIRHQVHKIGGMMNVLSGATLFCKITRAPNIFM

SEQ ID NO: 114847 - protein, 107 aa, Glycine max
  Coding DNA Sequence Number=SeqID_23162
MEQFLEQVAWPGALPSMVRPNKAAPLEPTPARVELVPADTQSSVVNPPSPKLEVVPASPPFIIISDSPSGEVVAPPDSPVGEAADLLDSLSREAVDLSDSPIFPSDR

SEQ ID NO: 114848 - protein, 78 aa, Glycine max
  Coding DNA Sequence Number=SeqID_23163
MTSSSSSRSFHLLYWLNPDTVHHCLFLRWMPLHRQPDLRGCRVEALRGWTCNLIKLDNGSNILLLCFLNEAHTKGCGK

SEQ ID NO: 114849 - protein, 87 aa, Glycine max
  Coding DNA Sequence Number=SeqID_23164
  Homolog annotation: Hit_ID=UPI0000ECBAF8; Match level="QueryCoverage =49%, HitCoverage=50%, E-value=1e-17, Identity=100%"; Hit description= UPI0000ECBAF8 related cluster
MPLHSSMIEFLQPGGSTSSRAAATGVGAPIRPIVSRITIHWPSFYNVVTGKTLALPNLIALQHIPLSPAGVIAKRPAPIALPNSCAA

SEQ ID NO: 114850 - protein, 189 aa, Glycine max
  Coding DNA Sequence Number=SeqID_23165
MAPRKLASKRSRKDKAAEGTSSAPEYDSHRFRSAEHQQRFEAIRGWSFLRERRIQLRDDEYADFQGEIVRRRWASLVTPMAKFDPDIVLEFYANAWPTEEGVRDMRSWVRGQWIPFDADAISQFLGYPLVLEEGQECEYGQRRNRSDGFDEEAIAQLLCIPGQDFARTAAGRRVDYAHQHDHPDPDMDD

SEQ ID NO: 114851 - protein, 77 aa, Glycine max
  Coding DNA Sequence Number=SeqID_23166
MEEAEKEILETFRKVEKLKGSERISMGRNVSALIGKSVPQIPEKCKDPGPLQSTDVVIHLANRSVAYPAGFIQRCLS

SEQ ID NO: 114852 - protein, 51 aa, Glycine max
  Coding DNA Sequence Number=SeqID_23167
MIEDEWEKVQLAVAEKPEGTDGAERELEEGIWESEGVEAETGGDRSGLRLK

SEQ ID NO: 114853 - protein, 267 aa, Glycine max
  Coding DNA Sequence Number=SeqID_23168
  Homolog annotation: Hit_ID=Q6WAY4; Match level="QueryCoverage=74%, HitCoverage=35%, E-value=1e-21, Identity=34%"; Hit description =Putative uncharacterized protein
MGTNQNGKRFYQVKVKGLDVTSLKELGRLMGPLQRQAFRKVYGKILDLTAVEVFTEAVVSLAQYYDQPLRCFTFGDFQMVPSVEEFEEILECPLGGRKPYLFSGFLPSLSKIAAVVGDSAKELDRMKQTRNGVVGLPRKYLEGKARDMASQEKWVPFADILALLIFGVVLLPNVDGLVDLAAIDAFLAYHHGKESPVVAILADLFDTFDRRCEKNSARIVCCLLALCVWLVSHLFQQDVRHPCPLQSYRSCIEKRESIGPTLGWDRR

SEQ ID NO: 114854 - protein, 61 aa, Glycine max
  Coding DNA Sequence Number=SeqID_23169
MKGNQQRVESPTVATYPSVGGRCETRGMRVPRKEYARSRHQRLFEENVGKTGKDAIYELFK

SEQ ID NO: 114855 - protein, 62 aa, Glycine max
  Coding DNA Sequence Number=SeqID_23170
  Gene Ontology: Mol. function=nucleic acid binding; Cellular component= nucleus; Biological process=mRNA processing
  Homolog annotation: Hit_ID=Q9FT01; Match level="QueryCoverage=88%, HitCoverage=14%, E-value=3e-18, Identity=83%"; Hit description =Putative splicing factor
MVKPSEAEKNLVQSNASGGAASVTGPYGAVDRKLYVGNLHFNMTESQLWESFGMFLGLCYIY

SEQ ID NO: 114856 - protein, 100 aa, Glycine max
  Coding DNA Sequence Number=SeqID_23171
MLTKKTGTVHSDRHWGRQLRSVVNQRILPPKHKVLVATCTICGGAHEFGCCIPIEEHLTREVNYIGNQPRNNFNAGGFSGFQHGQQYNQQQGQWRNHPGN

SEQ ID NO: 114857 - protein, 60 aa, Glycine max
  Coding DNA Sequence Number=SeqID_23172
MDLNIGQSRTRTLLSNMRDCPHPKKEQNGGGLNDQAGHPKAMGRVFTLNGTEASKSKDLI

SEQ ID NO: 114858 - protein, 131 aa, Glycine max
  Coding DNA Sequence Number=SeqID_23173
MELNTATVVAASTATEVDTTHPSSLNQVNCPVSDMVGQGGKALGSMGGPHFVHVQGKHSFPPYSLPPNYTPLNVAHTPDENVDNSAPIPIESQHPQSGHAQAPQPMRETHEVPRDHTLVDFEPHLEYATKG

SEQ ID NO: 114859 - protein, 363 aa, Glycine max
  Coding DNA Sequence Number=SeqID_23174
  Homolog annotation: Hit_ID=Q6WAY4; Match level="QueryCoverage=79%, HitCoverage=50%, E-value=3e-14, Identity=26%"; Hit description =Putative uncharacterized protein
MEAVVSLTQYYDQPLRCFTFGDFQLVPTVEEFEEILGCPLGGKKPYLFSRFLPSLSKIAIVPQLMRSHSKESPVVAILADLFDTFDRRCEKSSARIICCLPALCVRLVSHLFQQDIRHPCPLRSHRSCVEKRRVDWDQHLAGIGGRTISWFPRWKEGNEGVPFSCGDYPNVPLIGTRGCINYNPALVIRQLGYPMRGAPTEKSLSPFLVRDFGAQSFNIVQRVHKVWESPLRKDKELRGIRNGIIGGYHEWLKVHTRGLDWLSKLKIINEENFEAPEEDEEVRALKTELGKARLAKEKFKLVITDVRKECVELREENVATARALEQETKRARKEKHGRDKFRGALWGSNNELKLRREERDQSR

SEQ ID NO: 114860 - protein, 30 aa, Glycine max
  Coding DNA Sequence Number=SeqID_23175
KLKKSETLICLDLVEYPKVQDEKMEDLDMT

SEQ ID NO: 114861 - protein, 149 aa, Glycine max
  Coding DNA Sequence Number=SeqID_23176
VTRPRLSEDCMSSPSRADTPSPVRGLHCPRLERATRPHLGGLITLTVERLHVLALRGLHVLTIRGLHALTSRGLHVLALRGLHALTLGLHVLTIRGLHALTSGGLHVLALRGLHALTLGTSYPHRQRTTRPRLERTTRLHHQRAARPHL

SEQ ID NO: 114862 - protein, 109 aa, Glycine max
  Coding DNA Sequence Number=SeqID_23177
MKDPETELHCPSNIAKHQDWDDIYLKDLPLPNMYPDEIYPLVTVNHAEESNKVDSKVKYCFKIKTRLLQQTSIASRFIQDHLLSQNTLFPTCQGSSNQLPDNVIDYTKT

SEQ ID NO: 114863 - protein, 44 aa, Glycine max
  Coding DNA Sequence Number=SeqID_23178
MTDSKPISTLLSEKEKLSTMIKVQDQVDQDYMSKVPYSSVVGSL

SEQ ID NO: 114864 - protein, 145 aa, Glycine max
  Coding DNA Sequence Number=SeqID_23179
MGSPHLGYNRAAYPYGLPPNYSPPILQEDAGHIASPVHEKEPPQQPDEVHKDPQDYARRDVEFYPPIPEGPVPGTLPQPNIAASPIVLSMEGPPPVTEERRKLDLLEERLRAVEGFGDYPFADMTDLCLVPDVVIPPKFKVPDFD

SEQ ID NO: 114865 - protein, 118 aa, Glycine max
  Coding DNA Sequence Number=SeqID_23180
  Homolog annotation: Hit_ID=Q2HW89; Match level="QueryCoverage=27%, HitCoverage=3%, E-value=2e-08, Identity=84%"; Hit description =Integrase, catalytic region; Ribonuclease H
MNGAVEAANKNIKKIIQKMTVSYNGTDAPIATRWHLCSATNRNGAYPTLNFECSVRQNPHIVAKWRKSMRGTMGPWNYARACFCRKRAFSGGALVLTNMDGEELPSPVNSDVVKQYYA

SEQ ID NO: 114866 - protein, 295 aa, Glycine max
  Coding DNA Sequence Number=SeqID_23181
  Gene Ontology: Mol. function=protein kinase activity; Cellular component=chromatin; Biological process=protein amino acid phosphorylation
  Homolog annotation: Hit_ID=A2Q378; Match level="QueryCoverage=99%, HitCoverage=18%, E-value=1e-80, Identity=51%"; Hit description =Putative uncharacterized protein
  Pfam annotation: Domain name=DUF889; Domain location=91-295; Score =253.4; E_value=4.8e-73; Accession=PF05970.5; Description=Eukaryotic protein of unknown function (DUF889)
MVASSGIASLLLPGGRTAHSKFKIPVPIFEDSTCNILQGSQLAELLNQTNLIIWDEAPMAHKFCFQALDQCLRDIIKEKKSNQIFGGKVIVFGGDFRQILSVIPRGSRSDIINATINSSYLWPSCEVLTISKNMRLQGNAQSIDDQETTKFAKWILDIGDEVIGNQNDGYATVEIPEYLLITEYNDPIDAIVKSTFPDLYEHHSNPEFFKCRAILASTNETVEEVNDYILSLIPGEQMEYLSSDYIEKSETIDSWHFQSITTEFLNSLNTSGLPNHRIKLKIGSPIMLLRSLDQT

SEQ ID NO: 114867 - protein, 213 aa, Glycine max
  Coding DNA Sequence Number=SeqID_23182
  Gene Ontology: Mol. function=transcription factor activity; Biological process=regulation of transcription, DNA-dependent
  Homolog annotation: Hit_ID=Q4K7Z2; Match level="QueryCoverage=45%, HitCoverage=45%, E-value=2e-14, Identity=39%"; Hit description =Transcriptional regulator, TetR family
  Pfam annotation: Domain name=TetR_N; Domain location=24-70; Score =45.3; E_value=2.1e-10; Accession=PF00440.14; Description=Bacterial regulatory proteins, tetR f
MQIDEHITGREPQQERGRQRVQTILDSAAAIVAQDGLAALSMQRLAKHAKTSIGSMYHFFPDRHAVIKALADRHTESVEALIRDMALASDDEWRRLSAEEVIQRLFSPYAQYLREHTDYLPLPGADRQSAAAAPPRNRRSGDPAANPAVAKPGGRHAAPYLQDSAAERGVHAGGAARRAEPVSGGKRGEHRLGASQFIRLFVRAAAGMIPCRD

SEQ ID NO: 114868 - protein, 102 aa, Glycine max
  Coding DNA Sequence Number=SeqID_23183
MNLVQRFLPPLYFSLFKLGDVRWGVIAQNQAWPIPTQPGHSQSVTTCDVPKQASSWQSTNKRTKVHKARRLVWRLASYLFCVISEKSPMVIDYHSWVINYRV

SEQ ID NO: 114869 - protein, 180 aa, Glycine max
  Coding DNA Sequence Number=SeqID_23184
  Homolog annotation: Hit_ID=Q2HW90; Match level="QueryCoverage=77%, HitCoverage=25%, E-value=3e-14, Identity=36%"; Hit description =Putative uncharacterized protein
VKGLDVTSLKELGRLMGPLQRQAFRKVYGKDSRFGRSGDILALLIFGVVLFPNVDGLVDLAAIDSFLAYHHSKESPVVAILADLFDTFDQRCEKNSARIVCCLPALCVWLISHLFRQDTRHPCPLQSYRSCAEKGRVVWDQHLAGIGGSTINWFPRWKEGKEGVLFSCGDYPNVPLIGTT

SEQ ID NO: 114870 - protein, 144 aa, Glycine max
  Coding DNA Sequence Number=SeqID_23185
MCTCAIFGSQDALSMHVCKFSQGSACDVGSKYTLEVHINNLGNKGALIAHGRLYAIFVLRVAFLGKTNFPNVCLLMTWPRGSLPHRGPGRIRRMKELVPLLSMTVTALGTLYTSSASRPSKDGRISGSDASCSRTTSILISRRR

SEQ ID NO: 114871 - protein, 60 aa, Glycine max
  Coding DNA Sequence Number=SeqID_23186
EMLAAQLAQASQVASSRSNSLLEEYSGGPKKWPQGSLPQRDSRKDKAAEGTSSAPEYDST

SEQ ID NO: 114872 - protein, 118 aa, Glycine max
  Coding DNA Sequence Number=SeqID_23187
MQSDNKNPSKPKPLVIHFTRDVATQKPRGFQPITVKKPTPFPYKSDKALPWKYAAQGPDGRNDAFIINVKNDLSFAKVINIFSMSGMTRSGRFFVAPKLSMWSKDPKGKSKGRCGRER

SEQ ID NO: 114873 - protein, 153 aa, Glycine max
  Coding DNA Sequence Number=SeqID_23188
  Gene Ontology: Mol. function=protein binding; Biological process =transposition, DNA-mediated
  Homolog annotation: Hit_ID=Q1J7G7; Match level="QueryCoverage=25%, HitCoverage=55%, E-value=2e-15, Identity=97%"; Hit description =Transposase
MLPTTDLVYDGVFEVLQWLLFLSAVPPVQLLTGWCVTAKAPPDISAGKCSGHAARRVPFAIQAAQLLGRAIGAGLFAITPAGERGMCCKAIKLGNASVFPSHDVVKRRPVNCNTTHYRANWSSTAVAAALELVDPPGCRNSIDRIFLRKWKFG

SEQ ID NO: 114874 - protein, 48 aa, Glycine max
  Coding DNA Sequence Number=SeqID_23189
MPVSGWMSETAIAVSRCYRRTRYFFLPCSLTFQKQTAHTGLVRENYGF

SEQ ID NO: 114875 - protein, 37 aa, Glycine max
  Coding DNA Sequence Number=SeqID_23190
MEKNEETTMEEKRNGEGIEREEMPLQEKMSLEEAPPP

SEQ ID NO: 114876 - protein, 219 aa, Glycine max
  Coding DNA Sequence Number=SeqID_23191
MGEAEEVQEKMKAEMEAMKEQMATMMEAMMSMKKIMEANAVVVAATSVVAKVNPMLPSGLKQMNHPTSNMVGKDLGSTDDPMMCKFKTSTTSCHMACLPNYTPPNVAYIPNEDVNNSTPILIKSQQPQSDHAHVSRPMGETHGMPHHNLADFEPCLGYATEGQAVGGIPLQNTLEGPQCHPQPQPSHSTAIKNPHAMAEMGKRKGSGPLKEVKIMPLLT

SEQ ID NO: 114877 - protein, 82 aa, Glycine max
  Coding DNA Sequence Number=SeqID_23192
MIGTSKPYTGAMRGTVHEPQPYTGAMRGIVHEPQVNIGADQKFSPVDVFKQEKEKGGQTLGFQWIDQTSNGSIAVTPKWSSD

SEQ ID NO: 114878 - protein, 146 aa, Glycine max
  Coding DNA Sequence Number=SeqID_23193
  Homolog annotation: Hit_ID=Q2HW90; Match level="QueryCoverage=43%, HitCoverage=13%, E-value=6e-07, Identity=39%"; Hit description =Putative uncharacterized protein
DQGLPMDPKRIKVIPEWPTPPTPLIELVRNYILSWEDGHERGVEERIHEFQEPLDLRQAFRKAYEKILDLTIAEVFMEAVVSLTQYYDQPLRCFTFGDFQIVPTVEEFEEILGCPLGGRKSYLFLRVSSLLEQDCSCGRGFGERVG

SEQ ID NO: 114879 - protein, 161 aa, Glycine max
  Coding DNA Sequence Number=SeqID_23194
MAVDTPLTVTEGIKQGSSQGVNPDKIVVEDLTAILFTFCSPKHYPVEFSLLRSTTALVMRPSHSVQVITHLLPVQSIGHERQRSCSSFQPYPRVLAQRFEGNNEFITLMLQMSWASSIAVTFMSNLLGKDLRIFLTSFSSVILSPKAVQALAISRMFMWKS

SEQ ID NO: 114880 - protein, 259 aa, Glycine max
  Coding DNA Sequence Number=SeqID_23195
  Gene Ontology: Mol. function=oxidoreductase activity, acting on the CH-OH group of donors, NAD or NADP as acceptor; Cellular component =cytosol; Biological process=metabolic process
  Homolog annotation: Hit_ID=A7MR93; Match level="QueryCoverage=100%, HitCoverage=62%, E-value=1e-130, Identity=89%"; Hit description =Putative uncharacterized protein
  Pfam annotation: Domain name=2-Hacid_dh; Domain location=13-240; Score=80.5; E_value=5.3e-21; Accession=PF00389.21; Description=D -isomer specific 2-hydroxyacid dehyd
  Pfam annotation: Domain name=2-Hacid_dh_C; Domain location=117-259; Score=121.5; E_value=2.5e-33; Accession=PF02826.10; Description=D -isomer specific 2-hydroxyacid dehydr
  Pfam module annotation: Pfam domain module=2-Hacid_dh::2-Hacid_dh_C; Domain location=13-240::117-259
MAKVSLEKDKIKFLLVEGVHQSALDNLRAAGYTNIEFHKGALDAETLKSSIRDAHFIGIRSRTQLTEEIFAAAEKLVAVGCFCIGTNQVDLSAAAKRGVPVFNAPFSNTRSVAELVIGEMLLMLRGIPEANAKAHRGIWNKIATGSYEARGKKLGIIGYGHIGMQLGVLAESLGMHVFFYDIENKLPLGNATQVRHLSDLLNMSDVVSLHVPETPSTQNMIGSEELALMKPGALLINAARGTVIDIPALCNALASKHLA

SEQ ID NO: 114881 - protein, 75 aa, Glycine max
  Coding DNA Sequence Number=SeqID_23196
MCKKILLSGQAGFRVHYCETHRTIELEIGAMSLRLDEDALELMSDALDESVTKLQALHATKGSFRAFMRQLNMPD

SEQ ID NO: 114882 - protein, 141 aa, Glycine max
  Coding DNA Sequence Number=SeqID_23197
  Homolog annotation: Hit_ID=A5BX59; Match level="QueryCoverage=92%, HitCoverage=51%, E-value=4e-20, Identity=41%"; Hit description =Putative uncharacterized protein
MEIFIQPFDPGAWNTIVKGPFIPTKEVNGELVPKEWDQMKDDEKRKNGETILELQTRFTHIVNHLLGLGKMFEGDELSIKILNYLTRNWEPKITMIKESRDLASMSMEALFEKLLAYEYELIQQSHAEEIKNEKKRNCTQI

SEQ ID NO: 114883 - protein, 197 aa, Glycine max
  Coding DNA Sequence Number=SeqID_23198
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=18%, E-value=1e-107, Identity=100%"; Hit description=DNA- directed RNA polymerase subunit beta
  Pfam annotation: Domain name=RNA_pol_Rpb2_1; Domain location=14-190; Score=139.5; E_value=9.3e-39; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARVSRKQKISILVLSSAMGSNLSEILEN

SEQ ID NO: 114884 - protein, 112 aa, Glycine max
  Coding DNA Sequence Number=SeqID_23199
  Pfam annotation: Domain name=zf-CCHC; Domain location=14-30; Score =15.9; E_value=0.006; Accession=PF00098.14; Description=Zinc knuckle
  Pfam annotation: Domain name=zf-CCHC; Domain location=37-54; Score =32.1; E_value=2e-06; Accession=PF00098.14; Description=Zinc knuckle
  Pfam module annotation: Pfam domain module=zf-CCHC::zf-CCHC; Domain location=14-30::37-54
MAASNMSQSRGTGVQCFQCGGPHLKRNCPQLQQTQENRCYVCGKVGHYARECRVTGRPTVTANSNTVNRGPTNSTRSGNVSNNNISGGRPKVPSRVFAMSGSEAAASDDLIR

SEQ ID NO: 114885 - protein, 57 aa, Glycine max
  Coding DNA Sequence Number=SeqID_23200
MHPASHASPSRRRCMLEVMQSYPARALDRKLQVDWARYAREGPRVLMRLRVDFGSMG

SEQ ID NO: 114886 - protein, 157 aa, Glycine max
  Coding DNA Sequence Number=SeqID_23201
MAKLDPDIVLEFYVNAWPTEEGVRDMRSWVRGQWIPFDADALSQFLGDPLVLEEGQECEFSQRRNRADGFDEEAITQLLCIPGQDFAQTTTRRLVQIIRTNMSPTRHPLDPDKSNRALGFPALITGLCQSFGVPVTPSKVIRPSITRAFIEKYCMPR

SEQ ID NO: 114887 - protein, 180 aa, Glycine max
  Coding DNA Sequence Number=SeqID_23202
  Gene Ontology: Mol. function=acyl carrier activity; Biological process=fatty acid biosynthetic process
  Homolog annotation: Hit_ID=A4C1B7; Match level="QueryCoverage=66%, HitCoverage=91%, E-value=1e-21, Identity=40%"; Hit description =Putative uncharacterized protein
  Pfam annotation: Domain name=4HBT; Domain location=19-101; Score =12.1; E_value=0.023; Accession=PF03061.13; Description=Thioesterase superfamily
  Pfam annotation: Domain name=Acyl-ACP_TE; Domain location=2-177; Score=-113.5; E_value=0.014; Accession=PF01643.8; Description=Acyl -ACP thioesterase
  Pfam module annotation: Pfam domain module=4HBT::Acyl-ACP_TE; Domain location=19-101::2-177
MSLVYEKQIKVTEENIDQNKHVNNVQYVSWVEEIATEHWDSVKHLTEYPEDIWMLLDHHIQYKKQVYLNDVITVKTYPKNPEGIRQPRKVEFYCNGELVVDSLTLWVLIDSKTQRIQRLKMKGKPINDLENPKNGMVVDFGDIKSIVKSEIVDVWDHAVLINGLSPHKELVKILKKEGIK

SEQ ID NO: 114888 - protein, 162 aa, Glycine max
  Coding DNA Sequence Number=SeqID_23203
MIRGDTLRLFAPFCHPEAAGPMTSRDQVWSFCTLVSSRGGPRGGPDDTRRYLTVIRTLLSSRGGGPDDKQRPKAAGPMIRGDTLRLFTPFCHPEAAGPMTSRDQVWSFCTLVSSRGGGPDDTRRYLTVIRTLLSSRGGGPDDKQRPSLVILHPCIIQRRRAR

SEQ ID NO: 114889 - protein, 71 aa, Glycine max
  Coding DNA Sequence Number=SeqID_23204
MGVKYLEAVKRRLHATKQWSPDKIRAINSWGSGLDGGGCMNNARQSIHGAPDLMMEDARTALGNQFVRLRT

SEQ ID NO: 114890 - protein, 155 aa, Glycine max
  Coding DNA Sequence Number=SeqID_23205
MTSRRPSLVILHPVSSRGGGPDDTRRYLTVIRTLLSSRGGGPDDKQRPNLAAGPMTSRDQIWSFCTLVSSRGGGPDDTRRYLTVIRTLLSSRGGGPDDKQRPKAAGPMTSRDQIWSFCTLVSSRGGGPDDTRRYLTVIRTLLSSRGGGPDDKQRP

SEQ ID NO: 114891 - protein, 385 aa, Glycine max
  Coding DNA Sequence Number=SeqID_23206
  Gene Ontology: Mol. function=oxidoreductase activity, acting on paired donors, with incorporation or reduction of molecular oxygen, NADH or NADPH as one donor, and incorporation of one atom of oxygen; Cellular component=...
  Gene Ontology: Cellular component=extracellular space; Biological process=ubiquinone biosynthetic process
  Homolog annotation: Hit_ID=A6TDR9; Match level="QueryCoverage=100%, HitCoverage=98%, E-value=1e-146, Identity=68%"; Hit description=2 -octaprenyl-6-methoxyphenyl hydroxylase
  Pfam annotation: Domain name=DAO; Domain location=1-229; Score=-55.7; E_value=0.048; Accession=PF01266.15; Description=FAD dependent oxidoreductase
  Pfam annotation: Domain name=FAD_binding_3; Domain location=1-340; Score=-67.5; E_value=6.9e-08; Accession=PF01494.10; Description=FAD binding domain
  Pfam module annotation: Pfam domain module=DAO::FAD_binding_3; Domain location=1-229::1-340
GGMTGATLALAISHLTQGQLPVTLIERHQPDSRAHPGFDGRAIALAAGTCQQLAEIDLWRSLADCATPITHIHVSDRGHSGFVQLQAEDYQLSALGNVVELYDVGQRLFKRLREAPGVTLCCPDHVTSVTRSADSVQTTLSSGATLQGALLVAADGARSPLAASCGIRWQRDDYQQLAVIANVATQLPHQGRAFERFTRHGPLALLPMSGNRLSLVWCHPAAAEATVKQWDDATFLHELQRAFGWRLGRFTHAGQREIYPLALQTAERQVTHRLALVGNAAQTLHPIAGQGFNLGLRDVMSLAETLAAAHRHQQDPGSHAVLHHFAARRQPDRAATIGVTDGLVRLFANRYAPLVAGRNLGLVAMDHLPWLRNPLAVRTLGWVKR

SEQ ID NO: 114892 - protein, 186 aa, Glycine max
  Coding DNA Sequence Number=SeqID_23207
  Homolog annotation: Hit_ID=A6WZK3; Match level="QueryCoverage=61%, HitCoverage=67%, E-value=5e-55, Identity=86%"; Hit description =Putative uncharacterized protein
  Pfam annotation: Domain name=UPF0153; Domain location=70-128; Score =43.8; E_value=6.1e-10; Accession=PF03692.6; Description =Uncharacterised protein family (UPF0153)
MATILRTMGRMARRTGKATTHERAHAVIQLDARLGWAMPRVLAVAINDTMNGRRNETSMRIAVPGEIDALPNDDDTNEIYWTSVACTLLNPDSCQCRDYPNRKKTVPDCVFLTPEIVDEVDWLPVTCAYRLVAEGSDLYWWHPLISGSPETVHEAGISVRGKVTAFDHDLEDDDDYLDHMVMPSHR

SEQ ID NO: 114893 - protein, 230 aa, Glycine max
  Coding DNA Sequence Number=SeqID_23208
MWAWEHCTTLAPKRTPPIIENKPLGHMWLRRGNQHIGNDDLIVFRCKLDIMKRHEFLWEPYTATVMSMLPPIYLVGSMAWRKTKMFIDPNNASTTTLGEVTETLQYMVSPQGRNTWTVDDLVPYVEKLAILSQEQERITEPVAHGPASERRFPPQEFHMLQSSVETRGFDRRREIVQAEDFSQHMEQRGHGMYYTPPTFAQYPSQMYQYPFEGHDTDMSATDSRNNFIIF

SEQ ID NO: 114894 - protein, 165 aa, Glycine max
  Coding DNA Sequence Number=SeqID_23209
  Homolog annotation: Hit_ID=A6WZK9; Match level="QueryCoverage=83%, HitCoverage=83%, E-value=1e-71, Identity=94%"; Hit description =Conserved hypothetical signal peptide protein precursor
  Pfam annotation: Domain name=IalB; Domain location=32-162; Score= -20.5; E_value=0.024; Accession=PF06776.3; Description=Invasion associated locus B (IalB) prot
MRKNATTVALALAGLVASSLAASAKTSYLGEFRDWGVYQNTELAGNKCYALTVPVNFHPAGVRHGDNFVIISKADGQYSPQLVMGYQLKADSSVNVMVDGARFPFFSEGNRAWAENVADEAKLIRAMRAGKTLNVQATSARGTQTRYTFSLMGLSASLQRVDSCR

SEQ ID NO: 114895 - protein, 264 aa, Glycine max
  Coding DNA Sequence Number=SeqID_23210
  Homolog annotation: Hit_ID=Q2HSI5; Match level="QueryCoverage=94%, HitCoverage=66%, E-value=6e-17, Identity=31%"; Hit description=IMP dehydrogenase/GMP reductase, putative
CWIYEHFPSVAESTTDQDYDEASPRACRWIATKKTVKSIRTPAYTERLDRLRILDVCWIPYGEHREVQDFHVRSCYSGLLRWGPVAVYYRSERVVRQFGYTQTIPASPVDSWVSYDDIHDRWMHYEDHIVPADEVCVVPGACSSDFLDWFFRISHPFMTPGHTLDPLPHGHALQPRVVPQAPQTDIPHVPEPGALSTSTEEPRHAVEVCDDIAERLERHLSLGVVTPGSSTHEVIEECLRLARSVTQDHLVYVRCRRRRRTDQA

SEQ ID NO: 114896 - protein, 135 aa, Glycine max
  Coding DNA Sequence Number=SeqID_23211
MVPIIGLPLLRTFEVDRQHPSEVIRYDPAKGFSEAIHLANSLAKRFCVSLLVNAFKNTEGLGLYVALRRLPSQVLQAPRTLWGPLGLKDSIGLTIRHLLQVFIAVFPYGVTLCRIPTPDPNGHSKPYQRGHRDTS

SEQ ID NO: 114897 - protein, 176 aa, Glycine max
  Coding DNA Sequence Number=SeqID_23212
LFRLTDSKKVYTDNHSGISARQRDSKVSITDLVSAEDDVAEDEVSLYVLSGFSSYRQQKVYTDNHSGISARHRDSKVSMTDLVSAEEDGAEHDISLCVLSGFSSYRQQKVYTDNHSGFSARQRDSKGAEDDVSLCVLSGFLSYRQQKVYTDNYSGISARQRDSKVSMTDLVSAEDD

SEQ ID NO: 114898 - protein, 34 aa, Glycine max
  Coding DNA Sequence Number=SeqID_23213
SKYFCNASVSDSVEILHRSSSFFTVLHPFFVLQR

SEQ ID NO: 114899 - protein, 38 aa, Glycine max
  Coding DNA Sequence Number=SeqID_23214
MAKRMENSGRRMSCIEVLSKGQLAKCTVFTFRLSLRDN

SEQ ID NO: 114900 - protein, 153 aa, Glycine max
  Coding DNA Sequence Number=SeqID_23215
MCIVNGVEMIISVVVWKAIEGIDMGGVRKFEDPMDGYSKMETYRGMLLDPTRILRNQQGVGGLTMLVYIITYILAPRATNDAQVTDNDLQIKYGPKLAFTKASNEITERHLKKLGMTYVDYEWIMAGEQPTTANVNQMEEKAKEEARQKLAQQ

SEQ ID NO: 114901 - protein, 83 aa, Glycine max
  Coding DNA Sequence Number=SeqID_23216
  Subcellular localization annotation: CTP_CleavageSite=49; ConfidenceScore=5.40e-01
MSFVARNPEVTSQPIQARSIPLVKLNMAFMSTWQATSSNMVSIGMFNSRLVAKWGLFLDPWYPMRVICPLILVIHLLLPLGVK

SEQ ID NO: 114902 - protein, 88 aa, Glycine max
  Coding DNA Sequence Number=SeqID_23217
MGGANRNYQIWAFPCLRWKQPSSPGQAEITWRVNLSRWGANRNFQIFEFGPSGTFWKLGYLRRKQPSSPGRAELAWASWAATSSPIFL

SEQ ID NO: 114903 - protein, 85 aa, Glycine max
  Coding DNA Sequence Number=SeqID_23218
KPSHVFKLKKALYGLKKAPRAWYEHLSKFFLEKCGSNAFQGYFDDAKESTVKQIPKIQESSFKNQDSRIIKIKIQDSRFKNQEKT

SEQ ID NO: 114904 - protein, 251 aa, Glycine max
  Coding DNA Sequence Number=SeqID_23219
  Pfam annotation: Domain name=MAP7; Domain location=5-175; Score= -69.2; E_value=0.014; Accession=PF05672.2; Description=MAP7 (E-MAP -115) family
MSHHSSSVNGEGTSHKDPLSRILDELSSLKLWKEKQERKEKEKQERKEKGKKRVEEISQDERKKIREEERRKIMKEMKREKHASYSSHNSCKSLSEELRDYYEGRHRPHLRTHSHRREKERKPQEANINLPYFHGKDNVEANLVWEIRVEQQLKKKSTPKSYGSHSYPKKDQGQGILEVTPSKPKDDKGKTIEKLAPKASMQEKTSSINQDEATTSPSSSESEEAKWEESSEEIYPQEEGQPLVVKEKCKE

SEQ ID NO: 114905 - protein, 81 aa, Glycine max
  Coding DNA Sequence Number=SeqID_23220
MTTIRVILSIVAAENLHLEQKCQQVSEKQQLKKTFESEGSCPETSTAKKNEEKSWSLTKLPEGKKALQNRWVYRLKEESDG

SEQ ID NO: 114906 - protein, 35 aa, Glycine max
  Coding DNA Sequence Number=SeqID_23221
MAHQVHILWISSSGGYIHLVVQENKGGYMPCGSLL

SEQ ID NO: 114907 - protein, 62 aa, Glycine max
  Coding DNA Sequence Number=SeqID_23222
MDYADDEVHEQPEEVVVDDVATDAEGFSGGPHDISVLQDYERPELKFSSHGRKVEKFGKSAP

SEQ ID NO: 114908 - protein, 204 aa, Glycine max
  Coding DNA Sequence Number=SeqID_23223
  Homolog annotation: Hit_ID=Q84VH5; Match level="QueryCoverage=68%, HitCoverage=24%, E-value=2e-69, Identity=81%"; Hit description =Envelope-like protein
CYGSLVREFIVNIPSDITNRKSDEYQKVFVRGKCVRFSPAVINKYLGRPTDGVVDIAVSEHQIAKEITAKRVQHWPKKGKLSAGKLSVKYAILHRIGAANWVPTNHTSTVATESFAVKLPIAFPTVLCGIMLSQHPNILNNIDSGKAAASGAVSKDALIAELKDTCKKSGIDGEAAEEDGEAAEVEEEAAEEEEEAAEEEERSC

SEQ ID NO: 114909 - protein, 126 aa, Glycine max
  Coding DNA Sequence Number=SeqID_23224
LHAETGPGGCSVGRRRAATSSGRSNRIVDTEHYLWHLVRQQAANHRAHVQTHDCLYHMSLSLQSQDFTSFPCPTPDQFRAEVAWPGDWPEARAGEAPAEAPDEADEAREDEEMADLLDFLGGSGAT

SEQ ID NO: 114910 - protein, 155 aa, Glycine max
  Coding DNA Sequence Number=SeqID_23225
MAHRDKLWSFCAFCHPEAASPMTCKDQLWSFLTLFRHPEAIVSDGAQRQIMVIMHLSIQARSCSMARTNYGHSAPFHPGSIVSDGTQRQIMVILRPFVIQRQSCPMTCEDKLWSSRQIMVILRPLSFRSSESSDKRAETNYGHSAPFVIQEQRVE

SEQ ID NO: 114911 - protein, 66 aa, Glycine max
  Coding DNA Sequence Number=SeqID_23226
MALVIGPFLGRIASTKAQKEKKMKFIFCVFSGKRDELAKRDYRAKRVHLLRMNSHPLAEMPMAKRG

SEQ ID NO: 114912 - protein, 93 aa, Glycine max
  Coding DNA Sequence Number=SeqID_23227
MASRKHKSISSRPTTQYDTRRFHFLDAWNWYTDNVLGRNILPERKVKLYHIEFDDFKTKLERRNLHKHLTNLVDGSIDVALVKEFYANLYNFE

SEQ ID NO: 114913 - protein, 81 aa, Glycine max
  Coding DNA Sequence Number=SeqID_23228
MPKCPRCEVSQYKVKDDDEYSSDENSKKGPPAKMMQKTLHDMQMGKTAMECSVIQLIPPSGKRLIVCIQILAKRQEILGLD

SEQ ID NO: 114914 - protein, 99 aa, Glycine max
  Coding DNA Sequence Number=SeqID_23229
  Subcellular localization annotation: CTP_CleavageSite=45; ConfidenceScore=5.33e-01
MGTAPTRHPVDPKKSNKALGFPALGSRLQDTPVDPKKSNRVLELSSSKYGSLSVQGSACLPPAGSSGPLPIEFSSRSVAPPGRGRARHHSSIGMDGSGQ

SEQ ID NO: 114915 - protein, 163 aa, Glycine max
  Coding DNA Sequence Number=SeqID_23230
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=57; ConfidenceScore=5.03e-01
MKHFTDNLISANIETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 114916 - protein, 121 aa, Glycine max
  Coding DNA Sequence Number=SeqID_23231
MVKVEPLRADQRLISPKVGPGLPGINRDTRIYLFCEHRRTSALASVAVTLRVTTTPAALNAPLQGASHSPFRLRNCWEGRSVRASSLLRQLAKGGCAARRLSWVTPGFSQSRRCKTTASEL

SEQ ID NO: 114917 - protein, 186 aa, Glycine max
  Coding DNA Sequence Number=SeqID_23232
LHWLAKLKIVNEKNFEAHEEDEEVRALKAELGKARLAKEKFKLVATDVQKECAGLQEENAATAKALEQETKRARKEEHGHDKFRGALWGSNSEFKLRREERDRSRAHSMVLKEELAVCSRSKRNLSQRLCETETKLAIITKYQEELSLATAHEHRVADEYAQVYAEKEARGRVIDSLHQEATMWMD

SEQ ID NO: 114918 - protein, 67 aa, Glycine max
  Coding DNA Sequence Number=SeqID_23233
MDRAHKTPSGPRKVQQGPGFYGEPVAPNKVIRPLINWAFIKKYYAPPPPVRRMARHHSSLEMASSGQ

SEQ ID NO: 114919 - protein, 153 aa, Glycine max
  Coding DNA Sequence Number=SeqID_23234
MPSTHVLRKGDTAFFRWFAPLMWDRRTHMQSYSRAAGIVQLIQPLVPTSGMFGYLPHEKRTHSFPSFHRGNQLIVLPPIPAKSWSQSILLFSVHERWLRSGHGCLVSCWNKCETNQTQRAGKQQMIRALLFSHLRSNVSNRSAKTATTGLSLL

SEQ ID NO: 114920 - protein, 190 aa, Glycine max
  Coding DNA Sequence Number=SeqID_23235
MRRQNLVIPHPFAIQTKSCPMARRDKLWSFCTLLSSRGGGPDDMRRQNLVIPHPFAIQTQSCSMARRDKLWSFCTLLSSRGGGPDDMRRQNLVIPHPFAIQTQSCPMARRDKLWSFCTLLSSRGGGPDDMRRQIMVIPHPFAIQTQLCPMARRDKLWSFCTLRQSRPTSPLTRGDLHHKICHTDSQDLSY

SEQ ID NO: 114921 - protein, 184 aa, Glycine max
  Coding DNA Sequence Number=SeqID_23236
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=5e-27, Identity=34%"; Hit description= UPI00006A17C9 related cluster
  Subcellular localization annotation: CTP_CleavageSite=21; ConfidenceScore=5.55e-01
MKAWACSPLKARTCSPLKVRMCSHLKEKTCSRLKVRTCSPLKARTCSPRKVRTCSPMKARACSPLKVRTCSPLKVRACSPLKVRMCSPLKARTCSPLKARACSPLKGRTCSPLKARACSPLKVRTCSPLKARACSPLKAKACSPLKARTCGPLKARTCSPLKVRTCSPLKLRVLVLMVHPYEKT

SEQ ID NO: 114922 - protein, 208 aa, Glycine max
  Coding DNA Sequence Number=SeqID_23237
MTKDADNHKVRPRATGPSGHDSRIETFSRSRPEDADISGKGADDYIGLYNHKVSPHATGPLGHDSEIETFSRSRPKDADISGKGTDDHIGADNHNVCPRATGPFGHDSEIETFLWSRSEDADISGKGADNHKVSLHATGLTGHNSRMGWSTKAHVGYLTVNDSSFLGDPTVPSSEGKVYGGLRFWLKRLVERLVMIYVRVLVWSAIQG

SEQ ID NO: 114923 - protein, 71 aa, Glycine max
  Coding DNA Sequence Number=SeqID_23238
MSQNFTYCATKGAQYLEAVKQRLHAIKQCVVLGVISFNDIRVYWRRQFLVVHASEYQGPPRETFLTTNDPS

SEQ ID NO: 114924 - protein, 43 aa, Glycine max
  Coding DNA Sequence Number=SeqID_23239
IIQSDGLAAALFSAVEVSDSALVEEAGVDDDSTFSRVSIRSGD

SEQ ID NO: 114925 - protein, 60 aa, Glycine max
  Coding DNA Sequence Number=SeqID_23240
KEMVSQPVPHKESQRYMMQAPLELVGLESSSSMDSFASWKMNGSGMEKGKERGDATSRRR

SEQ ID NO: 114926 - protein, 118 aa, Glycine max
  Coding DNA Sequence Number=SeqID_23241
ANKPVTRRGYIVSAHLSSRGGKPDDMRGCRTVIRTFCQSGPTNPLTRGDTQVVIRKNGFCHLDPRSQVTCGGTVWFLLSSSGDIQARRRTRFFSAGQGRSSAIAWGSVVVPLVGILTG

SEQ ID NO: 114927 - protein, 92 aa, Glycine max
  Coding DNA Sequence Number=SeqID_23242
MNQQEAFRSYLLGWCKPTGGHHAQRIHISNHQSVYLQMRRDLCTVSAVLHMRTMRKRKWRKESEFLESRNVIDFDSKNPFASLMVPPYEGII

SEQ ID NO: 114928 - protein, 45 aa, Glycine max
  Coding DNA Sequence Number=SeqID_23243
MTSIYSLSDAILPRKGPVTRAMSKRLQEDWARVDKEGLRVLMNLR

SEQ ID NO: 114929 - protein, 181 aa, Glycine max
  Coding DNA Sequence Number=SeqID_23244
  Homolog annotation: Hit_ID=Q6UUU1; Match level="QueryCoverage=33%, HitCoverage=40%, E-value=1e-18, Identity=78%"; Hit description =Putative uncharacterized protein
  Subcellular localization annotation: CTP_CleavageSite=50; ConfidenceScore=5.05e-01
LGTVTQLPVHPASPVLLTKNGPLGALDSMARLNRAAAPSYHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114930 - protein, 248 aa, Glycine max
  Coding DNA Sequence Number=SeqID_23245
  Gene Ontology: Mol. function=beta-lactamase activity; Cellular component=nucleus; Biological process=beta-lactam antibiotic catabolic process
  Homolog annotation: Hit_ID=P62593; Match level="QueryCoverage=100%, HitCoverage=97%, E-value=1e-112, Identity=78%"; Hit description=Beta- lactamase TEM precursor
  Pfam annotation: Domain name=Beta-lactamase; Domain location=31-248; Score=53.2; E_value=9.3e-13; Accession=PF00144.15; Description=Beta -lactamase
MSIQHFRVALIPFFAAFCLPVFAHPETLVKVKDAEDQLGARVGYIELDLNSGKILESFRPEERFPMMSTFKVLLCGASQKSIYGWHDSRDMQCCHTMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEI

SEQ ID NO: 114931 - protein, 150 aa, Glycine max
  Coding DNA Sequence Number=SeqID_23246
MIRGDTLRLSAPFCHPEAAGPMTSRDQVWSFCTLVSSRGGGPDDTRRYLTVIRTLLSSRGEAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 114932 - protein, 108 aa, Glycine max
  Coding DNA Sequence Number=SeqID_23247
  Pfam annotation: Domain name=zf-CCHC; Domain location=57-74; Score =19.6; E_value=0.0017; Accession=PF00098.14; Description=Zinc knuckle
MELMRLNQHDENDKKKKRIALKASSSIQEESDKEDKGNQRKENFNSKKRREDSCSVPKCYECNQPGHLRVDYPSFKKRMEKYDRKTDKDKKAKKAYIVEASFMMLNQD

SEQ ID NO: 114933 - protein, 171 aa, Glycine max
  Coding DNA Sequence Number=SeqID_23248
MGTNQTGKRFCQVKVKSLDTTSIKELGRLMEPLQMQAFRKTYGKILELTIAEDVLSGEETISFLRVSPLFEQNCNCGQGFSKRFGPHKTDSERHSGPTTEVPRRQGEGLANQGDWVPFMDVLALLIFGVVLFPNVDGLIDLVAIDAFLAYHHSKESPVVAVLADLFDTFDQ

SEQ ID NO: 114934 - protein, 66 aa, Glycine max
  Coding DNA Sequence Number=SeqID_23249
MEGTHEIPHHNLANFKPCLEYATDGQVVGASPTMAEMGKLDQIEEILRVVEGGEDYTLADMEDLWP

SEQ ID NO: 114935 - protein, 111 aa, Glycine max
  Coding DNA Sequence Number=SeqID_23250
MPFRVCVVRSKPLAESLTTVAILLKEGRHPEERYGFLPPRGHPRISSNSSMVGTNLEVSECEASQAGRSIGEDAMASMDTSAKVNSRSFRKSAEGLHLRGPINRPNSLMLV

SEQ ID NO: 114936 - protein, 91 aa, Glycine max
  Coding DNA Sequence Number=SeqID_23251
MSNSDSNTYHRAIRPVRVGFSKMYLTGSILDTSQVVWLKKEGSPGHRWHKYQGVHEALFDSSNCLLTVIVPANGLILVKELEERLVGSCEL

SEQ ID NO: 114937 - protein, 192 aa, Glycine max
  Coding DNA Sequence Number=SeqID_23252
  Homolog annotation: Hit_ID=Q2HW90; Match level="QueryCoverage=92%, HitCoverage=35%, E-value=8e-21, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARIVCCTPALYVGLVSHLFLQEGRPVYPLQ

SEQ ID NO: 114938 - protein, 133 aa, Glycine max
  Coding DNA Sequence Number=SeqID_23253
  Gene Ontology: Mol. function=tetracycline:hydrogen antiporter activity; Cellular component=integral to membrane; Biological process=response to antibiotic
  Homolog annotation: Hit_ID=Q47336; Match level="QueryCoverage=36%, HitCoverage=54%, E-value=2e-20, Identity=95%"; Hit description=LacZ -alpha peptide
  Subcellular localization annotation: CTP_CleavageSite=33; ConfidenceScore=5.34e-01
MKHFTDTLISAQHSKPVYTPLAPNTQTASPRALADSLMQLARQVSRLESGHPGDPLVLERPPPRWSSNSPYSESYYNSLAVVLQRRDWENPGVTQLNRLAAHPPFASWRNSEEARTDRPSQQLRRLMANGRAL

SEQ ID NO: 114939 - protein, 49 aa, Glycine max
  Coding DNA Sequence Number=SeqID_23254
MWVPIAIFKFLDLDLSRTVLKQGCLWRKQPSSPRKSKLRCFRNAFETFS

SEQ ID NO: 114940 - protein, 76 aa, Glycine max
  Coding DNA Sequence Number=SeqID_23255
MAVEWRRKRERRRHFKEKMSLEKAHRHRRPWIRAWRKKEMNEGRGREEHEILCSKRALKSEPTNPRSIPRFSTKCA

SEQ ID NO: 114941 - protein, 79 aa, Glycine max
  Coding DNA Sequence Number=SeqID_23256
  Subcellular localization annotation: CTP_CleavageSite=33; ConfidenceScore=5.30e-01
MKMLLIPHDVSSIGACRPSVATYPSAGGRRVTRGMRVPRKEYARSRHQPLFEENVGKTGKDAIYELLSERFGSCIYARG

SEQ ID NO: 114942 - protein, 110 aa, Glycine max
  Coding DNA Sequence Number=SeqID_23257
  Subcellular localization annotation: CTP_CleavageSite=49; ConfidenceScore=5.02e-01
MYPLLFSVRTTQVDVPSTCTTKDVPSNVLRQSSQAIVQENDRSHPAQVVAAQIRTLLYKHEGCTSFPPSPRLKSYFRGFSDMGGSVLHVHTYMTEEAWTARHVGEAQQGN

SEQ ID NO: 114943 - protein, 227 aa, Glycine max
  Coding DNA Sequence Number=SeqID_23258
MIMRGQDIYSSQDKATTSPCSSKSEEAKGEESSEEIYPQEEGQPLMVKEECKEVSVSSKRLAKKERHFVIKTNIKEISLLRQPPHFLLCKKTLVSIATSLRLEFIPQVKELLDEGLVRKRLNPCALLVPKIGIIRHQIPKIGGVMNALGGATLFCRITRAPNIFMICVHRDSLGVPMNPKRIKVIPEWLAPPSVEEKSLEFQEPQDLRSNPFQGGGNDAILPHKGIG

SEQ ID NO: 114944 - protein, 224 aa, Glycine max
  Coding DNA Sequence Number=SeqID_23259
  Gene Ontology: Biological process=transposition, DNA-mediated
  Homolog annotation: Hit_ID=Q6UUU1; Match level="QueryCoverage=26%, HitCoverage=40%, E-value=2e-18, Identity=78%"; Hit description =Putative uncharacterized protein
  Subcellular localization annotation: CTP_CleavageSite=55; ConfidenceScore=5.11e-01
MVKVGTSYVPINVSFSPKVGQGFPVLQWLLFLSAVPPVQLLTGWCVTAKAPPDISAGKCSGHAARRVPFAIQAAQLLGRAIGAGLFAITPAGERGMCCKAIKLGASPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114945 - protein, 121 aa, Glycine max
  Coding DNA Sequence Number=SeqID_23260
MGSSQKPSLKKRFYQVKIKSLEVTSLRKLGQLMGQLQRQAFRKAYGLRTLLDYLTLALLHLEFFLFRIWKGVVDLAAIDAFLAFHHGKESPVVAILAMYVTRSTGDVKRAELFVVTNSWEY

SEQ ID NO: 114946 - protein, 44 aa, Glycine max
  Coding DNA Sequence Number=SeqID_23261
MGVQIAPRPTWALQKIPPEGGIPQRFEPFFDVLHSFFIVLRSST

SEQ ID NO: 114947 - protein, 94 aa, Glycine max
  Coding DNA Sequence Number=SeqID_23262
MKKKKITSYGSRFDEEMSKIGRFEGLGMEGRRKEEETAQGFLKNVVFIDQDALWRQPTGNRLHEYCNRLQAICSSVIDYSIHVIDYQNKTIAFS

SEQ ID NO: 114948 - protein, 30 aa, Glycine max
  Coding DNA Sequence Number=SeqID_23263
MASGLKRRIYRCTNFCTELKDSAVPKVKKT

SEQ ID NO: 114949 - protein, 138 aa, Glycine max
  Coding DNA Sequence Number=SeqID_23264
MTSTITKLFLRPYQVTWDAIMFRVFSPDFPLYRKHEDHSEIAHGGQYLSISVLQLHLTETSMRAGNSDKYGFLEPQSIQRSGQSQFETESYIKSWMQSSKCDVYIGAYLNGPNNYFKGIINSALKGLDDAPHLSQGSY

SEQ ID NO: 114950 - protein, 132 aa, Glycine max
  Coding DNA Sequence Number=SeqID_23265
MSISPCGSISWSVSFRHRDRARKTPSGPEEVQQGPGVSNSGITPTRHPVDPEKSNRVLELPALITGLCRFYGVPVAPSKVIRPPTNRAFIKKYCALKQAQGETPQQFEDGLQRATDAPPLPLEFTSAHPQKG

SEQ ID NO: 114951 - protein, 142 aa, Glycine max
  Coding DNA Sequence Number=SeqID_23266
MKLVLRCDALKDSLSKVALGMTLREEPLSISILATMWSKHLIDTCKALFCPRPSTGICSSAKELGCFFSEYSPFAEVILFLGKPSNKDLVILNRAHPIARFHAHLCFPLQVFGSHRWFGCCEDPLATSHATCTRYVCDLTGG

SEQ ID NO: 114952 - protein, 192 aa, Glycine max
  Coding DNA Sequence Number=SeqID_23267
FYANLYDPEDKSPKQVRGETLCAYSRFALPRPDPQELAAKLCIPGRGFELNADGQDLKIPRKNMTTLAHTWSVLSFSNLIPTSHTSNHDTSRLGFPALITTLCKARGVQSDWRSLESLSPAINLAYIKKNCWNLDDPIVTFRGPKKARGKRSEAPATSASEAPTPSSSTVSCPNFVRGPLLDDMRPFFGPCE

SEQ ID NO: 114953 - protein, 90 aa, Glycine max
  Coding DNA Sequence Number=SeqID_23268
MTGPLDESISCFLIRVDLGGLHVLAFKGSCTFNFRGLHVLAVKGSCAFTFVGLHTLTFRGLHVLTFRGLHVLAIRGLHVPHFQRGTCAHL

SEQ ID NO: 114954 - protein, 128 aa, Glycine max
  Coding DNA Sequence Number=SeqID_23269
  Homolog annotation: Hit_ID=A5BSR3; Match level="QueryCoverage=97%, HitCoverage=40%, E-value=3e-08, Identity=30%"; Hit description =Putative uncharacterized protein
DKQKLRTYSGIAARDKVDTTYENWKEVPTAQKDLIWEDIQDVRIKAHAIQKQNTAPHVLSRGGYDYLEQKLLAEKTKKKMQEVAQSGSVDGVIDPPSPVRRHVKWKMAHTKKTGEMTTEAAKEIAEKI

SEQ ID NO: 114955 - protein, 68 aa, Glycine max
  Coding DNA Sequence Number=SeqID_23270
  Gene Ontology: Biological process=transposition, DNA-mediated
  Homolog annotation: Hit_ID=Q1J7G7; Match level="QueryCoverage=48%, HitCoverage=47%, E-value=1e-11, Identity=96%"; Hit description =Transposase
FPGITGTPGLFILRSDLPSQVLQWLLFLSAVPPVQLLTGWCVTAKAPPDISAGKCSGHAARNHHTRRA

SEQ ID NO: 114956 - protein, 87 aa, Glycine max
  Coding DNA Sequence Number=SeqID_23271
MQLIKQIIKSRNGVPILYRDVVDGPAIYTHSPCTILFGHQQHRHNTWAQALLDPALLQQFFNLRLYLFSLLTVSPIGWPIRKACSWD

SEQ ID NO: 114957 - protein, 127 aa, Glycine max
  Coding DNA Sequence Number=SeqID_23272
MYPPLELIHKRCTLSCSQSNQVDVPSTCTTKDVPSNVLRQRSQAVTPLILCEWGYKRILKREWEESKEFSDCVVLNSLTREKGDTKEFRRLVLPSFGKGRRETQKEFRRLVLREFFLAKGEENGKDE

SEQ ID NO: 114958 - protein, 229 aa, Glycine max
  Coding DNA Sequence Number=SeqID_23273
  Homolog annotation: Hit_ID=Q6ATS9; Match level="QueryCoverage=83%, HitCoverage=23%, E-value=2e-07, Identity=23%"; Hit description =Putative uncharacterized protein OSJNBb0056O10.12
MASPPASPHSPPPPPPPLPFDASALSPPGAERPVVHIDPTNGKADDPHRKKLRTYLGIVAHDKVDVTYKNWKEVPTAQKDLIWEDIQDGVDDTVYEKYSIRKEKWSQFCQTRRDPSWEDVRKKAQAIQKQNSAPHVLSHGANLLAEKTKKKLEEAAQSGSVDDIIDPLSLVRRHVKWKMVRTKKIREMTTEAAKEIAEKIGSFVPHGCQDVFSTAIRCPEHLGRVHAAG

SEQ ID NO: 114959 - protein, 86 aa, Glycine max
  Coding DNA Sequence Number=SeqID_23274
MTKLGLCVPSDTTVSEWQRGADNRKVSPRISAYHGCRMTKLGLCVPSDTIVSEQRGADNRKIDQTWSLLPSDPTVSEWQRGADNLK

SEQ ID NO: 114960 - protein, 208 aa, Glycine max
  Coding DNA Sequence Number=SeqID_23275
  Homolog annotation: Hit_ID=A2Q4P8; Match level="QueryCoverage=68%, HitCoverage=77%, E-value=6e-13, Identity=32%"; Hit description=IMP dehydrogenase/GMP reductase, related
  Pfam annotation: Domain name=DUF1723; Domain location=84-133; Score =57.5; E_value=4.7e-14; Accession=PF08330.1; Description=Protein of unknown function (DUF1723)
MTTEGRDMAEDVADMTDDVPEQPTEAPDMRADAQGADSGGGERPDLKLVSHGRKVTLIGRPVSEIEGLVAATGLSPLIDCSVITGNPRLISAFVERWHNETSTFHLHVGELTITLDDVSSILHLSTTGALHSFHALSTEEARFLLTELLEVSAEEARAETALTRGAYLALICCTLFANKSATYMHVVHLDAFRDLAHSGGYAWGVAAL

SEQ ID NO: 114961 - protein, 38 aa, Glycine max
  Coding DNA Sequence Number=SeqID_23276
MWTTTGEKLATQLAQASKVASPRSNSLLEESSGGPKWA

SEQ ID NO: 114962 - protein, 170 aa, Glycine max
  Coding DNA Sequence Number=SeqID_23277
  Subcellular localization annotation: CTP_CleavageSite=53; ConfidenceScore=5.28e-01
MDRGMTLTNAPRSSMAFSNLLFPIMQGKQKVPGSLHFSRMCRMKLDRFRCKCRCCYWWRHLNLGEPSAPSDLLDSEWRLLSLAEIAYSGWSFASLTLIRKVEEEPQLLVVFVVTAVVLEEEHKACLDQQHSGKEGQAVVVDASSIGACRPRIFFINGFLCFLEDEWQRNG

SEQ ID NO: 114963 - protein, 188 aa, Glycine max
  Coding DNA Sequence Number=SeqID_23278
  Homolog annotation: Hit_ID=Q0KIL1; Match level="QueryCoverage=51%, HitCoverage=10%, E-value=6e-07, Identity=31%"; Hit description =Gag/pol polyprotein, 3'-partial, putative
  Pfam annotation: Domain name=G-patch; Domain location=43-82; Score =23.8; E_value=0.00025; Accession=PF01585.14; Description=G-patch domain
MPYVEAAEESLETAFQSFQVVCISSVDSFSGQACLSGAAVMMARVMLGNGYEPGMGLGKDKGGITSLINAKGNRGKYGLGYKPTQADVKRSIAGRKGGGQSSLLRQESEGSPPCHISKSFLSAGLGDEGQVVAIYEDDVPSFGYGFKSSIVVAHYKPKSGKPSCPKLYGKGALDLFWKCVSNPFAYVQ

SEQ ID NO: 114964 - protein, 93 aa, Glycine max
  Coding DNA Sequence Number=SeqID_23279
  Subcellular localization annotation: CTP_CleavageSite=66; ConfidenceScore=5.18e-01
MARSVFAPCPYFRNLQGRELKGLLVIFPKVVISVLMVSRVPSGVANCRNLPFSGRATRDSQVRLPRKENARSRHQRLFEENVGKTRKDVVYEL

SEQ ID NO: 114965 - protein, 98 aa, Glycine max
  Coding DNA Sequence Number=SeqID_23280
MDEFIELMKEHNWETLDFFEPWPIKRILHPFPPKQRTAESPQGRANRMLKPDFPRRKGGSERKEEMKERRKDNKKKKRRIPDRRSKGSENGKDRRKTE

SEQ ID NO: 114966 - protein, 196 aa, Glycine max
  Coding DNA Sequence Number=SeqID_23281
MKEGIGHILDLTPIGKKREERLKRITLTSHTSMGRTIESEEEKGEKSSEEIYPQEEGQPLMVKEECKEVSVSSKRLAKKESHFEIKTNIKETSPLRQPPHLFLCKETLVGTTTPLGFEIIPQVKELLDEGLVRKSLNPYALLVPKIGIMRHQIPMIGVMMNVLSGATLFCKITHASNIFMIHIHRDSLGRCSYGTP

SEQ ID NO: 114967 - protein, 128 aa, Glycine max
  Coding DNA Sequence Number=SeqID_23282
MVEASGNRLPACVIDYTEGWVTDRDCGVANPWSSRDGVPRGSMGDPRRQHERTVEWILPTPTPYRLVEPVQVIKVTSSEEDPEEDLEELPPEPAVDALDFLEGDEDPLLEVDSPEEVMPASEADSTED

SEQ ID NO: 114968 - protein, 19 aa, Glycine max
  Coding DNA Sequence Number=SeqID_23283
MEENVEEALAAHELRLHPL

SEQ ID NO: 114969 - protein, 101 aa, Glycine max
  Coding DNA Sequence Number=SeqID_23284
  Subcellular localization annotation: CTP_CleavageSite=41; ConfidenceScore=5.42e-01
MAESLKKHKGSSSTTVVVGHHCHGPSGAPTTPIPPFLSSPRSSTLFSLDGQRQRYYSQFCNRVILDPKYLDLDFFDGETFDCYQMKLPNHGVPFEGTLVDD

SEQ ID NO: 114970 - protein, 122 aa, Glycine max
  Coding DNA Sequence Number=SeqID_23285
  Homolog annotation: Hit_ID=A5BEV8; Match level="QueryCoverage=90%, HitCoverage=21%, E-value=8e-08, Identity=26%"; Hit description =Putative uncharacterized protein
MIPMLDQFVPVIEGFIEDIVDVKVDGNCGYRSVAALLELGKWSQDYKKLFGGTERFEQLRLSLHVDGLSKVSVDKWMDITDMGYVIASRYNVYLKDHCPLPPMALLLSSNSYPQAKQWPTAY

SEQ ID NO: 114971 - protein, 200 aa, Glycine max
  Coding DNA Sequence Number=SeqID_23286
  Subcellular localization annotation: CTP_CleavageSite=46; ConfidenceScore=5.12e-01
MATCPHLQKATRPRLQRTTRPLLLRTTCPRLQRTTNPHLERTAHHRLQMVTCLRLQRTAWLHALAVRGLHVLAFRGLHVLAFRGLHICTFRGLKVSMLVAQLISDAIHYLQGSHPQDTQWTRWSPTGPWGFQLWLRASINPTGDHARKTPNGPGEVQQGLGVSNSNYGPLSVLRSACRPQQGHQALTNRAFIKKYCAPCQ

SEQ ID NO: 114972 - protein, 294 aa, Glycine max
  Coding DNA Sequence Number=SeqID_23287
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIVSGYRRCARRIAGQRMDAGRGDRQIGSRAGAAARPSWPGPTLHDVADIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 114973 - protein, 190 aa, Glycine max
  Coding DNA Sequence Number=SeqID_23288
  Pfam annotation: Domain name=Transposase_23; Domain location=124-190; Score=-9.3; E_value=0.012; Accession=PF03017.5; Description=TNP1ENSPM transposase
MACTKKTGQMTSEAAKEIAEKIVKHPGRVRAAGVGVTIKQYFGSAPQSSCSSSSMPPEELEQLTQQIRDQLEESIIEKPDVVPVAITDPITETSLPPEPEVGPSAARVSTKGSCVDPSSTVLETGDSNKCGLYIEDNPSRLVTLGRVYEGSTAVHNIPLLHGQVKVGVEEVKDAEAPVPIPTHEVILVGQ

SEQ ID NO: 114974 - protein, 132 aa, Glycine max
  Coding DNA Sequence Number=SeqID_23289
MRRQIMVIPHPFAIQTQSCPMARRDKLCSFCNLLSSRGGGPDDMRRQIMVIPHPFAIQTQSCPMARRDKLWSFCTLLSSRGGGPDDMRRQIMRQIMVILHPSSIAADKPVDTRRFTSSSALARSVILTFESR

SEQ ID NO: 114975 - protein, 116 aa, Glycine max
  Coding DNA Sequence Number=SeqID_23290
MSSRCSRLNQEHFKVQEEIRFQESRIKIQGSSFQKSRSRFKTQDSRIKRRINQDKGYIYLGLTENKRGYISYGSVLVEGTSTRLFKENKGGYIPCRSLLVKELYKVEKKSRGLQVA

SEQ ID NO: 114976 - protein, 68 aa, Glycine max
  Coding DNA Sequence Number=SeqID_23291
MSFRVCFTRSNSLVESLTTTAILLKEGRNLEKRYGFLPPRGHPRISSNSSTVGTNWKSPNVKHLKGWS

SEQ ID NO: 114977 - protein, 28 aa, Glycine max
  Coding DNA Sequence Number=SeqID_23292
MSGNVRSASSGDASFLNLDRSSFLTDVG

SEQ ID NO: 114978 - protein, 100 aa, Glycine max
  Coding DNA Sequence Number=SeqID_23293
  Subcellular localization annotation: CTP_CleavageSite=44; ConfidenceScore=5.21e-01
MAQPKPSAGLKGKPHQHALTFMPSCISKKQRLGPPRPKILGCLPAALPACPELDMGRRSVDHGPSLYSPFSNAIIFLAKAGRVQFHLSAWGIPWTERKGS

SEQ ID NO: 114979 - protein, 164 aa, Glycine max
  Coding DNA Sequence Number=SeqID_23294
  Homolog annotation: Hit_ID=Q6WAY3; Match level="QueryCoverage=85%, HitCoverage=6%, E-value=8e-07, Identity=29%"; Hit description =Gag/pol polyprotein
MMSTRKIMEANAVTIAATSTVAKVNPMPPSGLNQMNHPTLDMETHEIPHHNLADFEPCLGYATEGQAVGGRPLQNPLEGPQYHPQLHLLHSTTSKNPHAMAEMGKLDHLEERLRVIEGGEDYAFANLEELFLVPNIITPPKFKVLDFDKYKRTTCPENHIKMYY

SEQ ID NO: 114980 - protein, 71 aa, Glycine max
  Coding DNA Sequence Number=SeqID_23295
MSFALRGLHALTLRTTRPRLERTTLTLTVERTTRPCLERTTRPHHQRAARPHLQRTTCPHLERATRPHLGY

SEQ ID NO: 114981 - protein, 165 aa, Glycine max
  Coding DNA Sequence Number=SeqID_23296
  Homolog annotation: Hit_ID=A5BTF9; Match level="QueryCoverage=52%, HitCoverage=7%, E-value=2e-11, Identity=41%"; Hit description =Putative uncharacterized protein
MAIRLVRHNVHLDYPEHFVPFEHPEHSIIGESEHSVVGDFEHPDFEHYNFEHSDFEHSKNKAQPPPRERTLREMAAPDFTYEACEDPHKHLKEFHIVCSTMKPPDVQEDHIFLKAFPHSLEGVAKDWLYYLAPRSITSWDDLKRVFLENFSLLPGPWPSERIFQH

SEQ ID NO: 114982 - protein, 128 aa, Glycine max
  Coding DNA Sequence Number=SeqID_23297
MKVFNCCGLVCSSLPCILVIVRVRALCQVGAGEHVGAGEQRDAGEQGDADAGEQRDGGEQRDTDAAGEQRDGSEQRDVDAGEQRDAGGEERDVADSEEEKEVDSDEWFINFSCMMNEVEAEVETDGYH

SEQ ID NO: 114983 - protein, 170 aa, Glycine max
  Coding DNA Sequence Number=SeqID_23298
VSLAKPPPKPDPKVDDPLYLMTLTIPELFLRPYQVTWDVTVFGVFNPDFPLYLKHEDLSEIAHDAGNSDIYGFLEPQSIQRSGQSQFESESYIKSWMQSSKRDVYLGAYLNGGHWQMVVIMPNEHLVVWFCSLHNKPDNYLKRIINSALKGLDDAPQPKSKAPARWIVIK

SEQ ID NO: 114984 - protein, 180 aa, Glycine max
  Coding DNA Sequence Number=SeqID_23299
  Gene Ontology: Mol. function=protein dimerization activity; Biological process=DNA integration
  Homolog annotation: Hit_ID=A3BRV8; Match level="QueryCoverage=70%, HitCoverage=25%, E-value=2e-28, Identity=38%"; Hit description =Putative uncharacterized protein
MEETLLDDIWWDKVDYILSFTAPIYVLRKIDIDMVVLHLVYEMWDSMIEKSSTPLHCLAHSLNPRYYSHEWLSEDPSRVPSHQGVELTDERKKCFRRYFDDVDAFMMLTPLRDKGELDTKSWWLVHAIFASLQEIPQTRMWDIARDRFSLDENGILEIAHLSLDEPVLEAVFFNEGDQGL

SEQ ID NO: 114985 - protein, 595 aa, Glycine max
  Coding DNA Sequence Number=SeqID_23300
  Gene Ontology: Mol. function=transcription factor activity; Cellular component=nucleus; Biological process=regulation of transcription, DNA-dependent
  Homolog annotation: Hit_ID=A2Q2X8; Match level="QueryCoverage=96%, HitCoverage=95%, E-value=0.0, Identity=63%"; Hit description=GRAS transcription factor
  Pfam annotation: Domain name=GRAS; Domain location=197-503; Score =177.9; E_value=2.5e-50; Accession=PF03514.5; Description=GRAS family transcription factor
MEDLYHVSFTTDDNSSSSNDILWCTEELNELRKVQFSGAEDHGEYGGIDPLYSNFGFFPDDPSEQEGYLLSTDQQKYHQQVQPSYHDYGQLDDNLQFDMVSPPLQFDAQYPTMVPLCHTTKDKPNSNSNTPLASLDILNNYGKGFKRLRNEDKTLKQVDDVAMATTNEGIMRKLSTEDVMRIAGTRFIQSSSSESESLPFLETHPFGIYFSGLSNEEKEDVELAESLLACAEKVGHQQFERASKLLSRCESLSCKTGSPVRRIVHYFAEALRQRIDRATGRVSYKDLQKGPSFDPLEATKVLNPTVVAFYEELPFCQISVFTEVQVIIEDVAEAKKIHVIDLEIRKGVQWTILMQALESRHECPIELLKITAVESGTTRHIAEDTGERLKDYAQGLNIPFSYNIVMVSDMLHLGEDVFEIDPEETIVVYSHFALRTKIQESGQLEIMMRVIRILNPSVMVVAEIEANHNSTSFVNRFIEALFFFSTFFDCLETCMKGDEGNRMIVESLYFSHGIRNIVAAEGAERDSRSVKIDVWRAFFSRFGMVEKELSKLCLFQADLVAKRFPSYSTFDKNGHCLLIGWKGTPINSVSVWKFL

SEQ ID NO: 114986 - protein, 117 aa, Glycine max
  Coding DNA Sequence Number=SeqID_23301
  Homolog annotation: Hit_ID=A2Q283; Match level="QueryCoverage=100%, HitCoverage=6%, E-value=1e-59, Identity=90%"; Hit description =Cytochrome cd1-nitrite reductase-like, C-terminal haem d1
  Pfam annotation: Domain name=WD40; Domain location=8-72; Score=21.6; E_value=0.003; Accession=PF00400.23; Description=WD domain, G-beta repeat
MDDTDQPIHEIDVLSGHENDVNYVQFSGCAVASRFSTAETLKEENIPKFKNSWLNHDNIVTCSRDGSAIIWIPKSRRSHGKSGRWTRAYHLRVPPPPMPTTTQRGGPRQRILPTPRG

SEQ ID NO: 114987 - protein, 215 aa, Glycine max
  Coding DNA Sequence Number=SeqID_23302
  Gene Ontology: Mol. function=oxidoreductase activity; Cellular component=cytoplasm; Biological process=response to red or far red light
  Homolog annotation: Hit_ID=Q4W8C1; Match level="QueryCoverage=93%, HitCoverage=60%, E-value=1e-82, Identity=78%"; Hit description =Gibberellin 2-oxidase
  Pfam annotation: Domain name=2OG-FeII_Oxy; Domain location=55-165; Score=115.1; E_value=2.1e-31; Accession=PF03171.11; Description=2OG -Fe(II) oxygenase superfamily
AERCVTVVIVHDSSSVSAYTEGVRELACEILELMAEGLGVPDTWFFSRLIREVDSDSVLRFNHYPPIILNNKDCKDNHNHTKVIGFGEHSDPQILTILRSNDVGGLQISLQDGVWNPVAPDPSAFCVNVGDLLQVMTNGRFVSVRHRAMTNSHKSRMSVAYFGGPPLDACIVAPPVMVTPERPSLLFKPFTWAEYKKVTYSMRLGEHRIDLFRSN

SEQ ID NO: 114988 - protein, 175 aa, Glycine max
  Coding DNA Sequence Number=SeqID_23303
  Gene Ontology: Mol. function=DNA-directed RNA polymerase activity; Cellular component=DNA-directed RNA polymerase II, core complex; Biological process=regulation of transcription
  Homolog annotation: Hit_ID=Q2HU21; Match level="QueryCoverage=44%, HitCoverage=68%, E-value=8e-38, Identity=91%"; Hit description=DNA -directed RNA polymerase, subunit C11/M/9
  Pfam annotation: Domain name=RNA_POL_M_15KD; Domain location=68-115; Score=42.7; E_value=1.3e-09; Accession=PF02150.7; Description=RNA polymerases M15 Kd subunit
MEDGRRTVVVAEVDSTKVVAMVVEEDVKREYQICGVGRKGKYNRHRRKSPSATASGGDRSLKGRTIRNNILYPKEDRDQKVLLFACRNCDHQEVADNFCVYRNEIHHSVGERTQVLQDVAADPTLPRTKSVRCSQCNHGEAVFFQGILHAFMILFHIRWVFPSSLCTWNDVEVVP

SEQ ID NO: 114989 - protein, 241 aa, Glycine max
  Coding DNA Sequence Number=SeqID_23304
MGINISSSNNYSERFPIDGSSVVVLRKTKIQKWRQVVDTWSADKHEEQISISIHDHPTDHAKDNFDFQMSIRVKEDLLLNNFNLNGPRSTQQLPERKTPIAHGGVLMSSSFLYGSDTDRKGLIVFLRAKRNDESGLLPYVIAVKHYFVAACCSHGVSVVAKIRRGGHGGLSVELEKPSKEHKHDLLSMFDDVQGKGWCPDPSSSDCPIEIIPSQNKNPANANPGHQNPTVAIGNGGYFEGN

SEQ ID NO: 114990 - protein, 75 aa, Glycine max
  Coding DNA Sequence Number=SeqID_23305
MAEVWAIVHGLIHAQSHGFTKLMVETYSLATIELINGVCMRDNPCYHLVEEIQWRLEDLDLFQCCSCRHRCKWSS

SEQ ID NO: 114991 - protein, 163 aa, Glycine max
  Coding DNA Sequence Number=SeqID_23306
MPENNILHSPLKKTQRFQFHPSWETSILPWLPHAKPRWGKGREVVDTWSTEYYSFGKKTCGNNYNHEQELTITILLGKINVNGPRTMLRLPQRKNPIPQGGGVLIKSSSFLYGRDTDDQNGLIVILRARRRDDDKELPIMITVKHYFCCRVLLSWCLCCGKDS

SEQ ID NO: 114992 - protein, 88 aa, Glycine max
  Coding DNA Sequence Number=SeqID_23307
  Gene Ontology: Mol. function=structural constituent of ribosome; Cellular component=intracellular; Biological process=translation
  Homolog annotation: Hit_ID=A9P870; Match level="QueryCoverage=69%, HitCoverage=100%, E-value=2e-27, Identity=93%"; Hit description =Putative uncharacterized protein
  Pfam annotation: Domain name=Ribosomal_L29e; Domain location=3-42; Score=72.6; E_value=1.3e-18; Accession=PF01779.8; Description =Ribosomal L29e protein family
  Subcellular localization annotation: CTP_CleavageSite=73; ConfidenceScore=5.14e-01
MAKSKNHTAHNQSYKAHKNGIKKPKRHRHTSTKGMDPKFLRNQRYARKHNKKSGETATEEEDLNPQSRPFLVPSTTKPTFLLVFYILT

SEQ ID NO: 114993 - protein, 690 aa, Glycine max
  Coding DNA Sequence Number=SeqID_23308
  Gene Ontology: Mol. function=hydrolase activity, hydrolyzing O -glycosyl compounds; Cellular component=cellular_component; Biological process=carbohydrate metabolic process
  Homolog annotation: Hit_ID=Q6RXY3; Match level="QueryCoverage=91%, HitCoverage=81%, E-value=0.0, Identity=77%"; Hit description=Beta xylosidase
  Pfam annotation: Domain name=Glyco_hydro_3; Domain location=8-247; Score=150.3; E_value=5.2e-42; Accession=PF00933.12; Description =Glycosyl hydrolase family 3 N terminal domain
  Pfam annotation: Domain name=Glyco_hydro_3_C; Domain location=319 -551; Score=283.8; E_value=3.4e-82; Accession=PF01915.13; Description= Glycosyl hydrolase family 3 C terminal domain
  Pfam module annotation: Pfam domain module=Glyco_hydro_3::Glyco_hydro_ 3_C; Domain location=8-247::319-551
MECIVCLLVSKTTFIIPVGSSAKGQRINQYKDFSFQNKKKYIYFTGTVLAIRRHALKVVSDEARAMYNGGQAGLTYWSPNVNIFRDPRWGRGQETPGEDPTLAAKYAASYVKGLQGDGAGNRLKVAACCKHYTAYDLDNWNGVDRFHFNAKVSKQDLEDTYDVPFKACVLEGQVASVMCSYNQVNGKPTCADPDLLRNTIRGQWGLNGYIVSDCDSVGVFFDNQHYTRTPEEAAAEAIKAGLDLDCGPFLAIHTDSAIRKGLISENDLNLALANLITVQMRLGMFDGEPSTQPFGNLGPRDVCTPAHQQLALEAARESIVLLQNKGNSLPLSPSRLRIVGVIGPNTDATVTMIGNYAGVACGYTTPLQGIARYVKTAHQVGCRGVACRGNELFGAAEIIARQVDATVLVMGLDQTIEAETRDRVGLLLPGLQQELVTRVARAAKGPVILVIMSGGPVDVSFAKNNPKISAILWVGYPGQAGGTAIADVIFGATNPGGRLPMTWYPQGYLAKVPMTNMDMRPNPATGYPGRTYRFYKGPVVFPFGHGLSYSRFSQSLALAPKQVSVQILSLQALTNSTLSSKAVKVSHANCDDSLETEFHVDVKNEGSMDGTHTLLIFSKPPPGKWSQIKQLVTFHKTHVPAGSKQRLKVNVHSCKHLSVVDQFGVRRIPTGEHELHIGDLKHSINVQTTH

SEQ ID NO: 114994 - protein, 944 aa, Glycine max
  Coding DNA Sequence Number=SeqID_23309
  Homolog annotation: Hit_ID=A7Q8L6; Match level="QueryCoverage=69%, HitCoverage=90%, E-value=1e-148, Identity=47%"; Hit description =Chromosome chr5 scaffold_64, whole genome shotgun sequence
MGVEKDGTKSGGGYVGGFFQLFDWSSKSRKKLFAAKSDLPESLKLGRKVDYNVVDEDEIGVGASVRGSCDHSYASSVTDDDAYGTRAPSVVARLMGLDSLPPSSFSDPYSTPYFDTRSLQDSHYFKKNLGHQHDHHTPYSGKLVEKVEGSSRNFMDPKPQKVITRPIEKFQTEVLPPKSAKSIPVTHHKLLSPIKNPGFVPTNNAAYIMEAAARIIEPGSQTSTKSKTPLAAPSTPLRVRDLKDKVEASQKGPLIGPSSMTSRTRDLKEKREISHRTTRSSESSQRSVESNAAKYLKGQSLNRSWNGSADTSVSVKSPTNEEEDSSFKNKGKSISLAIQAKVNVQRREGLSLIGGRSMTGQKEHPDVKSNQPMKATVQKNLHKKSSVQNSSGALRQNNLKQNYSIDRDKLPSKPLVTNSHNRKVPTGDSSYGRHRSSSNKSNAKSKVGSRKSAMEVTDSEKEVLYTSTNSFPRKKRSTDKDWNDRVVDNLFIEKTQKPAKSNPVSNKQSSWTEEVKKKDMDVVSFTFTTPLTRNNPGFETSGQAGQNTNGLSLDQCIKRVLLDPDNTKSPIGYNIIGGGDALGILLEQKLSELTNMEITCHDSSKVRQPAITAPMSDDQVARHNIVNLNPRLRQKKDQGVLFSDKLSSNYDSDISFTGPPELSLTRNSWIDEMESQLLNCRHPSPISVLEPSFSIESCESSLSTDITSTEGVLILNLLSGSKLSSSVQAHEVHGLSFSRKFYPCESDTELSDSASSTLAGNMMRKHTSTTFSVTRFGRSSTWELNYVKDILCNVELMYVDFSLGQASEVIDSHLFKQLEGCKGGFKRDDESRMRRKVTFDCVSECLGLRCRRYVGGGYKMWTKGFEMVKRKEWLAEDVYKEISGWSGMGDSMVDELVDKDMSSQYGRWLDYEVDASELGSEVVDQIFNSLVDDVVTEMLQLYTP

SEQ ID NO: 114995 - protein, 650 aa, Glycine max
  Coding DNA Sequence Number=SeqID_23310
  Gene Ontology: Cellular component=anchored to membrane; Biological process=root hair cell differentiation
  Homolog annotation: Hit_ID=A7Q8K9; Match level="QueryCoverage=94%, HitCoverage=94%, E-value=0.0, Identity=67%"; Hit description =Chromosome chr5 scaffold_64, whole genome shotgun sequence
  Pfam annotation: Domain name=Phytochel_synth; Domain location=226 -406; Score=370.8; E_value=2.2e-108; Accession=PF04833.6; Description= Phytochelatin synthetase-like conserv
  Subcellular localization annotation: CTP_CleavageSite=57; ConfidenceScore=5.26e-01
MALHVHSFFYFWFVVMIFVVVFFTAPSVSQPQATGSCNGILLSYAYTGGLQLPPNVSDPAEQPYRFSSTLTVLNNGLEELRSWRVFVGFQHGEWLVSASNAVLADGTSLPGSVENGTVLSGETVRDLKTAVATAGDLNQMQVRVDMVGTLLGVAPPSVPMPSSVTLANDGFLCGQPSGQGSNETHVCCTSDPNFKTNITTEEEFLPRQKGDLSITYDIIRTYDSDYWAEVTIANHNPLGRLDNWRLSWDWNNNEFIHTIKGAYPLNVDSSDCVFGPQGLFYKELDFSNVLNCERRPTIVDLPPTMFNNTDFGKIPFCCRNGTILPPTMDPSLSSSRFQIQVFKMPPNLNRSKLSPPHNWEIKGTLNPDYACGNPIRVSPSESPDPTHPPSNKSAIASWQVVCNITNTKREARKCCVSFSAYYNESVVPCNTCACGCSNPERTCSATSQAMLLPPEALLVPFQNRTEKARAWAEIQHLNVPNPFPCGDNCGVSINWHLVTDHRSGWSARITLFNWGEASFADWFAAVRMEKAAKGFEEVYSFNGSLLDGVDGTIFMQGKKGLNFLVAETDGSNPRRDPRVPGKQQSVISFTKKNTPGIDVVGGDGFPSKVFFNGEECSLPSVVPSSGTRMEVSLATMMFLVLFLWILFMRQ

SEQ ID NO: 114996 - protein, 1090 aa, Glycine max
  Coding DNA Sequence Number=SeqID_23311
  Gene Ontology: Mol. function=phospholipase D activity; Cellular component=endoplasmic reticulum; Biological process=lipid catabolic process
  Homolog annotation: Hit_ID=Q9LRZ5; Match level="QueryCoverage=99%, HitCoverage=90%, E-value=0.0, Identity=65%"; Hit description =Phospholipase D p1
  Pfam annotation: Domain name=PH; Domain location=272-398; Score=19.2; E_value=0.015; Accession=PF00169.20; Description=PH domain
  Pfam annotation: Domain name=PLDc; Domain location=544-571; Score =44.2; E_value=4.7e-10; Accession=PF00614.13; Description =Phospholipase D. Active site motif
  Pfam annotation: Domain name=PLDc; Domain location=977-1004; Score =35.9; E_value=1.4e-07; Accession=PF00614.13; Description =Phospholipase D. Active site motif
  Pfam module annotation: Pfam domain module=PH::PLDc::PLDc; Domain location=272-398::544-571::977-1004
  Subcellular localization annotation: CTP_CleavageSite=29; ConfidenceScore=5.10e-01
MATEQLMSSAGGGSSRYVQMKSSPPPSPPAAAAEEISSVPSFRHSGAEANRIFEELPKAAIVSVSRPDASDISPMQLSYTIQVQYKQFPRTKVSAFANLLLAFTSFLVVRVESVSFLPTGGYLYVSFAFQFKWELTKKAHQVFILHFALKKRAFIEEIHEKQEQVKEWLQNLGIGEHTAMAQDDDEGDDETVPLHTEETHESAKDRDVPSSAALPIIRPALGRQHSIADRAKRAMQGYLNHFLGNISIVNSREVCKFLEVSKLSFSPEYGPKLKEEYVMVKHLPKIQKDDDSRKCCLSDCFSCCNDNWQKVWAVLKPGFLALLADPFDTQPLDIIVFDVLPASDGNGDGRLSLASEMKERNPLRHSFKVTCGIRSIRIRVKSSSKVKDWVAAINDAGLRPPEGWCHPHRYGSFAPPRGLVEDGSQAQWFIDGRAAFEAIAFSIEAAKSEIFICGWWLCPELYLRRPFHTHASSRLDNLLEAKAKQGVQYSPYNNQVVTKIYILLYKEVALALKINSVYSKKKLLSIHENVRVLRYPDHFSTGVYLWSHHEKLVIIDNHICFIGGLDLCFGRYDTSEHKVGDFPPLTWPGKDYYNPRESEPNSWEDTMKDELEREKYPRMPWHDVHCALWGPPCRDIARHFVQRWNYAKRNKAPYEQAIPLLMPQHHMVIPHYLGRSREIQIESRNTDNHRVLKREDSFSSSSQDQDIPLLLPQEPDGLDTHEGDQKLNGVISFSHHLDKPRRISSGLPFSFRKAKIVAVGPDTPMKGFVDDLDSEHGLEKMSLDRVAHFDLQSTKPQWWETQERGDQGGFAEESGQVGPLASCRCQVIRSVSQWSAGTSQTEESIHNAYCSLIEKAEYFIYIENQFFISGLSGDEMIRNRVLEALYRRIMRAYNDKKSFRVIVVIPLLPGFQGGLDDSGAASVRAIMHWQYRTICRGQNSIMHNLYELLGSKIHDYISFYGLRSYGRLSNGGPVATSQVYVHSKIMIVDDCITLIGSANINDRSLLGSRDSEIGIVLEDREFIGSYMDGKPWKAGKFSLTLRLSLWSEHLGLPIGEVNQIMDPVVESTYRDIWMATAKASFLFIFVILAK

SEQ ID NO: 114997 - protein, 121 aa, Glycine max
  Coding DNA Sequence Number=SeqID_23312
MKSILPLSLSIAIVYIVSSEIGIAFARDSTALAPEPLADSPAPDEIPPADSAEPPTLDNNPSYDGSAEYIELYSTLLEYFDVTRNGAVADGRTDSSSPEASNQHVLRYGISITSDLRTKLI

SEQ ID NO: 114998 - protein, 78 aa, Glycine max
  Coding DNA Sequence Number=SeqID_23313
  Subcellular localization annotation: CTP_CleavageSite=3; ConfidenceScore=5.09e-01
MARAVAGGSVTGGANDVRDYETSTTSPNTATSTQFFVLYAMERVESHFGVRSEEVIVIDPQGMYRRNYSGLCENAEGC

SEQ ID NO: 114999 - protein, 103 aa, Glycine max
  Coding DNA Sequence Number=SeqID_23314
MASSQADLRKIAVESFDLIDKLYGRRGPASNDAFPSQRQCFWVVHQVPNGDMDQKPGLKNKHVVNYGIPVANQYPRGKAQNRWGHIGRLFTESSNDGIKTLSQ

SEQ ID NO: 115000 - protein, 44 aa, Glycine max
  Coding DNA Sequence Number=SeqID_23315
MICGGCGPHARWLLWPPRALSLPSLTCLRDIFEEALYMVLVAVE

SEQ ID NO: 115001 - protein, 219 aa, Glycine max
  Coding DNA Sequence Number=SeqID_23316
  Gene Ontology: Mol. function=transferase activity, transferring glycosyl groups; Biological process=sucrose metabolic process
  Homolog annotation: Hit_ID=O24301; Match level="QueryCoverage=51%, HitCoverage=17%, E-value=4e-17, Identity=44%"; Hit description =Sucrose synthase 2
  Subcellular localization annotation: CTP_CleavageSite=41; ConfidenceScore=5.31e-01
MSSSSFLSHTLFPFCSVSLFQCFTQFLPFPIPCPLPDIFDRASSLRERVQDTLSRYRNEFISLLSRYVAGGKGILQPHDLLDEVEKLLEEDEDMQKLKDSPFVKELESAKEYVRVNAFEFSVDNLSVAEYDSKKNFPPNQSQKNDDLEPFHRWIVVKFEYHVRNTIPSILTVGNFDIMEKKESHEDSMSGGFNLFSVSLTFENSIGAVGGITERISGNR

SEQ ID NO: 115002 - protein, 612 aa, Glycine max
  Coding DNA Sequence Number=SeqID_23317
  Gene Ontology: Mol. function=aspartyl esterase activity; Cellular component=extracellular region; Biological process=cell wall organization and biogenesis
  Homolog annotation: Hit_ID=Q42920; Match level="QueryCoverage=73%, HitCoverage=100%, E-value=1e-167, Identity=64%"; Hit description =Pectinesterase precursor
  Pfam annotation: Domain name=PMEI; Domain location=68-222; Score =88.6; E_value=2e-23; Accession=PF04043.6; Description=Plant invertasepectin methylesterase inhibitor
  Pfam annotation: Domain name=Pectinesterase; Domain location=275-571; Score=621.7; E_value=6.5e-184; Accession=PF01095.10; Description =Pectinesterase
  Pfam module annotation: Pfam domain module=PMEI::Pectinesterase; Domain location=68-222::275-571
MGGHNNDHEQQRSFAIFIISSILLVATMPVAMAFGLNPNPVGLNTNPNPNPNPGGETNGETGHQSNVLSTHSSGITICQGTEYEEKCKQSLGNSLFVNTDPKKLIETQFKVAIGELVDNIINNSTLYKQIVTDERTRLAMDDCKEILGYAVDAIMKSTSLLIQFDFSKLMEIVYDLKVWLTGSISHQYTCLEGLKNIEEKASQKMAMAMSSSLELSSNALDMTDTISRMLNGFRPKIFNRRLLSEEATVVDGFLSWVNEGQRRFLQVALGSVKPNAVVAQDGSGQFKTLTEALKTVPANNDKPFVIQVKAGVYKEIVKVTNTMTHVTIIGEGATKTKFTGSLNFVDGSTTLESATFAVNGANFMAKDIGFENTAGSSKQQAVALLVTADQAVFYNCQMDGFQDTLFAQSQRQFYRDCTISGTIDFIFGDAFAVFQNCQLIVRNPLKGARCMVTAGGRVKANSASALVFQSCHFTGEPELASAEPKLAFLGRPWMPYSKVVIMDSQIENIFLPEGYEAWTANANKDTCTYYEYNNKGPGADTSKRVKWQGVKVITSTEANNYYPGKFYELANSTSRDAWITDAGIPYSLGPMSGTVPAGLAQSSTTGSAQSPT

SEQ ID NO: 115003 - protein, 590 aa, Glycine max
  Coding DNA Sequence Number=SeqID_23318
  Gene Ontology: Biological process=T cell differentiation in the thymus
  Homolog annotation: Hit_ID=A7Q8F8; Match level="QueryCoverage=97%, HitCoverage=84%, E-value=1e-127, Identity=46%"; Hit description =Chromosome chr5 scaffold_64, whole genome shotgun sequence
  Pfam annotation: Domain name=DUF1032; Domain location=1-513; Score= -162.6; E_value=0.0076; Accession=PF06278.2; Description=Protein of unknown function (DUF1032)
MQLHGCARACPEHRNQDHIDGASVQPEESGPRAVTDEENDQFWGLDDIPVEEKNSLDATTGKVNLDHFIKPPANLVVLEGDCLDAGGDGGELESFLLSTTDLYQDFILLDTSDAIAVHEFLKSSKAATTQNDANRGTSARKSFLSPGHTGGSARRLSAAKSQGANNCSPKLNCGFNDENVRSSSPASAGLDDFNYGFDMDHGCDASRDSDNSDEDNDDPWKPLNPHEPGNLRVKPFRKVNTLKKNSINVRLPVSMNTLFPLAKLRGPISPELMEMWEMRHLVHERQRDSQAPLYEKLRQSLVNEGNETGGTFFNSEADNDDNEYDGGNPDFDMPDNAYMEEDLPSFSNEHEFDDAHVNPDEAVDLSQTSLEDLCRSHLNALLASIAETEKQTEMATRVSAWKQKIEDNLEEQDLHPPFDIQDYGERILDKFSLLSLEASSSGVLSFSDLVKGQNKYDVARSFSSLLQLVNNGDVALERNGVDGSVCYSSVNPFHVKLLKQKSKEREGVQLRLPKKRAKSPTKNPSTQGDKNKTVRKKSPSSSRHGSTGVSPPTNCKFSVKLGKVSGMKSPEAKRRRRSQYVEPVNLHSTG

SEQ ID NO: 115004 - protein, 53 aa, Glycine max
  Coding DNA Sequence Number=SeqID_23319
  Homolog annotation: Hit_ID=A7Q8E6; Match level="QueryCoverage=100%, HitCoverage=52%, E-value=3e-12, Identity=52%"; Hit description =Chromosome chr5 scaffold_64, whole genome shotgun sequence
  Pfam annotation: Domain name=DUF581; Domain location=17-53; Score =16.8; E_value=0.00016; Accession=PF04570.5; Description=Protein of unknown function (DUF581)
MVGLSVVLEAQKGSVSKKTPQHSPFQEAAAKFLDQCFLCRKRLLPGKDIYMYK

SEQ ID NO: 115005 - protein, 60 aa, Glycine max
  Coding DNA Sequence Number=SeqID_23320
MKEGRKRCNEGFHEFTTETNSEEGTVKGTVKKRRSEEGGNRVKGTVKKRRSEEGGDMVKR

SEQ ID NO: 115006 - protein, 350 aa, Glycine max
  Coding DNA Sequence Number=SeqID_23321
  Gene Ontology: Mol. function=microtubule motor activity; Cellular component=microtubule associated complex; Biological process =microtubule-based process
  Homolog annotation: Hit_ID=A7Y7E9; Match level="QueryCoverage=27%, HitCoverage=79%, E-value=1e-20, Identity=55%"; Hit description =Dynein light chain
  Pfam annotation: Domain name=Dynein_light; Domain location=37-114; Score=51.0; E_value=4.1e-12; Accession=PF01221.9; Description=Dynein light chain type 1
MSEDAKKNIAGALTARPNSDDQKPSPLPSPAPAVPPKKVIIKSADMIPDMQKEAVDIAVAAFEKYNVEKDVAEQIKKEFDKRHGPTWHCIVEKGAGSIPGEGIPGGAMVRTKNGGNNEEPLSELKQPVEDYREMSPTKGRGEELTIGDRRRWAYVKRVWPVNNRNTLGNKWIRSNDPKEMNGARSCGLGCGSVSQTEGSGSRGLGDHVIAHECLTRMTSKKSLKGIKPEVIKEYTVEEGDGHRIQNKGFCRNVELKLPTMNIVLEFYLFELGGGGCEVEIKGDPSLSRTVASLKAMLKELKRGNEAYYVELGMLTLYDLDLQRTVEGLEGVLEEYAELFQEAIELPPTRR

SEQ ID NO: 115007 - protein, 181 aa, Glycine max
  Coding DNA Sequence Number=SeqID_23322
  Gene Ontology: Cellular component=integral to membrane
  Homolog annotation: Hit_ID=A7Q8D6; Match level="QueryCoverage=90%, HitCoverage=71%, E-value=4e-41, Identity=52%"; Hit description =Chromosome chr5 scaffold_64, whole genome shotgun sequence
  Pfam annotation: Domain name=MtN3_slv; Domain location=6-93; Score =136.1; E_value=9.8e-38; Accession=PF03083.7; Description=MtN3saliva family
MAEASFFVGVIGNIISILMFLSPVPTFWKIKKHGSTEDFSSLPYICTLLNCSLWTYYGIIKAGEYLVATVNGFGILMETIYIILFLIYAPKGIRGRTAILALILDVVILTAIIIITQLALEGETRSGAVGVMGAGLNIVMYSSPLSVMCPTGAYGFSKVFFSFHDDTHTNNRVVESDPARA

SEQ ID NO: 115008 - protein, 513 aa, Glycine max
  Coding DNA Sequence Number=SeqID_23323
  Gene Ontology: Mol. function=protein binding; Cellular component =cytosol; Biological process=Golgi organization and biogenesis
  Homolog annotation: Hit_ID=A9PH78; Match level="QueryCoverage=100%, HitCoverage=98%, E-value=0.0, Identity=74%"; Hit description =Putative uncharacterized protein
  Pfam annotation: Domain name=WD40; Domain location=193-231; Score =49.0; E_value=1.6e-11; Accession=PF00400.23; Description=WD domain, G-beta repeat
  Pfam annotation: Domain name=WD40; Domain location=235-273; Score =33.4; E_value=8.4e-07; Accession=PF00400.23; Description=WD domain, G-beta repeat
  Pfam annotation: Domain name=WD40; Domain location=277-315; Score =41.0; E_value=4.3e-09; Accession=PF00400.23; Description=WD domain, G-beta repeat
  Pfam annotation: Domain name=WD40; Domain location=319-357; Score =36.4; E_value=1.1e-07; Accession=PF00400.23; Description=WD domain, G-beta repeat
  Pfam annotation: Domain name=WD40; Domain location=361-398; Score =15.5; E_value=0.2; Accession=PF00400.23; Description=WD domain, G -beta repeat
  Pfam annotation: Domain name=WD40; Domain location=403-440; Score =8.0; E_value=3.3; Accession=PF00400.23; Description=WD domain, G -beta repeat
  Pfam annotation: Domain name=WD40; Domain location=452-490; Score =16.4; E_value=0.11; Accession=PF00400.23; Description=WD domain, G -beta repeat
  Pfam module annotation: Pfam domain module=WD40::WD40::WD40::WD40::WD4 0::WD40::WD40; Domain location=193-231::235-273::277-315::319 -357::361-398::403-440::452-490
MEVEPVEPQSLKKLSFKSLKRALDLFSPIHGHLATPDAESKKIRTSHKVSVEYGGIKSTANQPPPRQVSSATQDPGSSNTLALPASCGIAIVFITSVHMLTLSLGSWGNSFVRKKICRGQGPGDSKDSQKGGPQNALVVGPTIPSTTPNDTGFQNKSTAVVSASGSSERNLSTSALMERMPSKWPRPVWHAPWKNYRVISGHLGWVRSVAVDPSNTWFCTGSADRTIKIWDLASGVLKLTLTGHIEQVRGLAVSNRHTYMFSAGDDKQVKCWDLEQNKVIRSYHGHLSGVYCLALHPTIDVLLTGGRDSVCRVWDIRSKMQIHALSGHDNTVCSVFTRPTDPQVVTGSHDTTIKMWDLRYGKTMSTLTNHKKSVRAMAQHPKEQAFASASADNIKKFTLPKGEFCHNMLSQQKTIINAMAVNEEGVMVTGGDNGSMWFWDWKSGHNFQQSQTIVQPGSLDSEAGIYACTYDLTGSRLITCEADKTIKMWKEDESATPETHPLNFRPPKDIRRF

SEQ ID NO: 115009 - protein, 37 aa, Glycine max
  Coding DNA Sequence Number=SeqID_23324
MECVGSWKLRNGILFNQKEKDEEDVLEMIKTMVTVNG

SEQ ID NO: 115010 - protein, 1263 aa, Glycine max
  Coding DNA Sequence Number=SeqID_23325
  Gene Ontology: Mol. function=binding; Cellular component=nuclear condensin complex; Biological process=mitotic chromosome condensation
  Homolog annotation: Hit_ID=A7NW20; Match level="QueryCoverage=100%, HitCoverage=93%, E-value=0.0, Identity=47%"; Hit description =Chromosome chr5 scaffold_2, whole genome shotgun sequence
  Pfam annotation: Domain name=HEAT; Domain location=357-389; Score =7.5; E_value=2.1; Accession=PF02985.13; Description=HEAT repeat
  Pfam annotation: Domain name=HEAT; Domain location=411-447; Score =9.2; E_value=1.1; Accession=PF02985.13; Description=HEAT repeat
  Pfam annotation: Domain name=HEAT; Domain location=449-485; Score =6.2; E_value=3.2; Accession=PF02985.13; Description=HEAT repeat
  Pfam annotation: Domain name=HEAT; Domain location=867-903; Score =4.1; E_value=6.7; Accession=PF02985.13; Description=HEAT repeat
  Pfam module annotation: Pfam domain module=HEAT::HEAT::HEAT::HEAT; Domain location=357-389::411-447::449-485::867-903
MEETVSRVISELEDLRGNPQPPPLSEQTLTNLLFLLKHSLSESLYDELSSKNLSPSSLIPPIASAMDSSPPHHSLLASDVFLSLLLAPNAPVFTLFTPMSFLSFLRSLRRSCKAHSHPGPAQDNSQNGKRKRPGRGRAKNPQNEDDSPDTSSQHDPRVLLRVLEKLVEVMGLIHLNRFPETLKSLIQTVAEIPVTSLNTCGNAAVYSRLLSLCSHVLKEVLKSEHGEPSNTAAEVLKSLCSLVLMAKSQARTFALGFVTSLGNQCDDVKKALVNFPRYLAKKAPEKAEPRALAVESIMEVVKVMGFDDQIAFVKYVVQMAQGKSSLRLLAVDLILNLVMSLKDPLGVESEESEVWGIWCLEVLLKRCSDVSGAIRARALSNLAQLVGFLSRGERTSVVLKEFMGFGKVGDGNVEGGMNDMLRRRCMDDKAAVRKAALLLVTNLTSLLGGAIDEVVLKTMGMACSDPLISMRKAAITALSEAFRTFSAETVITEWLHSVPRLISDNESSIQEECENMFKELVLDRIIRAATATSSYSEPLSNRKMKGKGLDNEMEMFFPNGTLYLLREICHGEVSTFLSKVVDWEFLHHHWQLLDKHEVEGEFKSPFVQRNASEEEESIECNHVAWASDRVFLLQTISNVSVELPPVPAADLAHNLLKRVEQFNMHSTEVDAHLKALKTLCKRKASNLEEAEALVLKWVHQVLSRASGIIEKFISENSEQNAEGSFFTPPRSGTSKGRKSVAKSKSLSKAVTAIYTVGSVVIVCPSADMSNLVPLLHTIITSGSSGPKLNNLPSPSTSLQQEAPSFYIQGWLAMGKLCLADGKLAKNYIPLFVQELEKSKSAALRNNIVVMMADFCVRFTALVDWDYVKWRGVLFLRFLLSLVDESEKIRQLADFLFGNILKVKSPLLAYNSFVEAVFVLNDCHVHNGHRESQGSRKESQIFSIRGTDEESRSKRMHIYVSLLKQMAPEHLLATFAKLCAEILAAASDGMLNIEDATGQSVLQIERLVGVGSNNSTGLAQASETRCDLGKFMDAFQILGCKEIRISSTRASSESADVEEEGGESGSAARGKTITQAVKKGLIQNTVPIFIELKRLLETKNSPLIGSLMECLRIILKDYKNEIDDILVADKQLQKELIYDIKKYEAAKAKATVAEAVGTKPKSVSNQSPDASKNLTKTQGQTVGQSSNELPSDSRVASAMANAAAAATARSVLREINKGTATPSLSSLSVPKVKSCTGMCHSKDKRMDVIQSIRKRQSFDSDEEN

SEQ ID NO: 115011 - protein, 468 aa, Glycine max
  Coding DNA Sequence Number=SeqID_23326
  Gene Ontology: Mol. function=cysteine-type peptidase activity; Cellular component=cytoplasm; Biological process=proteolysis
  Homolog annotation: Hit_ID=A7NW26; Match level="QueryCoverage=100%, HitCoverage=100%, E-value=1e-128, Identity=53%"; Hit description =Chromosome chr5 scaffold_2, whole genome shotgun sequence
  Pfam annotation: Domain name=Peptidase_C48; Domain location=280-467; Score=172.2; E_value=1.3e-48; Accession=PF02902.10; Description=Ulp1 protease family, C-terminal catalytic domain
MGAMTANRKRSEECMNVNHTNSDSPRKRAKFSIKPVPSATSAVARLSRYPEVHAPLAREVHAPCRSRKFERSRVIVSAGNVMGNFLATKFKEAKRSASAKCRNLVEKGKEVIEVDAETESEERYVDSSVEEARGDGDKVVRVQQQSQSTLSFDSEMMNAELKMVSGGKVWGYETQRDLENVHMYKKLLEDVGRRSGTLQRLNFEIDLNEKRREHYNLLRPKKELVEEQEVPQEPFVALTSEEEDEVECAFSSNWRRILVTHENSNIVITGEKFQCLRPTGWLNDEVINLYLELLKEREQREPQKFLKCHFFNTFFYKKLISGPKGYDFKSVRRWTTQRKLGYSLLECDKIFVPIHQEIHWCLAVINKKDKKFQYLDSMKGEDSFVLEKLAKYFADEVNDKTGKHIDVNTWKKEFVKDLPVQKNGYDCGVFMIKYADFYSRGLELCFNQENMSYFRRRTAKEILRLKAE

SEQ ID NO: 115012 - protein, 450 aa, Glycine max
  Coding DNA Sequence Number=SeqID_23327
  Gene Ontology: Mol. function=transferase activity, transferring glycosyl groups; Cellular component=integral to membrane; Biological process=polysaccharide biosynthetic process
  Homolog annotation: Hit_ID=A5BRM5; Match level="QueryCoverage=100%, HitCoverage=100%, E-value=0.0, Identity=83%"; Hit description =Putative uncharacterized protein
  Pfam annotation: Domain name=Glyco_transf_34; Domain location=139 -383; Score=434.0; E_value=2.1e-127; Accession=PF05637.3; Description= galactosyl transferase GMA12MNN10 family
MLECCLGTRRVRQIHRACRHSTVTFLCLFLTLVVLRGTIGAGKFGTPEQDFNEIRHHLSAARARRVLEEVKPESLSSSESNNYATFDLSKILVDEPPTDDEKPNPNAPYTLGPKISNWDEQRSSWLSNNPDYPNFIGPNKPRVLLVTGSSPKPCENPVGDHYLVKSIKNKIDYCRVHGIEIFYNMALLDAEMAGFWAKLPLIRKLLLSHPEVEFLWWMDSDAMFTDMAFEVPWERYKDSNFVMHGWNEMVYDEKNWIGLNTGSFLLRNCQWSLDILDAWAPMGPKGKIRDEAGKVLTRELKNRPVFEADDQSAMVYLLATGKEKWGDKVYLENHYYLHGYWGILVDRYEEMIENYHPGLGDHRWPLVTHFVGCKPCGKFGDYPVERCLKQMDRAYNFGDNQILQMYGFTHKSLGSRKVKRVRNDTSNPLEVKDELGLLHPAFKAIKLSSS

SEQ ID NO: 115013 - protein, 269 aa, Glycine max
  Coding DNA Sequence Number=SeqID_23328
  Gene Ontology: Mol. function=metal ion binding; Biological process =metal ion transport
  Homolog annotation: Hit_ID=A7Q091; Match level="QueryCoverage=44%, HitCoverage=44%, E-value=1e-26, Identity=49%"; Hit description =Chromosome chr7 scaffold_42, whole genome shotgun sequence
  Pfam annotation: Domain name=HMA; Domain location=19-79; Score=44.0; E_value=5.4e-10; Accession=PF00403.17; Description=Heavy-metal -associated domain
MDAKPPQLASQPLNYQTWFLKVSIHCEGCRRKVKKVLKSIDGVFTATIDQQQQKVTVTGSVGVEILLRKLIRAGKHAEIWPENLNLDDERIAGKGKKKKKKKKNEAREPQSLENKGAEKNATTTAKCSSVNKSSNNSPEKSPSGDHVPAEGGGSGKKKKKKVQSSLSSAAAESTGAPAHTGLQFEDLVGQVNVSPPRQQSLSFPETGYYPPMVNVAAYNRFYPSYYFYVPSSPYTCAGLDHDGHYQFQSPPLVSFEIFSDENANGCYVM

SEQ ID NO: 115014 - protein, 53 aa, Glycine max
  Coding DNA Sequence Number=SeqID_23329
DDGVRELAEGFVVFSMLLNKFQGSPWCEGERRMTKRTEEIYAVFAITDFGFVQ

SEQ ID NO: 115015 - protein, 329 aa, Glycine max
  Coding DNA Sequence Number=SeqID_23330
MYVSFSLFLTTIVCLLLLHFCALLPCIVKRHRSSLRLLRVAPPVSFPDVDIAFAIVSTISRIIGRSLGTEVSGDANEASQHQRSTTSACRQRTAAHVAEDVEHVDHTTDEERLELKLSSYGRKIEKFGRVALEIKGIVAAIGLSPLIELGEVIITLDNVISLLHLPITGAFHNFEALNVDKVKDLLVDLLEHFPIVAFSIAAEDYHERKPLACRWKSEKALPVSTYRKQLDRLTSDVVYWIPYNDHRAFIELELIIPPHPAAPSLSIDDRWIQFFEYLARLGDPLRHPPGVHSDTFIELDPPQQSVATAAMAEPSVAAPDNPPNSLRLS

SEQ ID NO: 115016 - protein, 333 aa, Glycine max
  Coding DNA Sequence Number=SeqID_23331
  Gene Ontology: Mol. function=structural constituent of ribosome; Cellular component=intracellular; Biological process=translation
  Homolog annotation: Hit_ID=A2Q664; Match level="QueryCoverage=70%, HitCoverage=78%, E-value=1e-90, Identity=69%"; Hit description =Ribosomal protein S6
  Pfam annotation: Domain name=Ribosomal_S6; Domain location=141-231; Score=112.3; E_value=1.5e-30; Accession=PF01250.8; Description =Ribosomal protein S6
  Subcellular localization annotation: CTP_CleavageSite=68; ConfidenceScore=5.53e-01
MEAKSLLKGSSLKPSYPIHKLSKTTMMTPNCVRFSFNYNSCLIFANGYPSSSLPLSLQNKPRKSASVVVSARRKDKKEDTHSSVPKPDEVTGFFPEAVLLKKRTVEEEGKLLPEFEDADERELFEALMLELDSDMDVDILRHYEVMYLIHEKHEEEVVAVNEKIQDFLREKKGQVWRLNDWGMRRLAYKIKKANNAHYMLINFELDAKYINDFKTLLDQDERVIRHLVIKRDEAITEDCPPPPDFHTLRGNADDDEDEEFDEDYDGDWDGEDEEDGDEGEDDIIFVDGDEDDIDSRKQTSANVRQPDIRKLRAENVLSAEGIEPAIFPSYLTS

SEQ ID NO: 115017 - protein, 152 aa, Glycine max
  Coding DNA Sequence Number=SeqID_23332
  Gene Ontology: Biological process=response to stress
  Homolog annotation: Hit_ID=A2Q669; Match level="QueryCoverage=64%, HitCoverage=33%, E-value=1e-38, Identity=80%"; Hit description =Desiccation-related protein PCC13-62, putative
MAPHISRASVVVLVAFLVLPLLFSDMARATIPESDVDLLEFPLNLEYLEAEFFLFGSLGHGLDVVAPNLTEGGPPPIGGKLAKLDNFVKDVIFQFALQEVGHLRAIKRTVKGFPRPLLDLSATSFAQHIPLSPAGVIAKRPAPIALPNSCAA

SEQ ID NO: 115018 - protein, 173 aa, Glycine max
  Coding DNA Sequence Number=SeqID_23333
  Gene Ontology: Biological process=response to stress
  Homolog annotation: Hit_ID=A2Q670; Match level="QueryCoverage=99%, HitCoverage=56%, E-value=2e-62, Identity=70%"; Hit description =Desiccation-related protein PCC13-62, putative
MDNAIGHPLLPSFDPYANSINFLLASYVIPYVGLTGYVGANPLLQNAASRKLVAGLLGVESGQDAVIRALLYEHRASLVHPYGLSVEVFTDRISMLRNKLGNKDLKDEGLIVPKVEGAEGNILAGDINSLAYPRTPEEILRIIYGGGDEHFPGDFYSRGASGRIATSYLNFTT

SEQ ID NO: 115019 - protein, 331 aa, Glycine max
  Coding DNA Sequence Number=SeqID_23334
  Gene Ontology: Mol. function=sequence-specific DNA binding; Cellular component=nucleus; Biological process=regulation of transcription, DNA-dependent
  Homolog annotation: Hit_ID=A7Q8S5; Match level="QueryCoverage=97%, HitCoverage=98%, E-value=2e-51, Identity=39%"; Hit description =Chromosome chr5 scaffold_64, whole genome shotgun sequence
  Pfam annotation: Domain name=WRKY; Domain location=184-243; Score =153.7; E_value=5e-43; Accession=PF03106.6; Description=WRKY DNA -binding domain
  Subcellular localization annotation: CTP_CleavageSite=54; ConfidenceScore=5.18e-01
MAEEKRQEQVANPNNSSSTTMPFSDQIPNNNNSIMMTFPFQQPSTIFDLMMMPSSSSFMDLLAVQDYNVPLFDWLPAGVAHHPSPSPASSNVPDSSEVLNTPASPNFSSISSSSNEATVNNNSEQQSGKELQEEEGGNGGRGDNQDQDKTKKQLKAKKKKKKKNQKKQREPRFAFMTKSEVDHLDDGYKWRKYGQKAVKNSPYPRSYYRCTSAGCGVKKRVERSSEDPSMVVTTYEGQHTHPCPASARSSLGFVTQPAAFGPSHFMLPHQAQASALSVVSSSSNYINTTSFGGFVQDHSTRRGFGHEALLRDNGLLQDIIVPTQVTKEEMD

SEQ ID NO: 115020 - protein, 107 aa, Glycine max
  Coding DNA Sequence Number=SeqID_23335
  Subcellular localization annotation: CTP_CleavageSite=61; ConfidenceScore=5.05e-01
MEFDSPTSRPIRSDVVLDPPPPFPTIYTFLPPPPSTVLLPLPINPSLFFTMDNQRSISLFQFMADEGLVPWLEDYLYGLGINIYAGTQGFCDPNPTNMLIMRKWSQM

SEQ ID NO: 115021 - protein, 112 aa, Glycine max
  Coding DNA Sequence Number=SeqID_23336
MRGCFRGSTRHRKCHKERTRNLGGVAMGPSAVTVEEDEEVHALKKELEKAQTVKEKFKSAPVRIRKENAELRDVNIATTKALEQETKRARREEHGRNKFRGALWGSNSELKL

SEQ ID NO: 115022 - protein, 176 aa, Glycine max
  Coding DNA Sequence Number=SeqID_23337
VEVETPEEDEEVQALKTELEKAQTVKEKFKSTTIRIQKENVELRGINIATAKALEQETKRARREEYGRNKFRGTLWGSNSELKLRREERDQSSKRSLSQLLSETETNMLAIISKYQEELNLATAHEHKVADEYARVYAEKEARGRVIDSLHQEATMWMDQFAPTPPPRRSTGSSAI

SEQ ID NO: 115023 - protein, 70 aa, Glycine max
  Coding DNA Sequence Number=SeqID_23338
MATTTDCCPTTNNEHANTCNNMIDYSASPYWGLTAHSIREGPSAYLYDDERTTTRTDRLVLLPALESSSE

SEQ ID NO: 115024 - protein, 213 aa, Glycine max
  Coding DNA Sequence Number=SeqID_23339
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=1e-23, Identity=100%"; Hit description=LacZ protein
MTMITPSSKLTLTKGNKSWYRAPPRDGRDGACGEDRRQQKGGDARRAPASAAEQGPTRGQHRDDDRPPIDLALLQTQVAGRKAAEPFERSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115025 - protein, 263 aa, Glycine max
  Coding DNA Sequence Number=SeqID_23340
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GFPVSQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDLFSIAANLLFLESPVGVGFSYKNTSSDISELGDTITDNVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115026 - protein, 77 aa, Glycine max
  Coding DNA Sequence Number=SeqID_23341
MSLHVLYLYAISGFPPGISRLLYLSLQSFKEMNGQDHLELPSGVGTKQGKQKPIKVLRNGCKWGWGHDRLIVAFSLR

SEQ ID NO: 115027 - protein, 75 aa, Glycine max
  Coding DNA Sequence Number=SeqID_23342
FEFDPVSDFYAESEFEFESGSDFLGVASSRTVLLDLLSLFLSHCIEQFHPQNQNGSLPVELKDMLTWRTSRKNFQ

SEQ ID NO: 115028 - protein, 145 aa, Glycine max
  Coding DNA Sequence Number=SeqID_23343
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=4e-25, Identity=56%"; Hit description =Putative uncharacterized protein
  Subcellular localization annotation: CTP_CleavageSite=39; ConfidenceScore=5.42e-01
MTMITPSSKLTLTKGNKSCTASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115029 - protein, 82 aa, Glycine max
  Coding DNA Sequence Number=SeqID_23344
  Subcellular localization annotation: CTP_CleavageSite=38; ConfidenceScore=5.04e-01
MSYAHSLRVSVDRPKNGSSPIRQHLRNSPFRLPLPPCLCFAPGPPLEIHKEKEKRFSSNGKESTQESSPASRDERSAAKGVC

SEQ ID NO: 115030 - protein, 121 aa, Glycine max
  Coding DNA Sequence Number=SeqID_23345
IDSCLLKSIPYTKNALRNGFLNPVPIANSFELLIIRFGVVHCSSFDQKSGPVPVSTDEVSLVGQALHTFLAWTTHLVVVSPAKPPPKPDSEVRWDATVFGIFNPDFPLYIKHEDLSEIAHG

SEQ ID NO: 115031 - protein, 81 aa, Glycine max
  Coding DNA Sequence Number=SeqID_23346
  Gene Ontology: Cellular component=integral to membrane
  Homolog annotation: Hit_ID=A1JNH2; Match level="QueryCoverage=56%, HitCoverage=20%, E-value=2e-12, Identity=57%"; Hit description =UPF0283 membrane protein YE2117
MAFIAWRNLRLVNRIAAIYGIELGYFSRIRLDIAARLSARAAQGIGCRAAHRPAGDQKRMEIMPSAAVAGGGQTAARRFPP

SEQ ID NO: 115032 - protein, 48 aa, Glycine max
  Coding DNA Sequence Number=SeqID_23347
MKKQQWKRSGRQRKIGERRRHPLRNKPWKKELHHQDEPWIRSLERMLQ

SEQ ID NO: 115033 - protein, 120 aa, Glycine max
  Coding DNA Sequence Number=SeqID_23348
MVMGDSISRLSFPACLHFSGDNTETFSSLTSYPELRRSEFLIGGYVGARASLLSTTPPFAVMTQELVARRDNLTVIRTSSFSDPKCDCMSKGHCGHLHPFPETASSGWRLFQVSQVSRTT

SEQ ID NO: 115034 - protein, 138 aa, Glycine max
  Coding DNA Sequence Number=SeqID_23349
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=3e-24, Identity=69%"; Hit description=LacZ protein
MKGEGEKSTKFCALSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115035 - protein, 408 aa, Glycine max
  Coding DNA Sequence Number=SeqID_23350
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=42%, E-value=0.0, Identity=86%"; Hit description=DNA -directed RNA polymerase subunit beta
  Pfam annotation: Domain name=RNA_pol_Rpb2_6; Domain location=1-317; Score=425.0; E_value=1.1e-124; Accession=PF00562.19; Description=RNA polymerase Rpb2, domain 6
  Pfam annotation: Domain name=RNA_pol_Rpb2_7; Domain location=319-396; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-317::319-396
MHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKRYRFKNFCLDKDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 115036 - protein, 86 aa, Glycine max
  Coding DNA Sequence Number=SeqID_23351
MAPTSCGQVLIFWACSHPIKRDTRNQDRYKILDGLRGPRSPCRPCLKVPLIFHPSTFFLTFSGSQLSLELSLMTGSLSIPNKKMDF

SEQ ID NO: 115037 - protein, 65 aa, Glycine max
  Coding DNA Sequence Number=SeqID_23352
MRVRELFTHEEGINTPRAHHKGRQPLIDCAKYYFKPQIDFNCKQKSFMMQAPMELTSCGIKSIFI

SEQ ID NO: 115038 - protein, 52 aa, Glycine max
  Coding DNA Sequence Number=SeqID_23353
MTGEPTTEAPVNGGRNYNGPKVAKFLVGLGGGQRRPPSGGARAISEIPLWKS

SEQ ID NO: 115039 - protein, 188 aa, Glycine max
  Coding DNA Sequence Number=SeqID_23354
MAEKEDEEVQALKSELGKAKLAKEKFKLAATHIRKECAELREENATTAKALEQETKKARRKSMAISNFLRSPLLGAQELQLLRRAREFGPHKTDSDERLGLAFMRDGRLCYMLWGLLIRQVQEEVEVDLAAIVLHHSKESRGDVYAEKEARGRVIDLCYPRHHLVGWIRTSLVSQEPRQCACPPEPRS

SEQ ID NO: 115040 - protein, 151 aa, Glycine max
  Coding DNA Sequence Number=SeqID_23355
  Gene Ontology: Mol. function=nucleoside-triphosphatase activity; Cellular component=plasma membrane; Biological process=peptide transport
  Homolog annotation: Hit_ID=Q7CVP5; Match level="QueryCoverage=94%, HitCoverage=73%, E-value=3e-62, Identity=62%"; Hit description=ABC transporter, nucleotide binding/ATPase protein
  Pfam annotation: Domain name=ABC_tran; Domain location=1-151; Score =59.5; E_value=1.2e-14; Accession=PF00005.18; Description=ABC transporter
MRLVEPSSGDVSLDGYDVMRLDTVGLRNMRKSVQMIFQDPFSSLNPRMTVGTAISEPFIKHKLGTTKQAKEKTADLLEKVGLSADMANRYPHEFSGGQRQRIAIARALALDPKVIVADESVSALDVSIKAQVCNLLLDLQQTSTRLPVHQP

SEQ ID NO: 115041 - protein, 235 aa, Glycine max
  Coding DNA Sequence Number=SeqID_23356
  Gene Ontology: Mol. function=phosphopyruvate hydratase activity; Cellular component=phosphopyruvate hydratase complex; Biological process=cell division
  Homolog annotation: Hit_ID=A3M9X7; Match level="QueryCoverage=100%, HitCoverage=61%, E-value=1e-117, Identity=91%"; Hit description=Cell division protein
  Pfam annotation: Domain name=FtsA; Domain location=22-193; Score =167.0; E_value=5.1e-47; Accession=PF02491.11; Description=Cell division protein FtsA
  Pfam annotation: Domain name=MreB_Mbl; Domain location=2-184; Score= -277.1; E_value=0.049; Accession=PF06723.4; Description=MreBMbl protein
  Pfam module annotation: Pfam domain module=FtsA::MreB_Mbl; Domain location=22-193::2-184
MVVSCLATAEASLLKDEKEYGVCLVDVGAGITNLAVYLDGRLALARTLQRGGEHVTRDIAAVLQTTTEEAERIKILYGCVDLSAVKPDHMIQVEGIDGPQTISRIELSEIIIARYEEIFSQIRDELAHSGAIHGLYHGVVLTGDACQIEGMVSLARRMLGVSAHLGNPPLQVYADDQHQAALRRSMYATAAGLLMFSQSELQEAVEEPEEANDRSVWERMVNGWNAFNSKLKAIF

SEQ ID NO: 115042 - protein, 144 aa, Glycine max
  Coding DNA Sequence Number=SeqID_23357
MVKEECKEVSVSSKRLAKKESHFEIKTNIKETSPLGQPPHLLLCKKTLVSTVTPLGLEVIPQVKELLDEGLVRKSLNPCALLAPKIDSDQGVPTDPKRIKVILEWPTPPSVEGRSPRYEEPRDLRSNPFQGGGNDAILPRKGIG

SEQ ID NO: 115043 - protein, 107 aa, Glycine max
  Coding DNA Sequence Number=SeqID_23358
  Homolog annotation: Hit_ID=A5BKB9; Match level="QueryCoverage=45%, HitCoverage=4%, E-value=1e-08, Identity=57%"; Hit description =Putative uncharacterized protein
MKKHDKGKRSLKINDDSLQIQKEGFLTIQTTSSNEKFVFMGNRVKTPVEAVGTYCLKLDTGHHLDLLETLYMVCMLCGRNVFQGYFDDAKESRVKKNPKIQESSFKN

SEQ ID NO: 115044 - protein, 205 aa, Glycine max
  Coding DNA Sequence Number=SeqID_23359
LAKEKFKSAATHIRKECTELQEENAATARALEQETKRARKEEYGREKFRGALWGSNNELKLRREERDRSLVHGMILKEELVACARSKRSLAQHLEATEQSMLAIIGQYKEELNQSMAHEQKLVEDFAQVYAEKEARGRVIDALHQEATMWMDRFALTLNGSQDLPRLLAKAKAMAEVCTAPEEIHGLINYCQHMIDLMAHIIRNR

SEQ ID NO: 115045 - protein, 36 aa, Glycine max
  Coding DNA Sequence Number=SeqID_23360
MERIADKIKIIDGSKETLKLAVRIIDLWFVGTPGSR

SEQ ID NO: 115046 - protein, 177 aa, Glycine max
  Coding DNA Sequence Number=SeqID_23361
MEAPLKSEVINVECWMVLHLLCFFSLFCMQSILCSLAGILRSSLPFLLLTLALLCSAYEVSLLLPSCQFFPIKRSFLIGASVIASFGYIKEHDGSWVKKGARNIGEEGHEGEDSSLLSKILERFDGLQTFVGERFDTLELQVDMRFNEMESRMTKVEEDVSYIRSSFDLPPPPPPSS

SEQ ID NO: 115047 - protein, 83 aa, Glycine max
  Coding DNA Sequence Number=SeqID_23362
MGVKYLEAVKRRSHPTKQMNYAIDYQCFKTVKNDFAEFEIPQASNSMTKKMLLQTIGERWRQFKSNLTRKWALAADQDDVDDT

SEQ ID NO: 115048 - protein, 298 aa, Glycine max
  Coding DNA Sequence Number=SeqID_23363
  Gene Ontology: Mol. function=hydrolase activity; Cellular component =plasma membrane; Biological process=antibiotic biosynthetic process
  Homolog annotation: Hit_ID=A7MRG8; Match level="QueryCoverage=85%, HitCoverage=93%, E-value=1e-112, Identity=76%"; Hit description =Putative uncharacterized protein
  Pfam annotation: Domain name=Abhydrolase_1; Domain location=48-260; Score=95.7; E_value=1.4e-25; Accession=PF00561.11; Description =alphabeta hydrolase fold
  Pfam annotation: Domain name=Peptidase_S15; Domain location=8-247; Score=-94.0; E_value=0.0042; Accession=PF02129.9; Description=X-Pro dipeptidyl-peptidase (S15 family)
  Pfam module annotation: Pfam domain module=Abhydrolase_1::Peptidase _S15; Domain location=48-260::8-247
MSTFKTKDGVNLYFKDWGKGQPVLFSHGWPLDADMWDSQLNFLAERGYRVIAFDRRGFGRSDQPWEGYDYDTFADDIHGLIEHLQLDEVTLVGFSMGGGDVSRYIGRYGTAKVKGLVLLGAVTPIFGKTDDHPEGVESAVFDGIKAGLLKDRAQFIKEFATPFYGTNAGQTVSDGVLTQTLNIALLASLKGTLDCVTAFSETDFRADIAKVDVPTLVIHGSHDQVVPFEATGKLVHEMIAGSQLKVGIKGESAFFPLTLTLSRLREKGDRSSGGLALGINPGAVSGPFMWQRFPSPRG

SEQ ID NO: 115049 - protein, 155 aa, Glycine max
  Coding DNA Sequence Number=SeqID_23364
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKHFTDTLISANIDIKCFYFSFITYHHNHGFSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115050 - protein, 143 aa, Glycine max
  Coding DNA Sequence Number=SeqID_23365
MPISKGPGVSNSGYGPLSVLQGARSPSEELHPQRHPVDPEKSNRALGFPALGSRLQDTQWTRRSPTGSWSCQTLITGLCQFYGVSVTSSKGIKPPTNRAFIKKYCAPRQAQGETPQQPGDGRQRATDAPPLPLEFTSAHPQKG

SEQ ID NO: 115051 - protein, 90 aa, Glycine max
  Coding DNA Sequence Number=SeqID_23366
  Subcellular localization annotation: CTP_CleavageSite=41; ConfidenceScore=5.21e-01
MTKLGLCLPSDTTVSAKQRGADNRKVSPRIIMTKLGLCVPSDTTVSECKGVRITVRMTKLGLCVPSDTTVSEWQRGADNRKVSPRIMCAE

SEQ ID NO: 115052 - protein, 63 aa, Glycine max
  Coding DNA Sequence Number=SeqID_23367
  Subcellular localization annotation: CTP_CleavageSite=45; ConfidenceScore=5.13e-01
MAKFSHLMLKLKFITLHSFLMIIPNLDFWVSLPRRTQSLCTSLVRKFKGPSEGYRSSYSPVNF

SEQ ID NO: 115053 - protein, 150 aa, Glycine max
  Coding DNA Sequence Number=SeqID_23368
MGLVWWLASCESCVIYGIWPLVIDYQGWSNKPLVIDYQLCVIDYTVHFTGFHVLKLRNSCLASGNRLPRLCNRLPEMKSLEIVMAAQLIHDRVEMECLEGAWETLKGNARCRFRGTIRFTTTSLVHPEEPVCTLQCTVEWILRTPTPYRL

SEQ ID NO: 115054 - protein, 62 aa, Glycine max
  Coding DNA Sequence Number=SeqID_23369
METRFLVSEKYIALQIAMTKTLKRCWKTKIDKPAVFVQKSRDDPPVHDEFDYNNVVFQWKDI

SEQ ID NO: 115055 - protein, 89 aa, Glycine max
  Coding DNA Sequence Number=SeqID_23370
ALGFPALVTGLCSPTGCPFPPARSRHHDIGITPARHPVDPKKSNRVLELSSSNYGQAQGETPQQPGDGRQQATDAPPSPLEFTSAHPQK

SEQ ID NO: 115056 - protein, 93 aa, Glycine max
  Coding DNA Sequence Number=SeqID_23371
EDVQSSEGDRYKYPRVHPYEKARDRLIERVGHPKSTRLDIRCRKSMQLTRFLGMQMHATFVLKCVSYPNFVRGPLLDDVRPFFGPREVLGTHH

SEQ ID NO: 115057 - protein, 125 aa, Glycine max
  Coding DNA Sequence Number=SeqID_23372
MAYTHIPDSTSDSPQISASPYQLDLAPYASEPYNAQWNAPGLLRDKHTLRSSRILGEMEVDEPWLGLWLPLNYQVDMGSSLAYDNGIWGEPYRLFAAKFLFVGVFFLFVLKVVFVIGSAVDRLCG

SEQ ID NO: 115058 - protein, 73 aa, Glycine max
  Coding DNA Sequence Number=SeqID_23373
MQTHDCLYQLSLNLQSQGFTSFPCPTSDQFRAEVAWPGDWPEAPAEAPDEADEARENEEMIDLLDFLGGSGAT

SEQ ID NO: 115059 - protein, 123 aa, Glycine max
  Coding DNA Sequence Number=SeqID_23374
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=42%, HitCoverage=50%, E-value=4e-24, Identity=100%"; Hit description=LacZ protein
MFVEILDGAVVQRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVGYAQRDRYTCQR

SEQ ID NO: 115060 - protein, 141 aa, Glycine max
  Coding DNA Sequence Number=SeqID_23375
MLTSKISFVVMGDFISRLSFPACSHFSGENTETFSSLTSYPELRRSEFLIGGYVGARASLLSTTPPFVAMTQELVARGDTLWLFAPFCHPEAAGPMTSRDQVWSFCTHDTRRYLMVIRTLLSSRGGGPDDKQRPSLVILHP

SEQ ID NO: 115061 - protein, 141 aa, Glycine max
  Coding DNA Sequence Number=SeqID_23376
  Gene Ontology: Biological process=transposition, DNA-mediated
  Homolog annotation: Hit_ID=Q1J7G7; Match level="QueryCoverage=27%, HitCoverage=68%, E-value=2e-11, Identity=72%"; Hit description =Transposase
LQWLLFLSAVPPVQLLTGWCVTAKAPPDISAGKCSGRVPFAIQAAQLLGRAIGAGLFAITPAGERGMCCKAIKLGNARVFPVTTFSPGIQHIKLIDTVDLEGGPGGLRIGALAECILAYYVGTDEGVSEVLHVGRRKKAAP

SEQ ID NO: 115062 - protein, 706 aa, Glycine max
  Coding DNA Sequence Number=SeqID_23377
  Gene Ontology: Mol. function=aspartate-tRNA ligase activity; Cellular component=cytoplasm; Biological process=tRNA aminoacylation for protein translation
  Homolog annotation: Hit_ID=A3XHN5; Match level="QueryCoverage=56%, HitCoverage=69%, E-value=1e-176, Identity=74%"; Hit description =Aspartyl-tRNA synthetase
  Pfam annotation: Domain name=GAD; Domain location=591-683; Score =63.5; E_value=7.4e-16; Accession=PF02938.5; Description=GAD domain
  Pfam annotation: Domain name=tRNA-synt_2; Domain location=401-681; Score=281.9; E_value=1.3e-81; Accession=PF00152.11; Description=tRNA synthetases class II (D, K and N)
  Pfam annotation: Domain name=tRNA-synt_2b; Domain location=424-577; Score=-41.7; E_value=0.024; Accession=PF00587.16; Description=tRNA synthetase class II core domain (G, H, P, S and T)
  Pfam annotation: Domain name=tRNA-synt_2d; Domain location=410-576; Score=-175.7; E_value=0.085; Accession=PF01409.11; Description=tRNA synthetases class II core domain (F)
  Pfam annotation: Domain name=tRNA_anti; Domain location=300-384; Score=57.1; E_value=6e-14; Accession=PF01336.16; Description=OB-fold nucleic acid binding domain
  Pfam module annotation: Pfam domain module=GAD::tRNA-synt_2::tRNA -synt_2b::tRNA-synt_2d::tRNA_anti; Domain location=591-683::401 -681::424-577::410-576::300-384
EMILKEKEFRAQVAAINTDEYIDAYIYIYNSADAIVPLWAYFVLTAKLTDVAKKIVFGNREDLEVILMHNAIQTYDFDDLRDKRVLVKGCSDKEIPENAYVELVEQLKPIAENKFGISKNQIIALLAVAAPLIISYLRNKSQDSKEAEALNNALDKDHNGSILDDASQVEARQAEGGSILSHIFGNNKQNVENQLSQNTGISIDKIGPVLAMLAPVIMGYIGKEKQQNNVGAGGLGDLLGGILGNASNQAQAQQSSPLNDILGSVLGGGGQAQSSGNPLNDILGSVLGGGQKQQQGGLGGILGRWVQTIRDKGFMIWIDLRDRYGITQLVLDQDRSSAQLMEEAKKLGREFVIQVTGKVIERVSKNPNIPTGEIEILVEKLSVLNDSQLPPFTIEDETDGGEELRMKYRYLDIRRNPVKDKLIFRHKMAQKVRNYLSEEGFIEVETPVLIKSTPEGARDFVVPSRMNPGQFYALPQSPQTFKQLLMVGGMDKYFQIVKCFRDEDLRADRQPEFTQIDCEMAFVEQEDVMNVFEGMTKTLLKDITGQEFGAFPRMTFAEAMQKYGNDKPDIRFGMEFVELNELVKGKDFKIFDDAELVVGINVEGCADYTRKQIDELVDWVKRPQIGASGMVWAKFQNDGVKTSSVNKFYNEEDLTKIIEKFGAKEGDLMLILSGNENKVRAQLSALRMELGNRLGLRKGDVFAPLW

SEQ ID NO: 115063 - protein, 69 aa, Glycine max
  Coding DNA Sequence Number=SeqID_23378
MSSTVVHLLPQMKVHDHHRYQPYGAKLQGKTRQQVSRSPCHAQATPPSHMVINMSHKGVSNQVTCPQVQ

SEQ ID NO: 115064 - protein, 41 aa, Glycine max
  Coding DNA Sequence Number=SeqID_23379
MTLRLTNMHSSSFFQILPHAQPRSVALSGWLAKPADWLSEK

SEQ ID NO: 115065 - protein, 307 aa, Glycine max
  Coding DNA Sequence Number=SeqID_23380
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=92%, HitCoverage=42%, E-value=1e-137, Identity=76%"; Hit description =Photosystem I P700 chlorophyll a apoprotein A2
  Pfam annotation: Domain name=PsaA_PsaB; Domain location=22-307; Score= -22.7; E_value=4.4e-06; Accession=PF00223.10; Description=Photosystem I psaApsaB protein
APATQPRALSIVQGRAVGVTHYLLGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGVYQWWYTIGYVLWDLYTGALFYIPSTISLIAGGYNLQPNGTQAFRGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHK

SEQ ID NO: 115066 - protein, 143 aa, Glycine max
  Coding DNA Sequence Number=SeqID_23381
MARGILYRSHVQSAHPILRPAFEMLHVRRLQLEPTIEVLRRSRMSSRGKKTISFLRLSPLFEQNCNCGRGFSKRFGPRKTNSKRHSGPTTEVPRRQGEGYGKSRRLGPIYGCVSIANLWGRPFSKRRWFGGPSRNQCVPCIPP

SEQ ID NO: 115067 - protein, 176 aa, Glycine max
  Coding DNA Sequence Number=SeqID_23382
  Gene Ontology: Cellular component=chloroplast
  Homolog annotation: Hit_ID=A7QL08; Match level="QueryCoverage=21%, HitCoverage=50%, E-value=3e-10, Identity=91%"; Hit description =Chromosome undetermined scaffold_116, whole genome shotgun sequence
MVGAGLKKDLRVSRVVPGGSLNAFLFLLIGVISQRLAMESIDSLPIGWTVGAMIYFTGEVSGSSPGWPSCVKEKNRRKGSLDSFMHAGPGGGPHDGLLAQWSRSNVDPTFSSLVGSGRSGGDHHGSSLLENSYIPYQYMDSYLSSTGLGLASMEKNGAPNNVSSQTKNYEIAPFIL

SEQ ID NO: 115068 - protein, 197 aa, Glycine max
  Coding DNA Sequence Number=SeqID_23383
LTSYPELRRSEFLIGGYVGARASLLSTTPPFVAMTQELVARGDTLRLSAPRHSVTPSVIDEQRPIWSSAPFPEMSAFSDGDFSSLTNYLELRRSEFLIGGYAAGPMIRGDTLRLSAPFCHPEAAGPMIRGDTLRLSAPFCHPEAAGPMTSRDKIWSFCTLVSSRGGGPDDARRYLTVIRTLCHPEAAGPMTSRDKIW

SEQ ID NO: 115069 - protein, 99 aa, Glycine max
  Coding DNA Sequence Number=SeqID_23384
MRSVPRSSYENAKFYKEKTKSSMISPDNLKEGALVGQKVWGGYCWIILGLAHDFQSDSVQQKKSFKVNGHRLKPFLTNPSLVDVVVEETSLLHPTLPPP

SEQ ID NO: 115070 - protein, 75 aa, Glycine max
  Coding DNA Sequence Number=SeqID_23385
MGQLQRQAFRKAYGIRTRKASRKWGGWGTKEMFGRKGESLGESRRMGPVHGHPDTFDLGGGPLSKCGWVGGLGSN

SEQ ID NO: 115071 - protein, 267 aa, Glycine max
  Coding DNA Sequence Number=SeqID_23386
MRGAPTEEILSPFLVWDLGAQEFTCARVRLLSKLKVIDEENFEAPEEDEEVQALKLELGKARLAKEKFKSAATHIRKECTELQEENVATARALEQETKRARKEEHGRNKFRGALWGSNNELKLRREERDRSRVHGMILKEELAACARSKRSLAQHLEAMEQSMLAIIRQYKEELNQSVTHEQKLAEDFAQVYAEKEARGRVIDALHQEATMWMDRFALTLNGSQDLPRLLAKAKAMAKVCTAPEEIHGLINYCQHMIDLMAHIIRNR

SEQ ID NO: 115072 - protein, 67 aa, Glycine max
  Coding DNA Sequence Number=SeqID_23387
MASYGEAKESIDEEDSRPTNSTWRYITKQGWLPKVTYNRKKVHSSYGLAKSKQKQVILPRALEAQNQ

SEQ ID NO: 115073 - protein, 127 aa, Glycine max
  Coding DNA Sequence Number=SeqID_23388
MEKSEKKNINEKKLKKAYITWDENDMESSEDSENEEINLCLMEKIYLVTKSQLELAKAYVPSINSWKEHEMELLRLNQHEETDKKKKGIALKASSAIQEDSDKEDSIDLDNDEDISLFVKRFNKFLR

SEQ ID NO: 115074 - protein, 129 aa, Glycine max
  Coding DNA Sequence Number=SeqID_23389
MAPKKLSAKRSRRDTAAEGTSAAPEFDSHRFRSTEHQQCFEAIKGWSFHRERCVQLRDDEYTDFQEEIACQYWTSLVTPMAKFDPDIVLEFYANAWPTEEGVRNMWSWVRGQWIPFDADAHSQFLGDPL

SEQ ID NO: 115075 - protein, 46 aa, Glycine max
  Coding DNA Sequence Number=SeqID_23390
ENDRSHPAQVVAAQIRTLLYKHEGCTSSVPSPGLKKLISIVQRAIS

SEQ ID NO: 115076 - protein, 111 aa, Glycine max
  Coding DNA Sequence Number=SeqID_23391
MTRGNPADLQPFDPEIDRTFHRLVRSSVHPGHSLHFEHSEHSIEGDSEYSDFEHSTTNFHTQPPPRERNLREMDAPDFTYETLCIQYPDEGVPYVLKTGLIHLLPKFHGLA

SEQ ID NO: 115077 - protein, 69 aa, Glycine max
  Coding DNA Sequence Number=SeqID_23392
ACSELQNKEREIRLKRAIKGINSRTHQQESSQGYCASNQWGKTHQMIIMMDGSNSHKGKIITFKDYHDM

SEQ ID NO: 115078 - protein, 191 aa, Glycine max
  Coding DNA Sequence Number=SeqID_23393
  Homolog annotation: Hit_ID=Q84VH5; Match level="QueryCoverage=98%, HitCoverage=40%, E-value=8e-37, Identity=70%"; Hit description =Envelope-like protein
MAQKKSTPITPATSRRSKVAIPSKKRKEISSSDSDDDVELDVSTSKRAKKSGRKVPGNVPDAPLDNISFHSIGNVEKGKLGIVSLAQRNCIVNTDPSDTNWFPRRQQGVKISENPSLATSPREVDTEMDKKIRSIVSSILKDASVPEADEDVPTSSTPNVSVPDVEKDVPTSSGPNAEVLSSPSKERSQRR

SEQ ID NO: 115079 - protein, 516 aa, Glycine max
  Coding DNA Sequence Number=SeqID_23394
  Gene Ontology: Mol. function=transporter activity; Cellular component= 1-2nm peptidoglycan-based cell wall; Biological process=transport
  Homolog annotation: Hit_ID=A6X4S1; Match level="QueryCoverage=73%, HitCoverage=87%, E-value=2e-46, Identity=41%"; Hit description=Polar amino acid ABC transporter, inner membrane subunit precursor
  Pfam annotation: Domain name=ABC_tran; Domain location=420-516; Score= -61.4; E_value=0.082; Accession=PF00005.18; Description=ABC transporter
  Pfam annotation: Domain name=BPD_transp_1; Domain location=41-255; Score=58.6; E_value=2.1e-14; Accession=PF00528.13; Description =Binding-protein-dependent transport s
  Pfam module annotation: Pfam domain module=ABC_tran::BPD_transp_1; Domain location=420-516::41-255
ARRLPFVKQSGAESRAGSGAALMTIDWQLLGFGDEGWGGVLLDAATVTVTVSLCAWLLGAMLGSLLCWMQIGGGRWQQRLASGYITLFRGVPELLVIYLFYFGGRQVVGFIGEAIGLQGPFDVNGFVAGAIAIGLISGAYQSSVFRGAFYAIPAGTLEAATVTGMGRFMLFRRMIVPQALRTALPGMGNQWQSVIKESALVSVTGLVETMNQISTASNSTQMPFFFYSVGAVIYLIITTSHAGGAAARTAADAQPGGIVPAGRRNTGAAAEFAASASPWQLRYAFLCLAVPRLPAVRESVLWPLLREPYWCGLIALILNDAAYTAEILRGGLNAVSVQSLEAAKVCGMSRFTTLRRITLPLAVRQALPAYSNEIISMIKSTSLRGDYLSAADRAGEQSGGAAGAPFVPLSCWSTLTAQDGDVISLIGASGSGKSTLLRCIPFLEVPQAGEIAVGDEVVTLDNADEKLSREQRRRIKLMRMQLGFVFQGFNLWPHKTVLQNIIEAPIHVQKRSASGG

SEQ ID NO: 115080 - protein, 375 aa, Glycine max
  Coding DNA Sequence Number=SeqID_23395
  Gene Ontology: Mol. function=transporter activity; Biological process= transport
  Homolog annotation: Hit_ID=Q12AM8; Match level="QueryCoverage=62%, HitCoverage=79%, E-value=3e-74, Identity=58%"; Hit description =Tungstate/molybdate binding protein precursor
MTAAGGLSLPAQAAMDIRVTYAGSMGKVMDQALGPAFAQQHDGKYEGQGQGAYGMARLLASKKITADVFVSVTPGPMQILKTAGLIDNAVPVASTSMVIAYNPKGPFAPQFAAAKGNDGRWLQLLAAPGLKFGRTDPVNDPKGQNIIFTLLLAQKYYRQPGIADNILGGYQNPAQTHLEGGLLTRLESGQVDAAAGYESEVISAHLPYIALPDEINLSNPAMATKWYNTVSFSVKDSQARLCRAEGRWALHPMKIRHAGALWLSLPALVLLAVPFITLTGVTHWQHLRLAWGAGKNALAGGNAGDDPAADAAAGDGNPAGQRVRSVQFARPAAEQAGLDAGEQSRRLYSGAVVWRAALLCHQRTLGVYRGAAGDP

SEQ ID NO: 115081 - protein, 245 aa, Glycine max
  Coding DNA Sequence Number=SeqID_23396
MPPGAPEEKQQMVTSHAAQSGQQATEQHPAPGTSEMQALKLVLCEKYQPVERHAAATKQHTQHQIEPQRLGGRVTQLTDINDGFVTVEHAKDNARHDHANKHRFYRYQAIAKLRAHLFDNEQNAGQRRVERRRKPRRGTGRQQRMTRFGIAHAKQIEAHTTDVAANLHRGSFASQHHARAQRTHAADKFNRQHAPPTHRAQLFQRALDFRNTRASRLWREAAHQKIADAAQQRRNKKRAQQRHGQ

SEQ ID NO: 115082 - protein, 316 aa, Glycine max
  Coding DNA Sequence Number=SeqID_23397
  Gene Ontology: Mol. function=transporter activity; Cellular component= integral to membrane; Biological process=transport
  Homolog annotation: Hit_ID=A2YH30; Match level="QueryCoverage=76%, HitCoverage=66%, E-value=2e-49, Identity=43%"; Hit description =Putative uncharacterized protein
  Pfam annotation: Domain name=MFS_1; Domain location=22-306; Score =12.6; E_value=0.0072; Accession=PF07690.7; Description=Major Facilitator Superfamily
  Subcellular localization annotation: CTP_CleavageSite=50; ConfidenceScore=5.16e-01
MSHTALSADSALHRSGFFLLLLLLTAANLRTPITATGPVLENIRLTFGLSASAAGVINFLPLLMFATLAPPAAWFGNRFGLERSLWGALLLIVLGSLLRISGSETALWLGTLILSSGIAAANVLLPPLIKRDYTAHTARYIGLYAMTMGITASIASGVAVPLAELSSAGWRLSLAVWLIPALIALLAWLPQLKNPATLEQRATEVTVTRSPWRSAIGWQVSLFMASQSLLFYTLIGWFTPFAQDNGISQLQAGGMLFVYQIVAIASNLASSDRAAGFAVDLHRGDRPAAGTRMVAIVADSGRPRGGRLAADQPVTV

SEQ ID NO: 115083 - protein, 567 aa, Glycine max
  Coding DNA Sequence Number=SeqID_23398
  Gene Ontology: Mol. function=transferase activity, transferring hexosyl groups; Biological process=carbohydrate metabolic process
  Homolog annotation: Hit_ID=Q2VJ73; Match level="QueryCoverage=53%, HitCoverage=70%, E-value=1e-166, Identity=97%"; Hit description =Zeaxanthin glucosyl transferase
  Pfam annotation: Domain name=Lycopene_cycl; Domain location=286-567; Score=230.1; E_value=5e-66; Accession=PF05834.3; Description =Lycopene cyclase protein
MLCRELPAVLKRLQVDGVIADQMEAAGGLVAEALRLPFVSVACALPVNREAAIPLAVMPFRFAQDEKALQRYQASSDIYDRIMRRHGAVIARHARTFGLPERHGLHQCLSPLAQISQLVPAFDFPRQQLPACYHSVGPLRTPVASGALAAPWPALRQPVVYASLGTLQGHRFRLFLHLAQACRNQQLSLVVAHCGGLTANQAHQLRLAGAAWVTDFVDQRAALQHAQLFITHAGLNSALEALECGTPMLALPIAFDQPGVAARIEWHGVGRRASRFSRVAQLEQHLQQLLSDDRYRLRIQAQPAGNHTWSFHREDVSEAQFRWLEPLLSARWPGYQVRFPTLRRQLDGEYCSIASEDFARHLQQVLGAALRTAAPVSEVSPTGVRLADGGMLQAQAVIDGRGLQPTPHLQLGYQAFVGQEWQLAAPHGLQQPILMDASVDQQQGYRFVYTLPLSASRLLIEDTHYINHATLDVAQARRHITDYAHQRGWNLRQLLREEHGSLPITLSGDIDQFWQQQHGQPCSGLRAGLFHATTGYSLPAAVALAEKIASTLPADAHTLSHYIESFA

SEQ ID NO: 115084 - protein, 393 aa, Glycine max
  Coding DNA Sequence Number=SeqID_23399
  Gene Ontology: Mol. function=oxidoreductase activity; Biological process=metabolic process
  Homolog annotation: Hit_ID=A8AF33; Match level="QueryCoverage=100%, HitCoverage=100%, E-value=1e-91, Identity=44%"; Hit description =Putative uncharacterized protein
  Pfam annotation: Domain name=DAO; Domain location=5-356; Score=177.6; E_value=3.2e-50; Accession=PF01266.15; Description=FAD dependent oxidoreductase
  Pfam annotation: Domain name=HI0933_like; Domain location=94-354; Score=-275.0; E_value=0.076; Accession=PF03486.5; Description=HI0933- like protein
  Pfam annotation: Domain name=Pyr_redox; Domain location=5-113; Score=- 13.1; E_value=0.075; Accession=PF00070.18; Description=Pyridine nucleotide-disulphide oxidor
  Pfam annotation: Domain name=Pyr_redox_2; Domain location=5-343; Score=-28.9; E_value=0.0033; Accession=PF07992.5; Description =Pyridine nucleotide-disulphide oxidore
  Pfam module annotation: Pfam domain module=DAO::HI0933_like::Pyr _redox::Pyr_redox_2; Domain location=5-356::94-354::5-113::5-343
MTTQKVAVIGAGVIGLAVAWALARQGVQETLFDRQHMGAGTSSTTFAWVNSNGKQPASYHRLNALAMEEHIRLQLTQTNGVRWLEPCGTWEWAGAGEAEQQLQQRATALQAAGYAARQRTLAELQQEIPELRASAVHGSIWHFPTESVLYPALYLARLWSEAQAHGAVLHQHQAIQHISENAEGVTVQLEQGEQWQGDRLVLATGRWANQLLHTLGLELALIDTSKPDAVACSFLARTAPQPLSLGTNLISPQLNVRPDGGGRLLLQALDLDHLADPGAPPSTHGAIADQFRERYRALFATAGALQIEQIVVGQRARPADGLPALGFVTPHQRVYVAVTHSGVTLSPLIGRLVAEELIGDSPSDLLREFRPQRLIGKTASAFAPIQRNFPAAQ

SEQ ID NO: 115085 - protein, 120 aa, Glycine max
  Coding DNA Sequence Number=SeqID_23400
  Gene Ontology: Mol. function=transporter activity; Cellular component= 1-2nm peptidoglycan-based cell wall; Biological process=transport
  Homolog annotation: Hit_ID=Q6MXU3; Match level="QueryCoverage=96%, HitCoverage=53%, E-value=5e-55, Identity=92%"; Hit description =Membrane transport system permease protein
MVLPIRIDPVTAAIVTIVINSGAYIAEITRGAILSINKGFKEASLAMGLSQRSTLWYVIMPLALRRMIPALGNQWIISIKDTSLFIVIGVAELTRQGQEIIAGNFRALEVWTAVAIDLSA

SEQ ID NO: 115086 - protein, 229 aa, Glycine max
  Coding DNA Sequence Number=SeqID_23401
  Gene Ontology: Mol. function=isomerase activity; Biological process =aromatic compound metabolic process
  Homolog annotation: Hit_ID=A4SIM9; Match level="QueryCoverage=37%, HitCoverage=65%, E-value=3e-15, Identity=47%"; Hit description =Probable tautomerase
GSTEPHGGLRKTATLHAGWLCFATIAAESIRRNIMAKTLDSKTLARIAPKLAELSQQPDYAGRTDGAGASATATVAYRIRATKWPGTRRDRRSVHPSGLLCRLAGGSVSAKLSGRGVTLMPFTRIILRQGYSDAQLTQISDILQQSLEDEFAVPPGDRFQVFEELPARLRVFDRHYKSRGRSENFVQFMMTAGKPRSREQKHKLCPQIVSATLAIAGYRSAGCDGDYSV

SEQ ID NO: 115087 - protein, 161 aa, Glycine max
  Coding DNA Sequence Number=SeqID_23402
  Gene Ontology: Mol. function=transcription factor activity; Cellular component=intracellular; Biological process=regulation of transcription, DNA-dependent
  Homolog annotation: Hit_ID=Q48BH4; Match level="QueryCoverage=91%, HitCoverage=97%, E-value=4e-54, Identity=72%"; Hit description =Putative uncharacterized protein
  Pfam annotation: Domain name=DUF24; Domain location=20-109; Score =74.6; E_value=3.2e-19; Accession=PF01638.8; Description =Transcriptional regulator
MAKQEALRTSECPVARTVEVIGERWCLMIIREAFDDVRRFSDFQKNLGLAKNILASRLKLLVEVGVLESCPASDGSAYKEYLLTERGRAVFPIVVAMRQWGERYLFEKGETHSVLLDNANGEPLPELAVYSARGERLDPADCHRRRVIAGDRADQASSIVK

SEQ ID NO: 115088 - protein, 269 aa, Glycine max
  Coding DNA Sequence Number=SeqID_23403
  Gene Ontology: Mol. function=nucleoside-triphosphatase activity; Cellular component=plasma membrane; Biological process=peptide transport
  Homolog annotation: Hit_ID=A1B1Q5; Match level="QueryCoverage=98%, HitCoverage=55%, E-value=2e-72, Identity=53%"; Hit description=ABC transporter related
  Pfam annotation: Domain name=ABC_tran; Domain location=95-269; Score =127.2; E_value=4.9e-35; Accession=PF00005.18; Description=ABC transporter
  Pfam annotation: Domain name=oligo_HPY; Domain location=28-87; Score=- 1.8; E_value=0.0017; Accession=PF08352.3; Description=Oligopeptidedipe ptide transporter, C-ter
  Pfam module annotation: Pfam domain module=ABC_tran::oligo_HPY; Domain location=95-269::28-87
MLLTITHDIALARQLGGDVLVIHKGSVIEQGPAQQVLQSPQQPYTRALLAADPAVWPARQQTVIGARPVISAQDIMLARGGKRLGVPRDFTLHAGEIVGLHGASGSGKSSFGDVLLGLLAPQQGRVTHHADADALKYQKIYQDPSALFPPQRTLGQSINDVLRRHALPPAQHDALMARLALHPALLTRRPEALSGGELQRFALLRVMLLRPVFLFADEPTSRLDPLVQQQTWQLIAELAREQQCAVLLVSHDRDLLEKGTHRVIAMEAA

SEQ ID NO: 115089 - protein, 215 aa, Glycine max
  Coding DNA Sequence Number=SeqID_23404
  Gene Ontology: Mol. function=sequence-specific DNA binding; Biological process=regulation of transcription, DNA-dependent
  Homolog annotation: Hit_ID=A6TG96; Match level="QueryCoverage=76%, HitCoverage=82%, E-value=6e-66, Identity=74%"; Hit description =Putative helix-turn-helix regulatory protein
  Pfam annotation: Domain name=Cupin_2; Domain location=117-188; Score =24.6; E_value=0.00038; Accession=PF07883.2; Description=Cupin domain
  Pfam annotation: Domain name=HTH_3; Domain location=20-74; Score =57.3; E_value=5.3e-14; Accession=PF01381.13; Description=Helix-turn -helix
  Pfam annotation: Domain name=LacI; Domain location=29-54; Score=15.5; E_value=0.045; Accession=PF00356.12; Description=Bacterial regulatory proteins, lacI fa
  Pfam module annotation: Pfam domain module=Cupin_2::HTH_3::LacI; Domain location=117-188::20-74::29-54
MNAPTGVIVTPPIAIIAAGLVRERQRAGLSLTEVARRAGIAKSTLSQLEAGNGNPSIETLWSLCVALNIPFARLMEPEVKKMQVIRRGEGMVVSAELADFQAALLASCPPGGRRDLYLITSQPGAPRASKPHPPGSVEHIILARGRARVGLMEAPVELFPGDYICYPADEPHIFEALEANTMAVQFIIGRTAGTYGPYSRAAASRGGDTEDLRLA

SEQ ID NO: 115090 - protein, 158 aa, Glycine max
  Coding DNA Sequence Number=SeqID_23405
  Gene Ontology: Mol. function=oxidoreductase activity; Cellular component=extracellular region; Biological process=metabolic process
  Homolog annotation: Hit_ID=Q7D0I4; Match level="QueryCoverage=98%, HitCoverage=65%, E-value=1e-61, Identity=76%"; Hit description =Oxidoreductase
MINNAGVMPLSPLSSLKVDEWDRMLDVNVRGVLYGIAAVLPVMESQQSGHIINIASIGALAVSPTAAVYCATKFAVRAISDGLRQESRQLRVTVINPGVVESELADTITDETARVAMQSYRQIALKPEAIAQAVSWAINQPGEVDVNEITVRPTASAH

SEQ ID NO: 115091 - protein, 283 aa, Glycine max
  Coding DNA Sequence Number=SeqID_23406
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINGIILKSFIDAFDQTGMKTEETAVISGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115092 - protein, 96 aa, Glycine max
  Coding DNA Sequence Number=SeqID_23407
  Subcellular localization annotation: CTP_CleavageSite=51; ConfidenceScore=5.22e-01
ARLTGALSKGGKCAESPPTFICGKRRKNRRKPVKKNIPSSGVVFTFEEGISTSHVDKSGALAPTCRNLPFGGRATRDSRVACSTKGIRAESPPTFI

SEQ ID NO: 115093 - protein, 109 aa, Glycine max
  Coding DNA Sequence Number=SeqID_23408
MTCRSLTYYFAYLWLWTWSPIGWPCGVGNTQTFLWMSRVLLDESSISRGPDALAGGDRVVMLVRMIRTRLFAATQVKSCPGMHSSCVIASLSGCARTVGPPPISGGVAQ

SEQ ID NO: 115094 - protein, 207 aa, Glycine max
  Coding DNA Sequence Number=SeqID_23409
LHVLAFRGLHILHFRGLHVFSFRGLHALAFRGLHALAFIPGPFPDSGGGPPMQVQPEEEAIVQLLCIPGQDFTRAAAKKQVRIMRTNMTTITQIWMTLLLSNIPSNDRNADLPLRKYQGRAHKTPSGPGEDQQGPGVSNFGYGPLSVLQGARTPRQGHPVDPKKSNRVLGFPALITDLYQFYGVPVTPNKVIRPPTNRAFIKRYCAS

SEQ ID NO: 115095 - protein, 114 aa, Glycine max
  Coding DNA Sequence Number=SeqID_23410
MPISPCRCIGWDRAHKTPSGPEEVQQGPGVSNSGCGPLSVLQGARSPSEGSRLQDTQWTRRSPTRSWSCQALITGLCQFYGVPVTSRKGIRPPTNRAFIKKYCVSRQAQGETPQ

SEQ ID NO: 115096 - protein, 142 aa, Glycine max
  Coding DNA Sequence Number=SeqID_23411
MSAKKKLNLAATHEQRLEDEYAKISAEREARERVIDSLHQEATMRMDRFALTLNRSQELPRLLAKAKAMADTYSAPKEIHGLLGYLLAIKIAIPWVMGLNQAHAFSKKVHQVKLKYGSNYLAKIGAKDESSYITASFTAKHI

SEQ ID NO: 115097 - protein, 106 aa, Glycine max
  Coding DNA Sequence Number=SeqID_23412
MAQECFPNEYMMWNCPSSVDRWHESSFSNARNGPEETHLKRSRKDKAAEGTSSAPEYDSHRFRSAEHQQCFEAIKGWSFLRERRVQLRDDEYTDFQEEIVAGGGHH

SEQ ID NO: 115098 - protein, 35 aa, Glycine max
  Coding DNA Sequence Number=SeqID_23413
MGENYVCHHQKGGDCRSKLHDDEPSNFDDTKSPSD

SEQ ID NO: 115099 - protein, 102 aa, Glycine max
  Coding DNA Sequence Number=SeqID_23414
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=UPI0000ECC20B; Match level="QueryCoverage =55%, HitCoverage=64%, E-value=4e-22, Identity=87%"; Hit description =UPI0000ECC20B related cluster
MVEYARTALEINSCSPGDPLVLERPPPRWSSNSPYCESYYNSLAVVLQRRDWKNPGVTQLNRLAAHPPFARWSNTEEARTDRPSQQFAQPEWRMGRDTVAAH

SEQ ID NO: 115100 - protein, 64 aa, Glycine max
  Coding DNA Sequence Number=SeqID_23415
MVETDDRNKEKITTFDIIGVVAMWERRLSLKLLLAALNGKDSAVAMCRFCRLMGTTTAELSLNR

SEQ ID NO: 115101 - protein, 386 aa, Glycine max
  Coding DNA Sequence Number=SeqID_23416
  Homolog annotation: Hit_ID=Q84VH5; Match level="QueryCoverage=100%, HitCoverage=62%, E-value=1e-165, Identity=73%"; Hit description =Envelope-like protein
VPTSSTPNAEVLSSSSKEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYEKSKKSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCK

SEQ ID NO: 115102 - protein, 315 aa, Glycine max
  Coding DNA Sequence Number=SeqID_23417
SRRDAAAEGTSAAPEFDSHRFRSAEHQQHFEAIKGWSFHRERRVQLRDDEYADFQEEIARRRWTSLVTPMAKFDPNIVLEFYANAWPTEPPRAGHAVMGKGSASFSQRRNRADGFDEEAIAQLLCIPGQDFARTGAGRRVRIMCTSMTTLTQMWITLLLSNVLPSDHNSDLPLPKCQLVYAILTRMSIHVAQLIADAIYLFAGMPPTRHPLDPDKSNKALGFSALITGLCQAFGVLVTPSKVIRPPITQAFIEKYCTPRQGQGDAPQAANAPPPPHQAGSAGSLAWSGIYSTGFPAGGQPQGQYRYMSVSTSSAS

SEQ ID NO: 115103 - protein, 90 aa, Glycine max
  Coding DNA Sequence Number=SeqID_23418
MGAKYLEVVKRGSHPNNGWSPDEIRYRHIILTLSILSLCFVGNDRAWAARYRMTIICLCMPPDMIASGWRKGAQNDHNLSPPISRLTVFE

SEQ ID NO: 115104 - protein, 55 aa, Glycine max
  Coding DNA Sequence Number=SeqID_23419
MDVMDWCEELIWARLDERKCEFRNLHFVQIFAVKLCNRIVHKCRKMLCFRWLWKE

SEQ ID NO: 115105 - protein, 41 aa, Glycine max
  Coding DNA Sequence Number=SeqID_23420
MKIQKKGVEGRSLEYEEPRDLRSNPFQRGGDDAILPSKGIG

SEQ ID NO: 115106 - protein, 159 aa, Glycine max
  Coding DNA Sequence Number=SeqID_23421
VVGCTICGGAHESGCCIPIEEHPTCEGQWRNHPENQFNKDQGGPSTRPHQQGPSLYDRTTKLEETLAQFMQVSMSNQKSTESAIKNLEVQVGQLAKQLVYRSSSSFTANIEKNPKEKCKAVMTRSRMAIQGNDSEAGKKMEEHKHSWHLSQHFNLFLIL

SEQ ID NO: 115107 - protein, 150 aa, Glycine max
  Coding DNA Sequence Number=SeqID_23422
  Subcellular localization annotation: CTP_CleavageSite=97; ConfidenceScore=5.11e-01
MSPSSSLVSPLLHPLLQLSTSSERMQRAMQPMNNMDIFNMVHDISIKVKLEVTGTLTSLNVFGSRRSNDVTRSIFCPNFCKMVTSMLQLDSMNLFVKARAWFNPITQGMAILIANTSKTFHRDERLENTHATHRKCNYEIEMPEETSFLN

SEQ ID NO: 115108 - protein, 134 aa, Glycine max
  Coding DNA Sequence Number=SeqID_23423
MCKAKSESWYQSLALRVEYLTILRKRSRISKLGKKDSPPTNHQYLWDVTKNGDYIPYDGQVNEIPRGQWTEEQKLRFLINSYAQNVMLCALLKEEYTKVRSFKSVKQMWDTLAITYDMNPHGTRADLGSSRIKP

SEQ ID NO: 115109 - protein, 423 aa, Glycine max
  Coding DNA Sequence Number=SeqID_23424
  Homolog annotation: Hit_ID=Q2HW90; Match level="QueryCoverage=36%, HitCoverage=31%, E-value=6e-20, Identity=35%"; Hit description =Putative uncharacterized protein
MASQEKWGPFADVLALLIFGVVLFPNVDGLESPVVAILADLFDTFDRRCEKNSARIVCCLPALCVWLISHLFRQDTRHPCPLQSYRSCAEKGRVDWDQHLAGIGGSTINWFPRWKEGKEGVLFSCGDYPNVPLIGTRGCINYNPALAIRQLGYPMRGAPTEESLSPFLVRDLGAQGLKSSHAGLDWLSKLKVINKENFEAPEEDEEVQALKLELGKARLAKEKFKSAATHIRKECTELQEENATTARALEQETKRARKEEYGREKFRGALWGSNNELKLRREERYQSRVHGMILKEELAACARSKRSLAQHLEATEQSMLAIIGQYKEELNQSVAHEQKLVEDFAQVYAEKEARGRVIDALHQEATMWMDRFALTLNGSQDLPRLLAKAKAMDEVCTAPEEIHGLINYCQHMIDLMAHIIRNC

SEQ ID NO: 115110 - protein, 120 aa, Glycine max
  Coding DNA Sequence Number=SeqID_23425
  Subcellular localization annotation: CTP_CleavageSite=58; ConfidenceScore=5.13e-01
MIAGERITHSPLGTGARTTTPNVTHPSPTYRLGGTSDIQLSRSRILSAADMRDFSWIRSFALTEAFGPSEKDFISLRASKRERSKQSRSFARSKTRKQSCRISGSFPRPTKQKYNSRDLL

SEQ ID NO: 115111 - protein, 96 aa, Glycine max
  Coding DNA Sequence Number=SeqID_23426
MVAITLAKSSLTSISPRIQLERSRCGLSRRSPGDYVAIEHCRALKRIRCKNICKKGDGSFKEHAQKVEGSGGPGGTPNDGKGDDDRDGRHIIDTLL

SEQ ID NO: 115112 - protein, 142 aa, Glycine max
  Coding DNA Sequence Number=SeqID_23427
MRLNLEVLKVVVALSSPFGLSAHPLLSVASVRLARQKNLEEHQYLGHARCSRAKRNGCLKAGSTHDKRQAQIHLLALSLSLAHQWAKRASIAKHSYSATEESGRASISRPCTKHEINALSAIVVFSQAQRTTGAKLKSTYSH

SEQ ID NO: 115113 - protein, 90 aa, Glycine max
  Coding DNA Sequence Number=SeqID_23428
MEQEGGLCDGKEVDQFHQPSGSNEVAIANEDGISYGSELIEVDKMVLSGIFFGDRMSLSCRNIWKNFREFRHVHCCRLKQDWLKDQAANK

SEQ ID NO: 115114 - protein, 176 aa, Glycine max
  Coding DNA Sequence Number=SeqID_23429
  Homolog annotation: Hit_ID=A5B4Q9; Match level="QueryCoverage=52%, HitCoverage=30%, E-value=3e-07, Identity=31%"; Hit description =Putative uncharacterized protein
MVKEECKEVSVSSKRLAKKESHFEIKTNIKETSPLRQSPHLLLCKKTLVSTATPLGLEVIPQVKELLDEGLWSRDSHRPKRIKVIPDWLTPPSIREIWGCHDLTNFYKRFVPYFSILIAPLIELVRNNVPSWEDVHERGVEGKSPKYEEPRDLRSNPFQGGGDDAILPRKGLDRRL

SEQ ID NO: 115115 - protein, 150 aa, Glycine max
  Coding DNA Sequence Number=SeqID_23430
MRPFTIKAASLPRLFTRTSKVYLLLTSHTFPWLNSHTCILKHFGAPKIAHVHILAFLIPTYANFMMNLDYLHNKFLGLGHMRGNYSSSFENECMSQKYVQTKLPHGLFPYKNHALMPLRHFTEHLVGARLGVNSKRTGTMWHAPLLQNAL

SEQ ID NO: 115116 - protein, 121 aa, Glycine max
  Coding DNA Sequence Number=SeqID_23431
MARGVTSNSLTFESFSLAINLAYIKKNSWNLDDPTVSFPGTPSANYEHGAVFFAGGLAKSLAFFSWRRGHSPRVICTRNGSRGKSSDCGGQSTGITSIYTNIGAEHPVRITSRHACAALDR

SEQ ID NO: 115117 - protein, 171 aa, Glycine max
  Coding DNA Sequence Number=SeqID_23432
MQLPQEPLNKRPRGLARKSMAGTNFAELYGVAIVNSSCEGKKGTSREHMAWSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 115118 - protein, 113 aa, Glycine max
  Coding DNA Sequence Number=SeqID_23433
LKNGDRMLRWPLGDRTLVIDYLLGVIDYTVEFVGFYVQKLCNSSLSTGNRLPERKSLEKDILTMRSRYGTHCIVAWSLGDPRRQLEVPIPWHDSTHCYFIGTSRGTSTHASAA

SEQ ID NO: 115119 - protein, 108 aa, Glycine max
  Coding DNA Sequence Number=SeqID_23434
MTPKYPDPRGDEYVLALKIGALTNIFADNASYDRLTPSRRNRVPSFGTVSISALQYHLTPIHTHALQLDRHGNSAPHRPQSVTTATPGFCCSTVSGNPASVVISTRWF

SEQ ID NO: 115120 - protein, 69 aa, Glycine max
  Coding DNA Sequence Number=SeqID_23435
MLQCERYISQLKDDIKISNVLKFHDDPTVKKSEIVIFLRQVRWPTGKREGFRRREKKRNCEVEEAEESV

SEQ ID NO: 115121 - protein, 89 aa, Glycine max
  Coding DNA Sequence Number=SeqID_23436
  Homolog annotation: Hit_ID=Q84VH5; Match level="QueryCoverage=56%, HitCoverage=7%, E-value=2e-18, Identity=98%"; Hit description =Envelope-like protein
KAAASGAVSKDALIAELRDTCKVLEATIKATTEKKMELERLIKRLSDSGIDDEEAAEEEEETEEEEEAAEEEEDAAEDTESDDDSEATP

SEQ ID NO: 115122 - protein, 87 aa, Glycine max
  Coding DNA Sequence Number=SeqID_23437
MKSIPQTSNTSQNSIGCRGICCRHIFHASLKMVKGQLKPSISNLDKCLKPREPVGRRKNSLSHGGGSQSQGGVRNPSNDLSTTISTK

SEQ ID NO: 115123 - protein, 181 aa, Glycine max
  Coding DNA Sequence Number=SeqID_23438
  Homolog annotation: Hit_ID=Q84VH5; Match level="QueryCoverage=82%, HitCoverage=25%, E-value=1e-61, Identity=70%"; Hit description =Envelope-like protein
PTDGVIDIDVSEHQIAKEITAKRVQHWPKKGKLSAGKLSVKYAILHRIGAANWVPTNHTSTIATESFAVKLPIAFPTVLCGIMLSQHPNILNNIDSVMKRESPLSLHYKLFEGTHVPDIVSTSGKAAASGAVSKDALIAELKDTCKQLKKRRSSREEEEAAEEEEDAAEETESDDDSEATP

SEQ ID NO: 115124 - protein, 91 aa, Glycine max
  Coding DNA Sequence Number=SeqID_23439
MRLRRYRIMTVIDFHIVLCSTFFVRHPVSIYLKYLNTIYSPLWDLFVDLYIFRCTLESRLALPLKGRLRQYPLDIVFSSPDSNFLATCFPL

SEQ ID NO: 115125 - protein, 140 aa, Glycine max
  Coding DNA Sequence Number=SeqID_23440
MVKVGTSYVPINVFIFAKNWPRASRYQQGHQDLFILRSSLPSQVLQWLLFLSAVPSCSATDGGGGRSPLRVTTTPAALNAPLQGASHSPFRLRNCWEGRSVRASSLLRQLAKGGCAARRLSWVTPVFSQSRRCKTTASEL

SEQ ID NO: 115126 - protein, 77 aa, Glycine max
  Coding DNA Sequence Number=SeqID_23441
MKLLKNVQTGCGHAFLIFHWESGKSWNDPKLPWRAQYLITSLVKKGTNTEDPAVDFEREANRPEVDKDEGMEFPPKL

SEQ ID NO: 115127 - protein, 281 aa, Glycine max
  Coding DNA Sequence Number=SeqID_23442
  Homolog annotation: Hit_ID=Q6UUU1; Match level="QueryCoverage=21%, HitCoverage=40%, E-value=4e-18, Identity=78%"; Hit description =Putative uncharacterized protein
MPQNVLYDAMGYINGVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDILDAFRQQVAEPGLTFNPGLILGGNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115128 - protein, 41 aa, Glycine max
  Coding DNA Sequence Number=SeqID_23443
KTAREPHFKRNLKESWASSSKGNNTRKSSLPWIQTENAGIL

SEQ ID NO: 115129 - protein, 102 aa, Glycine max
  Coding DNA Sequence Number=SeqID_23444
  Subcellular localization annotation: CTP_CleavageSite=63; ConfidenceScore=5.05e-01
MFNTHRGGIRKVPRCFSQKPAQKHKNGSDLAKRLNTHRGGIRKFPGRFKKKTAKNTKAGVNLSNMGVRSRNFIQNILEGIILKKPLGGNHLHFVNKWHPGLP

SEQ ID NO: 115130 - protein, 107 aa, Glycine max
  Coding DNA Sequence Number=SeqID_23445
  Homolog annotation: Hit_ID=A7P2B3; Match level="QueryCoverage=57%, HitCoverage=5%, E-value=6e-11, Identity=54%"; Hit description =Chromosome chr19 scaffold_4, whole genome shotgun sequence
MVIYFPHATSVDFASLFPKIGNADIHQGSNCDFTALLARFMTSLVIDVPSQAHWITQLTKYDSGGQQDILLLQYLDVTIKDGYYVIIVFECQPRCNIQRRLLCTNRL

SEQ ID NO: 115131 - protein, 192 aa, Glycine max
  Coding DNA Sequence Number=SeqID_23446
MADVYPALEEVHGLFDYCQHMEVQEQMKANIKAMKNQMTSMMEAMLSRRRMMEDNAAATTTTSAATEADPAHPFGINQTSRLVPDMVVREEKYWAVWAVLICENANHSVPILLEGQQPQIGHVPFTQPMGETRKEPWDHALGEFEPYPTYVIEGPTFSGMPQHNALGAPQHRPLQPLHFSVGRLPPAMEERK

SEQ ID NO: 115132 - protein, 63 aa, Glycine max
  Coding DNA Sequence Number=SeqID_23447
EFRIPVTGPGCPVSEHPPHLSDEVRVGPPLVMQSYPARALDRRLQVNWAKDAREGPRVLMSLR

SEQ ID NO: 115133 - protein, 134 aa, Glycine max
  Coding DNA Sequence Number=SeqID_23448
  Homolog annotation: Hit_ID=A6N1F2; Match level="QueryCoverage=35%, HitCoverage=60%, E-value=2e-08, Identity=62%"; Hit description=Imp biosynthesis protein
MSVKMRTTCTWTERPYEASLFPGIGFGLFLRSLGGGQRRPPSGGARAIRPTGRGTVSGRQFLWGVGLPKGLIFPQELTSTGRFGPLRCRLSATWGCSNVPRGWAVPPIKAVRGAGVQKRRETVRSISGCGALEH

SEQ ID NO: 115134 - protein, 152 aa, Glycine max
  Coding DNA Sequence Number=SeqID_23449
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=71%, E-value=2e-23, Identity=67%"; Hit description=LacZ protein
  Subcellular localization annotation: CTP_CleavageSite=26; ConfidenceScore=5.10e-01
MPRKGLTFLTHIQSYRHGPTDLFSIRASSSATRPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 115135 - protein, 96 aa, Glycine max
  Coding DNA Sequence Number=SeqID_23450
MGEFRVAVFKFKWVNANTSVHQDHLGFTLVDLNKVAYMENLSLWQNKPDKSFTSKIHVIQDCQWFYKEEQVVSVTKMMIQHLTFVRRLLFANECLL

SEQ ID NO: 115136 - protein, 133 aa, Glycine max
  Coding DNA Sequence Number=SeqID_23451
LPGINRDTRIYLFCEVIFRHRYLFAQSASAVPPVQLLTGWCVTAKAPPDISAGKCSGHAARNHHTPPRLMRRYRARPIRHSGCATVGKGDRHDVVKRRPVNCNTTHYRANWSSTAVAAALELVDPPGCRNSMM

SEQ ID NO: 115137 - protein, 84 aa, Glycine max
  Coding DNA Sequence Number=SeqID_23452
MAIWLEMRHDKRSSYVIGIRGNSGIGFGGKFLIALEPAPKWALPTERVVVGVGAWGASLWMGAGVLGCAGAELEEFPTRDEKLG

SEQ ID NO: 115138 - protein, 84 aa, Glycine max
  Coding DNA Sequence Number=SeqID_23453
MEECKVVMTRSKMATHVDERKVDKKMEEHKQQLADELKLEPVDDLVELEEIVEEAEVLLFNAFFHPSTKMQELSRYRVLLVRLL

SEQ ID NO: 115139 - protein, 126 aa, Glycine max
  Coding DNA Sequence Number=SeqID_23454
MTLLLSNILPSDRMPILPLQKYQLVCVVPTWGSHPQRHPVDLKKSNRALGFPALVTGLYRPYRALVPPASSCHHDMGIVPARHLVDPKKANSVLELPALNTGLYQFKGVPVAPSRVIRPPTNRVFI

SEQ ID NO: 115140 - protein, 146 aa, Glycine max
  Coding DNA Sequence Number=SeqID_23455
  Gene Ontology: Mol. function=endonuclease activity
  Homolog annotation: Hit_ID=Q9AY32; Match level="QueryCoverage=36%, HitCoverage=80%, E-value=6e-21, Identity=96%"; Hit description=RRNA intron-encoded homing endonuclease
GAENGFHIQGRQQARKLPNLTRGVKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRAPQ

SEQ ID NO: 115141 - protein, 121 aa, Glycine max
  Coding DNA Sequence Number=SeqID_23456
  Subcellular localization annotation: CTP_CleavageSite=93; ConfidenceScore=5.48e-01
MSRVDRRTGSHRSTSRFRNFNPIRDTSRPSGLPSRQFQGLFDSLFKVLFMLSLAPWTEFTAQIGAAFPNNPTRSTRLGCDRVLGFTTGALTLSGAPYSSGTWARRPEDRSRALAPDSNFRG

SEQ ID NO: 115142 - protein, 120 aa, Glycine max
  Coding DNA Sequence Number=SeqID_23457
MSYVIYTKPIELAWDGAKFGLPNSTNGFFITHVDVTEIILGDKWFMNDWSTSIGFAPVYCFLEPQSIRCAKDTHEECQQYIETWVRESHQEVYLGPYLNHAMKKICSNFQGKDNAPPPPP

SEQ ID NO: 115143 - protein, 161 aa, Glycine max
  Coding DNA Sequence Number=SeqID_23458
MIRGDNLRLSASFCHPEAAGPMTSRDQVWSFCTLVSSRGGGPDDTRRYLTVIRTLLSSRGGGPDDTRRYLTVIRTLLSSRGGGPDDKQRPKGGGPDDTRKYLTVIHTLLSSRGGGPDDKAETNLVILHPCIHPRGGGPDDTRKYPSGYPYNILLLSVRQNA

SEQ ID NO: 115144 - protein, 80 aa, Glycine max
  Coding DNA Sequence Number=SeqID_23459
MEETHEIPHNNLADFEPCLGYATERSKQLGGIPLQNTLEGPKYHPQPHLLHSTVGRNPHAMAEMGKLDHLEERLRTIKGG

SEQ ID NO: 115145 - protein, 383 aa, Glycine max
  Coding DNA Sequence Number=SeqID_23460
  Homolog annotation: Hit_ID=Q6WAY6; Match level="QueryCoverage=48%, HitCoverage=30%, E-value=1e-24, Identity=38%"; Hit description =Putative uncharacterized protein
MANQGDWVPFMDVLALLIFGVVLFPNVDGLVDLAAIDAFLAYHHSKESSVVAVLADLFDTFDRRCEKSSARIICCLPALCVWLVSHLFQQDTRHPCPLLSHRSCTEKRRIDWDQLLAGIGGRTISWFPRWKEGKEGVLFSCGGYPNIPLVGTRGCINYNPVLAIRQLGYPMRGAPTEESMSPFEKDQELRGIRNGIIGGYHEWLKVHTRGLDWLAKLKVVSEESFEAPEEDEEVQALKSELGEAKLAKEKFKLAATHVRKECAGLREENAITARALEQETKRARKEEYGRNKFRGALWGSNSELKLRREERDQSRAHSMVLKEELIACSRSKRSLSQRLCETETNMLAIIAKYQEELDLAAAHEHRIADEYAQVYAEKEARGR

SEQ ID NO: 115146 - protein, 135 aa, Glycine max
  Coding DNA Sequence Number=SeqID_23461
  Subcellular localization annotation: CTP_CleavageSite=40; ConfidenceScore=5.87e-01
MGSPPASTPPPPPPSPPSPPPPPPTSDASASTSAVKRTRKASRLRSLSTRPPGVERPVVHVDPTTGKADGPHKKKLRTYLGIVARDKVDITYENWKEVPTAQNDLIWEDIQAEFDIPEASDSRTKRKLLQTMGER

SEQ ID NO: 115147 - protein, 116 aa, Glycine max
  Coding DNA Sequence Number=SeqID_23462
  Homolog annotation: Hit_ID=UPI00016621D1; Match level="QueryCoverage =89%, HitCoverage=37%, E-value=3e-08, Identity=38%"; Hit description =UPI00016621D1 related cluster
  Subcellular localization annotation: CTP_CleavageSite=68; ConfidenceScore=5.25e-01
MLSHKGGPLGTSTLTFGGLHVLPSRGLRVLAFRGLRVLAFRGLYVLAFIGLHALTFRGLHVLTFRGLHAFAFRGLRVLAFKGLHVLPFRGLHVLAFRGLRVLAFKGLHVLTFRGLH

SEQ ID NO: 115148 - protein, 111 aa, Glycine max
  Coding DNA Sequence Number=SeqID_23463
REDAEKCAKADDGVSGRPVGVSGSPEEPVPGKFRKKCLPEVTKRLPERTPLPEDFRKTSSGNFPEEVVHPEEFRKTRTSGRSFKLPEDLSGRTLLPECFRKNHFFRKFYEK

SEQ ID NO: 115149 - protein, 90 aa, Glycine max
  Coding DNA Sequence Number=SeqID_23464
MTVANSIKTTLPKIESAKKFMWKTRQNIQSQRKLQRETQLLEIVHTDICGPFDVSSFGKEMIIFITIFCMIIHVTVMSTYCPRFLRQWMP

SEQ ID NO: 115150 - protein, 65 aa, Glycine max
  Coding DNA Sequence Number=SeqID_23465
MKPHQEEMEIVNLGVGEEKKELKMASEDMEKTMFVTLWEHLLQGDVLWAQKCWGNLSTSYGSIIP

SEQ ID NO: 115151 - protein, 114 aa, Glycine max
  Coding DNA Sequence Number=SeqID_23466
  Subcellular localization annotation: CTP_CleavageSite=50; ConfidenceScore=5.62e-01
TAKAPPDISAASVAVTLRVTTTPAALNAPLQGASHSPFRLRNCWEGRSVRASSLLRQLAKGGCAARRLSWGELELHRGGGRSRTSGSPGLQEFDIQAHNIWRRSKLNYGSSREI

SEQ ID NO: 115152 - protein, 31 aa, Glycine max
  Coding DNA Sequence Number=SeqID_23467
MGGEEAFFAYGRTFFRMRDCLKMLRAEEGSS

SEQ ID NO: 115153 - protein, 122 aa, Glycine max
  Coding DNA Sequence Number=SeqID_23468
MSLATLFGKLQEHEMELMRLHQHEENDIKRKGIALRASSSFIQEESDKEDLTETEEDDDDDSTLCEKGININTKKKEEDSSLAPTCYESNQPRHMRFDYLVFERRIEKSDKRNLKEKKEKKA

SEQ ID NO: 115154 - protein, 75 aa, Glycine max
  Coding DNA Sequence Number=SeqID_23469
MKAGITTTWSFIRGFYKVHAPSKARPSWCCYVKVRLEKVRDYGNGPLALVHQVDPEEVRLSMNQRAKGLCSPREA

SEQ ID NO: 115155 - protein, 86 aa, Glycine max
  Coding DNA Sequence Number=SeqID_23470
  Gene Ontology: Mol. function=aspartic-type endopeptidase activity; Biological process=proteolysis
  Homolog annotation: Hit_ID=A5AZ88; Match level="QueryCoverage=77%, HitCoverage=6%, E-value=2e-09, Identity=49%"; Hit description =Putative uncharacterized protein
MLTLTATCQRLIGARENSARHTMFEELKNNRPIEKPKVELKALLAHLKYVFLDDNEAKPVIISSSLKKAEEDQLVQILKKHKAAIG

SEQ ID NO: 115156 - protein, 377 aa, Glycine max
  Coding DNA Sequence Number=SeqID_23471
RIATVVKGSARGLDRIKQTRNGIAGLPQRYLEDKARGMANQGDWVPFMDVLALLIFGVVLFPNVDGLVDLAAIDAFLAYHYSKESPVVAVLADLFDTFDRRGCINYNPALAIRQLGYPMRGAPTEESMSPFLVRDFGAQNSKTIQRIHKHGKPHWLAKLKVVSEESFEAPEKDEEVQALKSELGKAKLAKEKFKLAATHVRKECAGLREENAITARALEQETKRARREEYGRNKFRGALWGSNSELKLRREERDQSRAHSMVLKEELIACSKSKRSLSQRLCETETNMLAIIAKYQEELGLATAHEHRIADEYAQVYAEKEARGSVIDSLHQEATMWMDRFALTLNGSQELPRLLAKAKAMADTYSTPEEIHGLLGY

SEQ ID NO: 115157 - protein, 192 aa, Glycine max
  Coding DNA Sequence Number=SeqID_23472
MSSSSEDCTSLPSVDCTSSPLEDYMSSPLEGCTPSPLEDYMPSPSERFTSSLSEGSTSALVSRYQSLGQPPDLGGGPTVRAQPEGGYRAATMHTGANFSQPLQGDEGCAHKTPSGPEGAQHGPGVSSSGYGPLDRARKTPSGPGEGQQGLGVASSNYRPLLGETPQQPGDGRQRATDAPPPPLEFTSAHPQK

SEQ ID NO: 115158 - protein, 106 aa, Glycine max
  Coding DNA Sequence Number=SeqID_23473
MPISPCRCTGIAPTRRQWARRSPTGPWGFQLWLRASVVLQGARSPAQGIVPQDTQWTQRSPTGSGSCQALIMGLCQFYGVLVTSGKGIRPPTNQAFIKKYCVPRQA

SEQ ID NO: 115159 - protein, 85 aa, Glycine max
  Coding DNA Sequence Number=SeqID_23474
  Subcellular localization annotation: CTP_CleavageSite=66; ConfidenceScore=5.01e-01
MERTEYRTLGKLVLFGSLLNNKQKNKMKDCKNKSGEDVSFTSSISQSLTNSSQALKPAPASSSGLCRSSKSKISKNSLELGRFSL

SEQ ID NO: 115160 - protein, 184 aa, Glycine max
  Coding DNA Sequence Number=SeqID_23475
MSSRKRKSIDARPTTQYDIRRFHSFEAWTRYTDNVLGRHILAERKVEIYHTELDEFKAELERRNFHKRLTNLADSSIDLALVKEFYANLYSPKGPSPEQVRIRGHLIKIDADSLNTFLETPVVLAEGESLPAYSRYCRMPTDIGEIEAALPSWEDPQERSDNSCSSFRVFSHTPTWLRLPTPRI

SEQ ID NO: 115161 - protein, 148 aa, Glycine max
  Coding DNA Sequence Number=SeqID_23476
APLDPDKSNRALGFPALITGLCQSFGVPVAPTKAAGAPPPPHQAGQAGAFDMEQYLRHLVCQQAANHRAHVQIHDCLYQMSLSMQSQGFASFSCPTPDQFRAEVAWPGDWPEAQAGEAPPEAPGGGEEAHEDEEMADLLDFLGGSGDA

SEQ ID NO: 115162 - protein, 109 aa, Glycine max
  Coding DNA Sequence Number=SeqID_23477
MGSSQKPSLKKRFYQVKIKSLEVTSLRKLGQLMGQLQRQAFRKAYGGRKPYLFFGFYPSTTRVAKVVKISAQELDRVKQNRNGVVGVPRKCLEERAKALENQGKWAFFY

SEQ ID NO: 115163 - protein, 161 aa, Glycine max
  Coding DNA Sequence Number=SeqID_23478
MSLHSSSSVNGEGSTPKDPLYKILDELRSLKLWKEKQERKEKGRHRSHLRPHSHRRENERKPQEANINLPYFHGKDNVEANLDWEIRVEQQLKRKSTSKSYGPHSYPKKDQGQGILGGQDIYSSQDEATTSPSSSKSEEAKREDSSEEIYPQEEGQPLMVK

SEQ ID NO: 115164 - protein, 17 aa, Glycine max
  Coding DNA Sequence Number=SeqID_23479
MCGYLGHVAPLPPKKPS

SEQ ID NO: 115165 - protein, 173 aa, Glycine max
  Coding DNA Sequence Number=SeqID_23480
MEAMMSMKKIMEANAVAVAATSAVAKMNPMPPSGLNQMNHPTSDMVGKDLGSTDGPMMCKFKMSTPSYRMACLPTIHHPMWHTLLSRQPHHVHVSQPMGEAHEIPHHNLADFEPCLGYATEEQAVVDIPLQNTLEGPQYHPQPHLLHSTVGKNPHAMAEMGKLDHLEEKAQGH

SEQ ID NO: 115166 - protein, 193 aa, Glycine max
  Coding DNA Sequence Number=SeqID_23481
MNAVEEDGPSGTKRLGDVATSRRFIYQSLQAACMVSRGGDERDECLFHLGKSHDMETCPVVEELLQRLMDCEQLEVFIGGKEEPQICMQSEEKKVPLTPKALVICFTRKGTGSTPIYPRAAPKPTPFAYQSDKAVPWKYTTLASSERVATEVDSLSAKVTNITGLSGVTRSGRVFASPHLVELSSKGKAPMVQ

SEQ ID NO: 115167 - protein, 50 aa, Glycine max
  Coding DNA Sequence Number=SeqID_23482
MVHLLWIEFKGGYPLVERKLPREGTSTWFQSETSREINAGMEDMRERRHK

SEQ ID NO: 115168 - protein, 130 aa, Glycine max
  Coding DNA Sequence Number=SeqID_23483
MPFRGLKSARKRAVFSRKRDELAKQACCAKRLHQYSFHALSRAFLSQAQFLAAFAELSGPFSAAKRNLSLAKRKSMRLTLGFTGSLPAKPTLQTRWPLRNIGIAILDHRIRMITGDFNQRKPGIDISIIF

SEQ ID NO: 115169 - protein, 107 aa, Glycine max
  Coding DNA Sequence Number=SeqID_23484
  Subcellular localization annotation: CTP_CleavageSite=51; ConfidenceScore=5.61e-01
MATPPSSPPQSDGNTKASPKKTRQTTRLGRLTLRTLDQPRPTVTVDLGTGRASSPEKQKFYSYLGAKFDILEASKAKKKVMSTVATRLRQFKSSLTTKFVYADTEGG

SEQ ID NO: 115170 - protein, 101 aa, Glycine max
  Coding DNA Sequence Number=SeqID_23485
MSQHALLRVSEARLTGAHSKGGKMRGVATNVYLWKTSEKPKETGHKEYSKSTNAGLLLLRTLHQRGNQTYVVLFKGESSDSFYLEGDHFKALDLKNDPFTW

SEQ ID NO: 115171 - protein, 49 aa, Glycine max
  Coding DNA Sequence Number=SeqID_23486
MTSPPKKNVGSNLTLVLARPSLGYPEEVANIVPVRRKSGKVECVWIIGT

SEQ ID NO: 115172 - protein, 36 aa, Glycine max
  Coding DNA Sequence Number=SeqID_23487
VLREGAPEYEEPQEFEVKILSKVKGMMQSYPTKGIG

SEQ ID NO: 115173 - protein, 92 aa, Glycine max
  Coding DNA Sequence Number=SeqID_23488
  Subcellular localization annotation: CTP_CleavageSite=36; ConfidenceScore=5.47e-01
MKSNCCLHKKGDPSSSSWHLTITQTLSNHSVTTYPSAGGRRGRSRVRPPRKENARSRHQRLFEENVGKIGKVWSTNFKCERFGSCIYARGRY

SEQ ID NO: 115174 - protein, 205 aa, Glycine max
  Coding DNA Sequence Number=SeqID_23489
  Homolog annotation: Hit_ID=Q6WAY4; Match level="QueryCoverage=89%, HitCoverage=32%, E-value=6e-21, Identity=36%"; Hit description =Putative uncharacterized protein
MGTNQNGKRFYQVKVKSLDVTSLEELGRLMGPLLRQAFHKVYGKILDLTAAEVFTEAVVSLAQYYDQPLRCFTFGDFQMVPTIEEFDEILGCPLGGRRPYLFSGFLPSLSKIAAVVGNSAKELDRMKQTRNGVVGLPRKYLEGKARDMASQEKWGPFADILALLIFGVVLFPNVDGLVDLAAIDAFLAYHHSKESPVVAILAGFV

SEQ ID NO: 115175 - protein, 173 aa, Glycine max
  Coding DNA Sequence Number=SeqID_23490
  Homolog annotation: Hit_ID=Q6UUU1; Match level="QueryCoverage=34%, HitCoverage=40%, E-value=1e-18, Identity=78%"; Hit description =Putative uncharacterized protein
ECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGTIVLSPTRKDMQKHHWQQPLVIDLEGVSLEVMRRVKAKLKGTSFGDCAPPSQLPRFKELGSSENLRKTALQG

SEQ ID NO: 115176 - protein, 102 aa, Glycine max
  Coding DNA Sequence Number=SeqID_23491
MMRSIRCCISQPARGRVGLGRSKTSALYSPISSDLALSDDTHHAMDRERTSRKTLENGPTTPQARRLLTVGCPFPYAPSRSLLLATPTIKLPATTCPPIYCI

SEQ ID NO: 115177 - protein, 155 aa, Glycine max
  Coding DNA Sequence Number=SeqID_23492
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=72%, E-value=3e-23, Identity=65%"; Hit description=LacZ protein
  Subcellular localization annotation: CTP_CleavageSite=28; ConfidenceScore=5.03e-01
RQYANRLSPRVGRFINAAGTTGFPTGKRAVSATQLIPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 115178 - protein, 126 aa, Glycine max
  Coding DNA Sequence Number=SeqID_23493
  Subcellular localization annotation: CTP_CleavageSite=63; ConfidenceScore=5.21e-01
GVTQWTQRSTIGPWGFQLWLWASVSSTGCPSPPARSRHRDIGKDRARKTPSEPGEVQQGLGVSSSDYGPLLVLRSVCRPQQGAGRDTTIAWGWPTVDNRRIVATSRAPQLIYKGWSVAYDTWLTNE

SEQ ID NO: 115179 - protein, 179 aa, Glycine max
  Coding DNA Sequence Number=SeqID_23494
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=73%, E-value=2e-24, Identity=68%"; Hit description=LacZ protein
  Subcellular localization annotation: CTP_CleavageSite=73; ConfidenceScore=5.50e-01
MKHFTDTPHQCQHSKPVYTPLAPNTQTASPPRVGRFINAAGTTGFPDWKAGKCLVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115180 - protein, 102 aa, Glycine max
  Coding DNA Sequence Number=SeqID_23495
MGASSRPRDNADWAGQWMTSEQTLQWQNFVFCPVADEPRVYCSRNCILKFNCYQMDVKRFLKEYNEELCGAAKGICRPNSSRSCIQAQEGSLWIEASSKSLV

SEQ ID NO: 115181 - protein, 88 aa, Glycine max
  Coding DNA Sequence Number=SeqID_23496
MSPVESPTVATCPFAGERRRGSRVRLPKEERCAESPPTFICGKRQKNQRKPVKMKILSSGVVFTFEEGRQRRGSCSYVPSIEEEIRPT

SEQ ID NO: 115182 - protein, 178 aa, Glycine max
  Coding DNA Sequence Number=SeqID_23497
MHEKAPKKLSTKRSRRDATAEGSNAAPEFDSHRFRSAEHQQCFEAIKGWSFHRERRVQLREDEYTDFQEEIARSHWTSLVTPMAKFDPERRECETCVHECPQPVPGSPASFGGGPTVRVQLEEDQGRRVRRGGHCPVVIHTGAGFRPDRCREAGADHTHQHDHLDPDVHGTAAQQCPA

SEQ ID NO: 115183 - protein, 147 aa, Glycine max
  Coding DNA Sequence Number=SeqID_23498
MPISPCRCIGWNRTHKDTQWTRRSPTGPWGFQLWLRASVVLQGARSPRQGHVIIGIAPARHPVDPKKSNRVLELSSSNYGSLPVLRSTCHLQQGHQAGAGRNTTAAWGWPAAGNRRTAITSRVHLSSSTKRLERCLRPMADQVQSQR

SEQ ID NO: 115184 - protein, 123 aa, Glycine max
  Coding DNA Sequence Number=SeqID_23499
MPISPLQKYQLVCFLPDMGIAPPKTPSEPEEVQQGPGVSSSGYGPLSVLQGARTPPGKGLCLQDTQWTRRSPTGSWSCQALITGLCQFYGVPVTSSKGIRPPTNRAFIKKYCAPRQTQGETPQ

SEQ ID NO: 115185 - protein, 70 aa, Glycine max
  Coding DNA Sequence Number=SeqID_23500
  Subcellular localization annotation: CTP_CleavageSite=35; ConfidenceScore=5.19e-01
MCQVPVHHGTFPLLRPQKFSFEYLLLPPRSAPDARSARARRPGFCSDRRALLTPSGLGPCPRRPGIGRAL

SEQ ID NO: 115186 - protein, 164 aa, Glycine max
  Coding DNA Sequence Number=SeqID_23501
MARTRGLGRAIGRVIGRDRQDDHDDVPERRRPTASARRQRVHQMTQDVPDMIEDAPDMVEDAPEMTADVQGDDGAEGSHADDAEGFPGGPRDPSVHTSFADHVAHAVWSGQVTLIGRPVLEIEGLVGATGLSPLVDCSVVTGDPGLISAFVERWHSETSTFHLP

SEQ ID NO: 115187 - protein, 51 aa, Glycine max
  Coding DNA Sequence Number=SeqID_23502
MASYGVASPLSLPFSILLPFIFQEAKESIDEEDPRPTSSNGACIILSLLIL

SEQ ID NO: 115188 - protein, 79 aa, Glycine max
  Coding DNA Sequence Number=SeqID_23503
MKNWPKIICNKIEYLYLSFPGTTHTLHLEFCSCRNLPFGGRATRGLTGASSMGGKCAKSSPTFIRGKRRKNRKGVVYEL

SEQ ID NO: 115189 - protein, 292 aa, Glycine max
  Coding DNA Sequence Number=SeqID_23504
  Homolog annotation: Hit_ID=Q6WAY6; Match level="QueryCoverage=92%, HitCoverage=53%, E-value=2e-30, Identity=31%"; Hit description =Putative uncharacterized protein
MGQLQRQAIHKAYGKIWDLAMVEVSTAAIASLAQYYDQPLRCFTFGDFQLSPMVEEFEKILGCPLGGSKPYLFSGFYPSLARISKIVQISAQELDHRKQVENGVVGIPRKYLEAKARILAGKGEWAPFIDILALLIFGGVLFPNVDGLVDLAAIDAFLAYHNHKESPVVAMLADLYDTFDRRCEKSNTRIVCCTPALYEGKTRVLFMRRISKCPLMGTRGCISYNLVLAIRKLGYPMRGAPLEDELAPVISQGFNKTNVETLQKAHKAWEVLQKKDKELRGSNNGPIGGYRK

SEQ ID NO: 115190 - protein, 111 aa, Glycine max
  Coding DNA Sequence Number=SeqID_23505
  Subcellular localization annotation: CTP_CleavageSite=73; ConfidenceScore=5.73e-01
VLQWLLFLSAVPSCSATDGVVRNGKKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 115191 - protein, 451 aa, Glycine max
  Coding DNA Sequence Number=SeqID_23506
  Gene Ontology: Mol. function=pyruvate kinase activity; Cellular component=cellular_component; Biological process=glycolysis
  Homolog annotation: Hit_ID=A4TJJ4; Match level="QueryCoverage=100%, HitCoverage=93%, E-value=0.0, Identity=85%"; Hit description =Pyruvate kinase
  Pfam annotation: Domain name=PK; Domain location=5-350; Score=745.8; E_value=2.9e-221; Accession=PF00224.12; Description=Pyruvate kinase, barrel domain
  Pfam annotation: Domain name=PK_C; Domain location=362-451; Score =106.8; E_value=6.8e-29; Accession=PF02887.7; Description=Pyruvate kinase, alphabeta domain
  Pfam module annotation: Pfam domain module=PK::PK_C; Domain location =5-350::362-451
MSRRLRRTKIVTTLGPATDRDNNLEKIIAAGANVVRLNFSHGSPEDHQARADKVREIAAKLGRHVAILGDLQGPKIRVSTFKEGKIFLNVGDKFLLDANLSKGEGDKEKVGIDYKGLPADVVPGDVLLLDDGRVQLKVLEVQGMKVFTEVTVGGPLSNNKGINKLGGGLSAEALTEKDKADIVTAAKIGVDYLAVSFPRTGEDLNYARRLARDAGCNAKIVSKVERAEAVCSDEAMDDIILASDVVMVARGDLGVEIGDPELVGIQKKLIRRARTLNRAVITATQMMESMITNPMPTRAEVMDVANAVLDGTDAVMLSAETAAGQYPAETVAAMARVCLGAEKIPSINVSKHRLDVQFDNIEEAIAMSSMYAANHLKGVTALIAMTESGRTALMMSRISSGLPIFAMSRHEHTLNLTALYRGVTPVYFDSHTDGVIAANEAVNRLRDKGFL

SEQ ID NO: 115192 - protein, 248 aa, Glycine max
  Coding DNA Sequence Number=SeqID_23507
  Gene Ontology: Mol. function=glucose-6-phosphate dehydrogenase activity; Cellular component=cytoplasm; Biological process =carbohydrate metabolic process
  Homolog annotation: Hit_ID=B0A5G0; Match level="QueryCoverage=100%, HitCoverage=47%, E-value=1e-126, Identity=90%"; Hit description =Glucose-6-phosphate 1-dehydrogenase
  Pfam annotation: Domain name=G6PD_N; Domain location=13-186; Score =322.3; E_value=9.1e-94; Accession=PF00479.13; Description=Glucose-6 -phosphate dehydrogenase, NAD bindi
MAVTSTAQACDLVIFGAKGDLARRKLLPSLYQLEKAGHIHPETRIIGVGRAEWDKKAYTEVVKEALGTFMKEKLDDELWATLSARLDFCNLDVNDSKNFTKLGKMLDQKHRTTINYFAMPPSTFGAICKGLGEAKLNHEPARVVMEKPLGTDLASSHVINDQVAEYFNESQVYRIDHYLGKETVLNLLALRFANSLFASNWDNRTIDSVQITVAEEARIEGRWGYFDQAGQMRDMIQNHLLQILTMIA

SEQ ID NO: 115193 - protein, 51 aa, Glycine max
  Coding DNA Sequence Number=SeqID_23508
DILPFILGYKEDYPWHKYIVMQSYPARALGSRLQVDWARDPREGPRVLMSL

SEQ ID NO: 115194 - protein, 128 aa, Glycine max
  Coding DNA Sequence Number=SeqID_23509
  Homolog annotation: Hit_ID=A5ANT6; Match level="QueryCoverage=75%, HitCoverage=22%, E-value=3e-15, Identity=38%"; Hit description =Putative uncharacterized protein
  Pfam annotation: Domain name=zf-CCHC; Domain location=24-41; Score =9.9; E_value=0.049; Accession=PF00098.14; Description=Zinc knuckle
MVASRGRGSGRNSRGGRGGRGGRPHCTYCKRIGHTQESCYSLHGFPDKVAQVSKSEKAESRFSDEEYQEYLKLKSEKPSNQAQPSSVPCFSTACISQFIEGHSPWILDSGASDHISGTWDGATDWRRI

SEQ ID NO: 115195 - protein, 67 aa, Glycine max
  Coding DNA Sequence Number=SeqID_23510
MTVSWAKCASTTKRSFNMLIMIEESGRASISRSRAKREISALSAAVIFSQAQRMTGAKRNVTDSEPI

SEQ ID NO: 115196 - protein, 98 aa, Glycine max
  Coding DNA Sequence Number=SeqID_23511
  Homolog annotation: Hit_ID=O52175; Match level="QueryCoverage=83%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSG

SEQ ID NO: 115197 - protein, 245 aa, Glycine max
  Coding DNA Sequence Number=SeqID_23512
  Subcellular localization annotation: CTP_CleavageSite=61; ConfidenceScore=5.12e-01
PHWRIRRSKSLAFVDHTAFCYHDPRAGSPRRHLTVIRTSSVIDKRRPIWSSGPFRRCRHLLMETFSSLTSYLELRRSEFLIGGYVGARALLCRPPHIFVILTLRSKTKFGHSAPLYHPEAAGPMIRGDTLRLSAPFCHPEAAGPMTSRDKIWSFCTLVSSRGGGPDDTRRYLTVIRTLLSSRGGGPDDKQRPKAAGPMTSRDQVWSFCTLVSSRGGGPDDTRRYLTVIRTLLSSRGGGPDDKQRP

SEQ ID NO: 115198 - protein, 68 aa, Glycine max
  Coding DNA Sequence Number=SeqID_23513
FDGYGLELLFDYPGSFKPLMIAADDPITASPKLSVLSSRRIPCLANSLEYPQVVVTETPCDERRDAFV

SEQ ID NO: 115199 - protein, 22 aa, Glycine max
  Coding DNA Sequence Number=SeqID_23514
MEGLDDSLEVPTGSALSLHGLH

SEQ ID NO: 115200 - protein, 114 aa, Glycine max
  Coding DNA Sequence Number=SeqID_23515
  Gene Ontology: Mol. function=protein binding
  Homolog annotation: Hit_ID=Q10C73; Match level="QueryCoverage=94%, HitCoverage=25%, E-value=1e-39, Identity=69%"; Hit description =BTB/POZ domain containing protein, expressed
MSGSHEFVIKGYSLTKGMGIGKYIVSETFIVGGFQWAIYFFPDGRDPKDNAAYVSVFVALHSKSTNVRALFDLTLLDLCKKGEHKVHSHFSHSLTIGPYTLINHGSMWLVKSRY

SEQ ID NO: 115201 - protein, 114 aa, Glycine max
  Coding DNA Sequence Number=SeqID_23516
MTQELVARGDTLRLSAPRHSVTPSVIDEQRPMWSSAPFPGMSASSDRDFSSLTSYQELRRSEFLIGGYVGARASLLSATLTSSVMLALESRDMRRYPSGYSYEHSFLLSVRRKA

SEQ ID NO: 115202 - protein, 84 aa, Glycine max
  Coding DNA Sequence Number=SeqID_23517
MVLQLIASNQEVSSALKSRVYQVIREASSLNSAREQSLHIPTFRESISLAVEMQHTHALAEVLTVVTSEDMLEPNLAKHVLEHI

SEQ ID NO: 115203 - protein, 27 aa, Glycine max
  Coding DNA Sequence Number=SeqID_23518
MAGRLIFLSFTIGLLTKVKHLLYQEYQ

SEQ ID NO: 115204 - protein, 91 aa, Glycine max
  Coding DNA Sequence Number=SeqID_23519
MPYLNLHPNIGTLDGFQVDGEVGGNEGGVDDFNKGIDVEQGVIGFDGVEGVSIGKGLKRGIGIAGFLCCCKGGGGSKGEMDKERGEEKEEE

SEQ ID NO: 115205 - protein, 111 aa, Glycine max
  Coding DNA Sequence Number=SeqID_23520
MVHKANPHQLDFAPHASGSYNAQQNAPELLHDNYMLHSSRILGKMEVEESWLGLWLPLHYRVDMGVSYPNFVRELLLVDMQPLVSRFEILGVLCCTINEVPRRVINQKEAG

SEQ ID NO: 115206 - protein, 27 aa, Glycine max
  Coding DNA Sequence Number=SeqID_23521
MDKSLKVGEDKWREKERSSTKFCASNE

SEQ ID NO: 115207 - protein, 15 aa, Glycine max
  Coding DNA Sequence Number=SeqID_23522
MVNYFSTKYRKIFRW

SEQ ID NO: 115208 - protein, 68 aa, Glycine max
  Coding DNA Sequence Number=SeqID_23523
MPQNVLYDAIGIYQRWVPPVASCFLSAVPPCSATDGGGCGNGKKHPPDISAGKCSGSPLRVTTTPRRA

SEQ ID NO: 115209 - protein, 284 aa, Glycine max
  Coding DNA Sequence Number=SeqID_23524
  Subcellular localization annotation: CTP_CleavageSite=37; ConfidenceScore=5.15e-01
SEFLIGGYVGARALLLSTTPPFAVMTQELVTRGGTLRLSAPRHSVTPSVVDEQRPMWSEFLIGGYVGARALLLSAAQQDLRVRWHAETKFGHSAPFCHPEAAGPMTCGDKIWSFRTPCHSRHSRVRWHAETKFGHSAPFCHPEAAGPMTCGDKIWSFRTPLPFKTQSCPMARRDKIWSFCTLLSSRGGGPDDMRRQNLVIPHPFAIQTQSCPMARRDKIWSFCTLLSSRGGGPDDMRRQNLVIPHPFAIQTQSCPMARRDKIWSFCTLLSSRGGGPDDMRRQNL

SEQ ID NO: 115210 - protein, 179 aa, Glycine max
  Coding DNA Sequence Number=SeqID_23525
MIRGDTLRLSAPLCHPEAVGPMMHGDTLWLSAPFCHPEAAGPMTSRDKIWSFCTLVSSRGGGPDDTRRYLTVIRTLVSSRGGGPDDTRRYLTVIRTLLSSRGGGPDDKQRQNLVILHPCVIQRRGGGPDDTRRYLTVIRTLVSSRGGGADDTRNTQVVIRINFLLLSVDRTLDSMQRLT

SEQ ID NO: 115211 - protein, 269 aa, Glycine max
  Coding DNA Sequence Number=SeqID_23526
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGASIYATAKAAVMTFTRAMAKELGPKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115212 - protein, 206 aa, Glycine max
  Coding DNA Sequence Number=SeqID_23527
MERSMIDAASGGALGDITPAEARNLIEKMASNSQQFSARNDAIVIIGVHEQSGAIEQPKAYAANIYNRPPQPQQQNQPQQNNYDLSNDKYNPGPDVPPPIQLQQQQQKQQQPQKQQIVEAPPEPSLEELVRQMTMQNMQFQQETRASIQSLTNQMGQLATQSGKQYQGPQLVASSSSANEPAQLHSTPEKEDDKNLKSKLPINFYA

SEQ ID NO: 115213 - protein, 157 aa, Glycine max
  Coding DNA Sequence Number=SeqID_23528
  Homolog annotation: Hit_ID=A5BXI2; Match level="QueryCoverage=68%, HitCoverage=7%, E-value=6e-14, Identity=35%"; Hit description =Putative uncharacterized protein
MSFLGSNIKDLKNTYPDVHIETWRFGLHVKLQFGLQQDIPVDPMNLDLLHQIDMRGNHYIDWMEYHAEWINIWKNKRNDVLAGQWVEGIVTHTPAYMEWYRKNTTLFLSVAQQLHDPCTTITHNVAGLGVEQTHFEISHPQPMYSTPFTCSSNFWPH

SEQ ID NO: 115214 - protein, 241 aa, Glycine max
  Coding DNA Sequence Number=SeqID_23529
  Homolog annotation: Hit_ID=Q6UUU1; Match level="QueryCoverage=29%, HitCoverage=46%, E-value=1e-18, Identity=71%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIIAFGVRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGARFPGRCQEDT

SEQ ID NO: 115215 - protein, 157 aa, Glycine max
  Coding DNA Sequence Number=SeqID_23530
  Gene Ontology: Mol. function=endonuclease activity; Biological process=response to DNA damage stimulus
  Homolog annotation: Hit_ID=P09184; Match level="QueryCoverage=79%, HitCoverage=80%, E-value=4e-56, Identity=77%"; Hit description=Very short patch repair protein
  Pfam annotation: Domain name=Vsr; Domain location=11-72; Score=62.3; E_value=1.6e-15; Accession=PF03852.6; Description=DNA mismatch endonuclease Vsr
MIRPHVVKICALSRPAIRQLRSGLAALLTQAGFTFRVQEASLPGRPDFLLSDYRCVIFTHGCFWHHHHCYLFKVPATRTDFWLKKIGANVQRDRRDLAMLLAQGWRVLIVWECALRGRQKLSDDALCDRLEEWICGGGNCAQIDTQGIGFIDPIDKA

SEQ ID NO: 115216 - protein, 68 aa, Glycine max
  Coding DNA Sequence Number=SeqID_23531
MEDCLEGPHLAIHEHSSKLESGGHMNRPRPITLMGLEKSSKLESGGHMNSPRQNIHGAPEKPENGELP

SEQ ID NO: 115217 - protein, 687 aa, Glycine max
  Coding DNA Sequence Number=SeqID_23532
  Gene Ontology: Mol. function=sugar binding
  Homolog annotation: Hit_ID=Q8Y118; Match level="QueryCoverage=99%, HitCoverage=57%, E-value=1e-97, Identity=33%"; Hit description =Putative curculin-like (Mannose-binding) lectin protein
RAGDALLRDFYGQEVVRYSATKPATRIYETNVVEATSYHSVKRLTAAGKPGDLAVQVDTPYVSIVPTSTAETPVSDVLAGMGTISQVPSGPAGSLGQNFNASFAAGVPVSRYLGTGLVVGAIRVVAGSVELTDDGTGGLASAVATPWSGTVDYQGGVVALTHASGVGSTSISITASPAGSIPMQGFTDEIEVTQNNQGMVWLFQLTPLPAPGTVVVGYRALGRWIRLTDNGRGRLIGKPGQGTGTINYQTGSVVVTAGALPDLKSSIISNWGTPIIAEARVGDAAILPPALRFVLGEGSAVPETVQLTLRVGGSNVVVTDNGNGGLLIGGQVRGQISYSTGEISLRPLSLPDADSQLSIAYDWGQPLHAAPQPVPDAAGIVSFTLPQGPVRQGTVLLDWLVSVRRDRDDLSSAPQAMRVIAKDDGAGNLVGVSVGDTAFSTVLGAVNYSTGAVSLQAGKFMVRQVSYPVYEIRSGRLKVVGYERLDVLAQFSAGSIVSAGWMLAGEAAQSAQEAMPLPAVQLQLTPTISDSIVPGSVRFAFRGRTYVDRSGGLYHSIDPATGSGIYAGTIDYAAGVVNLVQWLAGGENTVQIQSLLTRIADPGVAVSFFRAPGSPLRPGMFTLRATRIDGELLTVTADINGVLSAAEIRGKVDWESGVVKVQFGQLVPVAGNEGKPWFDPDQVEGDQ

SEQ ID NO: 115218 - protein, 91 aa, Glycine max
  Coding DNA Sequence Number=SeqID_23533
  Subcellular localization annotation: CTP_CleavageSite=63; ConfidenceScore=5.00e-01
VLQWLLFLSAVPPCSATDGVVRNGKKHPPDISAGKCSGPAARNHHTPPRLMRRYRARPIRHSGCATVGKGDRCGPLRYYASWRKRDVLQGD

SEQ ID NO: 115219 - protein, 204 aa, Glycine max
  Coding DNA Sequence Number=SeqID_23534
MVMGDFISRLSFPENTETFSSLTSYPELRRSEFLIGGYVGARASLLSTTPPFVAMTQELVAAEIPYETKFGHSAPMIRGDTLWLFAPFCHPEAAGPMTSRDQVWSFCTHDTRRYHMVIRTLLSSRGGEPDDKQRPKTKFGHSAPMIRGDTLWLFAPFCHPEAAGPMTSRDQVWSFCTHDTRRYLMVIRTLLSSRGGGPDDKQRP

SEQ ID NO: 115220 - protein, 34 aa, Glycine max
  Coding DNA Sequence Number=SeqID_23535
MVLSRVLMMLHNLNQRLLLGGLSSWSNYMTRKVL

SEQ ID NO: 115221 - protein, 105 aa, Glycine max
  Coding DNA Sequence Number=SeqID_23536
RDRALRCPYQTCVKARVMREIEEVQEQMKADMEAMKEQMTTMMEAMMIMRKMMEVKTAIVVVASTATKVDLTHPSGLNQVNRPVSDMVGQGGEALGSVGGPHFVQ

SEQ ID NO: 115222 - protein, 50 aa, Glycine max
  Coding DNA Sequence Number=SeqID_23537
MDRSTCISGFWLSACFSCSVDEVKRFFLVLSQENGALSGWLAKPADGLSK

SEQ ID NO: 115223 - protein, 95 aa, Glycine max
  Coding DNA Sequence Number=SeqID_23538
MDRVASLLRLLPNTFRTVDVLVTSSFTLTKEVQEQMKADMEAMKEQMATMMEAMMSMKKIMEANAVTVAATSVVAKVNPMPPSGLNQINHPTSDM

SEQ ID NO: 115224 - protein, 112 aa, Glycine max
  Coding DNA Sequence Number=SeqID_23539
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=50%, HitCoverage=29%, E-value=3e-22, Identity=87%"; Hit description =Chromosome chr4 scaffold_32, whole genome shotgun sequence
  Pfam annotation: Domain name=APC10; Domain location=4-112; Score= -52.8; E_value=0.00012; Accession=PF03256.7; Description=Anaphase -promoting complex, subunit 10 (APC10)
  Subcellular localization annotation: CTP_CleavageSite=43; ConfidenceScore=5.15e-01
NLLSKKSRRKPYTVVGTVGRRKPYTALGTVGRRKPYIALGTVVGAQSSKLSTLPVNKLIVLYVVFKLDESYTPSKVSIRAGDGFHNLKEIKTVELVKPTGWVYLSLSGADPR

SEQ ID NO: 115225 - protein, 79 aa, Glycine max
  Coding DNA Sequence Number=SeqID_23540
MGCPCVPIPRKIIEATRSNNNSHRMDPQASQQAAVRGVNIHYLKGNLTGVRAYLYREVDLSPNLSEGAVEGTNYHGAWL

SEQ ID NO: 115226 - protein, 41 aa, Glycine max
  Coding DNA Sequence Number=SeqID_23541
MKIQKKVLREGAQSMKNLGILRSNPFQGGGNDAILSRKGIG

SEQ ID NO: 115227 - protein, 440 aa, Glycine max
  Coding DNA Sequence Number=SeqID_23542
  Gene Ontology: Mol. function=oxidoreductase activity, acting on sulfur group of donors, disulfide as acceptor; Cellular component =chloroplast; Biological process=sulfate reduction, APS pathway
  Homolog annotation: Hit_ID=Q8W1A1; Match level="QueryCoverage=99%, HitCoverage=91%, E-value=0.0, Identity=90%"; Hit description =Adenosine 5'-phosphosulfate reductase
  Pfam annotation: Domain name=PAPS_reduct; Domain location=89-270; Score=259.7; E_value=6.4e-75; Accession=PF01507.10; Description =Phosphoadenosine phosphosulfate reductase family
  Pfam annotation: Domain name=Thioredoxin; Domain location=337-439; Score=14.1; E_value=1.5e-05; Accession=PF00085.11; Description =Thioredoxin
  Pfam module annotation: Pfam domain module=PAPS_reduct::Thioredoxin; Domain location=89-270::337-439
MVCFGFREGSLFSSVVANVTQGPPWGGPLNPDPQGKVFFFLFAETFFGPREFFPEVEKEEEDFEQIAKDLENASPLEIMDRALEKFGNDIAIAFSGAEDVALIEYAHLTGRPYRVFSLDTGRLNPETYKFFDAVEKHYGIHIEYMFPDAVEVQALVRTKGLFSFYEDGHQECCRVRKVRPLRRALKGLKAWITGQRKDQSPGTRSEIPVVQVDPVFEGLDGGIGSLVKWNPVANVNGLDIWSFLRTMDVPVNSLHSQGYVSIGCEPCTRPVLPGQHEREGRWWWEDAKAKECGLHKGNIKHEDAAQLNGNGASQANGSATVADIFNSQDVVSLSRSGIENLAKLENRKEPWLVVLYAPWCRFCQAMEESYVDLAEKLAGSGVKVAKFRADGDQKEYAKTELQLGSFPTILLFPKHSSQPIKYPSEKRDVDSLTAFVNALR

SEQ ID NO: 115228 - protein, 207 aa, Glycine max
  Coding DNA Sequence Number=SeqID_23543
MAGVEPLDASLDRLEAAMANLATVDSDLHASHLRLDAFHTSMLFKLDLLSRKLDTMIFRQRFLFPSSVLPPSPPLLSPPLFPSSAQPPPLPSLPAPPSNASSYHPSQYPPPPRSHVPPSMAGQRDGPVIGIDSSTIDFPVSVWQHHRVTINHHFQSNQVLPLPLRTDHRRYYKIPYNNDIILHGDPVVAHQIHQRWIWVFFTFETQR

SEQ ID NO: 115229 - protein, 283 aa, Glycine max
  Coding DNA Sequence Number=SeqID_23544
  Gene Ontology: Mol. function=DNA binding; Cellular component=nucleus; Biological process=regulation of transcription
  Homolog annotation: Hit_ID=A7R052; Match level="QueryCoverage=32%, HitCoverage=67%, E-value=6e-30, Identity=68%"; Hit description =Chromosome chr10 scaffold_297, whole genome shotgun sequence
  Pfam annotation: Domain name=Myb_DNA-binding; Domain location=75-126; Score=46.0; E_value=1.3e-10; Accession=PF00249.22; Description=Myb -like DNA-binding domain
  Subcellular localization annotation: CTP_CleavageSite=43; ConfidenceScore=5.57e-01
MKNKKGEALSETSLPPSTMSSSSSSLVTTLVDNNNPTQPSQLRAARRRFTSDHHLPEISLKTPMVRPYVRSKMPRLRWTPDLHRCFVHAVQRLGGEDRATPKLVLQLMNVKGLTISHVKSHLQMYRSMRHEQMSQGAKKNNMAPDFPASTLATLGPRQQKPHKRSCTEELVPTQAQWNHDEQECYNGNQGGESIIICNGNEQKVHSYIIFEGLLRGQSVQENKTTTTEKVSLGDAGYESDHQRFQDTTLSLSMSSRPSSHSFLNRSHSTGPDANDVSLELTLS

SEQ ID NO: 115230 - protein, 99 aa, Glycine max
  Coding DNA Sequence Number=SeqID_23545
  Gene Ontology: Cellular component=integral to membrane
  Homolog annotation: Hit_ID=A5C4Z3; Match level="QueryCoverage=83%, HitCoverage=44%, E-value=4e-32, Identity=69%"; Hit description =Putative uncharacterized protein
MQIFGAAYLGPFGHFFHLILDKIFKGKRDSKTVAKKVLIEQLTSNPWNNLLFMIYYGLVVEGQPWVNVKAKVKKDYLSVQYTSWTGSILEPSSTIYGID

SEQ ID NO: 115231 - protein, 784 aa, Glycine max
  Coding DNA Sequence Number=SeqID_23546
  Homolog annotation: Hit_ID=A7R3T5; Match level="QueryCoverage=100%, HitCoverage=88%, E-value=6e-97, Identity=52%"; Hit description =Chromosome undetermined scaffold_567, whole genome shotgun sequence
  Subcellular localization annotation: CTP_CleavageSite=45; ConfidenceScore=5.37e-01
MSSLRASPLLIDNPLHSYSCSSSLKRINCSINAPKLPRVSFSLPKASSRRSLVEDLDKFTSEKNPLSEKNDSIKTLHDGVLYESANSKAIIQLYAISEAVADRIEMHKNVGEQRVNWNTLLLNSINMLTLTASTMAGVAGSGEGAPLLALKLSSTLLFSAATGMLLATNKIQPSQLAEEQRNAARLFKQLQTQIQTKIAIGNPSEGDVRDAIEKVLALDKAYPLPLLGGAMLEKFPAKFEAARWWPESYRLSNGKEKIMEIKSNKNNNGWNVELEEEMREVIEVVKRKDMEDYERLGNIALKINKGFAVSAPLLTGIAALGSVFSGDGLVPALAGALATVVNAFEHGGQVGMVFEMYRTCGGFFQLLEETIEATLEEKNLEKRENGELFEMKMALQLGRSVSQLRELASKSASCRLEGREIDEFSSKLFYNNNNNITSKATIQLYAILEAVDDRVEMHHNIGEQRDNWNTLLLNSINMLTLTATAMAGVAATIATGDAPLLALKLSSMLLFSASTGMLMVMNKIQPSQLAEEQRNARRLFKQIKSHIETTLAIGNPTEEDVKDAMEKVLALDKAYPLPLLGAMIEKFPKKFEPAVWWPSKRNNSKYHETNQQQQHGKNNGWNEGLEMEIRDVLKVVKEKDMKDYERLGNLVLKINKSLAIAGPLLTGVAAVGSACLSQDSSWGAIVSVLGGALATAVNAFEHGGQVGMVSEMYRNCGGFFQMLENSIQETMEEDEEQRENGELFEMKLALKLGRSLSQLRDLARKSAYSRVEGITTDEFASKLF

SEQ ID NO: 115232 - protein, 310 aa, Glycine max
  Coding DNA Sequence Number=SeqID_23547
  Gene Ontology: Mol. function=protein binding; Cellular component =intracellular; Biological process=embryonic development ending in birth or egg hatching
  Homolog annotation: Hit_ID=A7QUJ8; Match level="QueryCoverage=54%, HitCoverage=67%, E-value=3e-61, Identity=71%"; Hit description =Chromosome chr10 scaffold_179, whole genome shotgun sequence
  Pfam annotation: Domain name=Ala_racemase_N; Domain location=87-304; Score=-55.9; E_value=0.0059; Accession=PF01168.11; Description =Alanine racemase, N-terminal domain
  Subcellular localization annotation: CTP_CleavageSite=55; ConfidenceScore=5.12e-01
MLRCASWFKKNRNRGSRESSSWGPWQRFPFPNKVYIRGRSVVTVSEANGSIVTIAATEGGAGAECGRDSCSGGELTVRYTTPAADASARTTFRKSFIKHHRLLTYLLQTSISLLISCFWYSLINAYIPFSIAASRRHRMAFNLIGNLQSNKVKPLIAAVPNLACVQTVDDEKIANLLDRAVENVGRKSLKVFFQVNTSGETSKFGVEPAQWVDLVKHITNCPNLEFCGLMTIGMLDYSSTPENFKTLSNCRSEVCKAIGISETQCELSMGMTGDFEQALTLILKIEMGSTNVRNGTAIFGSREYPPKEEE

SEQ ID NO: 115233 - protein, 514 aa, Glycine max
  Coding DNA Sequence Number=SeqID_23548
  Gene Ontology: Mol. function=malonyl-CoA decarboxylase activity; Cellular component=mitochondrion; Biological process=fatty acid biosynthetic process
  Homolog annotation: Hit_ID=A7QUK9; Match level="QueryCoverage=90%, HitCoverage=99%, E-value=0.0, Identity=79%"; Hit description =Chromosome chr10 scaffold_179, whole genome shotgun sequence
  Pfam annotation: Domain name=MCD; Domain location=112-481; Score =486.7; E_value=2.9e-143; Accession=PF05292.2; Description=Malonyl -CoA decarboxylase (MCD)
  Subcellular localization annotation: CTP_CleavageSite=45; ConfidenceScore=5.37e-01
MNAQQNARSQMQQQQQNSLPNGSPGDGNSAPNDSGNSDREFKSVRASMHSAISMNKTEVLDDVLNNFSEGYLSLSRENRRKLLLVLAREYDLNRSQVRELIKQYLGLELPADKAQVSGSEDEGLFSSFYRVERNLRHALQPVYEVLFERLNTHPGGLRTLSILREDILSILTEENIASLRALDSYLMEKFITWLSPAALELHQITWDDPASLLEKIVAYEAVHPISNLLDLKRRLGIGRRCFGYLHPAIPGEPLIFIEVALLKDVAQTIQEVLWDSPPIPEGEATCALFYSISSTQPGLAGINLGKFLIKRVVTQVKREMPHISTFATLSPIPGFMSWLLSKLASQRLLAEGDNLSQPQAEGSSSTFYENILKPKEEEALMSLPKDIATGENGMDVMFNLLTSTSYKWIHSPELLSALKSPLMRLCARYLLQEKKRGKALDSVANFHLQNGAMVERINWMADRSDKGLSQSGGIMVNYVYRLDHIEEYAHSYFSNAEIHASSALHHWVDVTDTA

SEQ ID NO: 115234 - protein, 262 aa, Glycine max
  Coding DNA Sequence Number=SeqID_23549
  Homolog annotation: Hit_ID=A5AKT3; Match level="QueryCoverage=29%, HitCoverage=33%, E-value=1e-22, Identity=59%"; Hit description =Putative uncharacterized protein
MTIQNEYMFFNCSQDSLCSACEHFSEHCDSSCDSASYLCSHLPGSSYYPKATQSLRLMLKYCATYASVYWKNVGAPMPYDQDGNSTTHCKAYFYVIETAGPTKMRLGTPYKANLAWFAIMNFNAMHDNMANTLYCNARPICYLHFSTSSINGLVAIHDKLILEPNNHIFGKNDTKGLFLDHTIMKCACLWAYGPPTASLPKPIAQLAMAWRFDAQFDLARQQESILFRIALSVEYARCSMKHEIKSSVGEVALLVRLRLHME

SEQ ID NO: 115235 - protein, 787 aa, Glycine max
  Coding DNA Sequence Number=SeqID_23550
  Gene Ontology: Mol. function=hydrolase activity; Cellular component =nucleus; Biological process=metabolic process
  Homolog annotation: Hit_ID=A7QUJ9; Match level="QueryCoverage=83%, HitCoverage=91%, E-value=0.0, Identity=49%"; Hit description =Chromosome chr10 scaffold_179, whole genome shotgun sequence
  Pfam annotation: Domain name=DUF1068; Domain location=634-787; Score =109.2; E_value=1.3e-29; Accession=PF06364.3; Description=Protein of unknown function (DUF1068)
  Pfam annotation: Domain name=PPR; Domain location=128-162; Score =47.0; E_value=6.5e-11; Accession=PF01535.11; Description=PPR repeat
  Pfam annotation: Domain name=PPR; Domain location=226-260; Score =31.2; E_value=3.8e-06; Accession=PF01535.11; Description=PPR repeat
  Pfam annotation: Domain name=PPR; Domain location=261-295; Score=6.5; E_value=1.3; Accession=PF01535.11; Description=PPR repeat
  Pfam annotation: Domain name=PPR; Domain location=327-361; Score =47.1; E_value=6e-11; Accession=PF01535.11; Description=PPR repeat
  Pfam annotation: Domain name=PPR; Domain location=362-396; Score=5.5; E_value=1.7; Accession=PF01535.11; Description=PPR repeat
  Pfam annotation: Domain name=PPR; Domain location=428-462; Score =44.2; E_value=4.7e-10; Accession=PF01535.11; Description=PPR repeat
  Pfam annotation: Domain name=PPR; Domain location=463-497; Score=5.7; E_value=1.6; Accession=PF01535.11; Description=PPR repeat
  Pfam annotation: Domain name=PPR; Domain location=529-563; Score =34.2; E_value=4.6e-07; Accession=PF01535.11; Description=PPR repeat
  Pfam annotation: Domain name=PPR; Domain location=564-598; Score =10.1; E_value=0.5; Accession=PF01535.11; Description=PPR repeat
  Pfam annotation: Domain name=PPR; Domain location=62-96; Score=7.0; E_ value=1.2; Accession=PF01535.11; Description=PPR repeat
  Pfam module annotation: Pfam domain module=DUF1068::PPR::PPR::PPR::PPR ::PPR::PPR::PPR::PPR::PPR::PPR; Domain location=634-787::128-162::226- 260::261-295::327-361::362-396::428-462::463-497::529-563::564 -598::62-96
  Subcellular localization annotation: CTP_CleavageSite=30; ConfidenceScore=5.12e-01
MFSYKPKQSPSGLKRCVVSLPHPATTNSVNATINHHSTQGAHHQVLATYASMLKTHVPSDAYTFPSLLKACSFLNLFSLGLTLHQRILVSGLSLDAYIASSLINFYAKFGFADVARKVFDYMPERNVVPWTTIIGCYSRTGRVPEAFSLFDEMRRQGIQPSSVTVLSLLFGVSELAHVQCLHGCAILYGFMSDINLSNSMLNVYGKCGNIEYSRKLFDYMDHRDLVSWNSLISAYAQIGNICEVLLLLKTMRLQGFEAGPQTFGSVLSVAASRGELKLGRCLHGQILRAGFYLDAHVETSLIVVYLKGGKIDIAFRMFERSSDKDVVLWTAMISGLVQNGSADKALAVFRQMLKFGVKPSTATMASVITACAQLGSYNLGTSILGYILRQELPLDVATQNSLVTMYAKCGHLDQSSIVFDMMNRRDLVSWNAMVTGYAQNGYVCEALFLFNEMRSDNQTPDSITIVSLLQGCASTGQLHLGKWIHSFVIRNGLRPCILVDTSLVDMYCKCGDLDTAQRCFNQMPSHDLVSWSAIIVGYGYHGKGEAALRFYSKFLESGMKPNHVIFLSVLSSCSHNGLVEQGLNIYESMTKDFGIAPDLEHHACVVDLLSRAGRVEEAYNVYKKKFPDPVLDVLGIILDACRANGNNELGDTIANDILMLRPMDAGNFVQLAHCYASINKWEEVDCMRQDPEESEEVGKSFTDLLAEEVKQKEAEAEEKQRSVDTKLLEAKKLASQYQKEADKCNSGMETCEQARERAEAALENQMKETALWELRARQRGWNKKMLQ

SEQ ID NO: 115236 - protein, 52 aa, Glycine max
  Coding DNA Sequence Number=SeqID_23551
MQSIMEAKEEVEVEVEVEAVVEFQIATVKVGPSTFFPSGVLDFLASVSTFSF

SEQ ID NO: 115237 - protein, 87 aa, Glycine max
  Coding DNA Sequence Number=SeqID_23552
  Gene Ontology: Mol. function=nucleoside-triphosphatase activity
  Homolog annotation: Hit_ID=A2X9F9; Match level="QueryCoverage=68%, HitCoverage=10%, E-value=3e-19, Identity=76%"; Hit description =Putative uncharacterized protein
MSEFYGKSERLLGKVLSLANTLPNGAIIFLDEIDSFAAARDNEMHEATRRILSVLLRQFNLVGYCLRYTEWHVIYLLSIEIDCVLEF

SEQ ID NO: 115238 - protein, 536 aa, Glycine max
  Coding DNA Sequence Number=SeqID_23553
  Gene Ontology: Mol. function=calcium ion binding; Cellular component =endocytic vesicle; Biological process=endosome transport
  Homolog annotation: Hit_ID=A7P0K3; Match level="QueryCoverage=99%, HitCoverage=98%, E-value=0.0, Identity=71%"; Hit description =Chromosome chr19 scaffold_4, whole genome shotgun sequence
  Pfam annotation: Domain name=Dynamin_N; Domain location=196-356; Score=108.6; E_value=1.9e-29; Accession=PF00350.14; Description =Dynamin family
  Pfam annotation: Domain name=GTP_EFTU; Domain location=191-421; Score= -80.3; E_value=0.034; Accession=PF00009.18; Description=Elongation factor Tu GTP binding domain
  Pfam annotation: Domain name=MMR_HSR1; Domain location=194-357; Score= 29.6; E_value=2.1e-06; Accession=PF01926.14; Description=GTPase of unknown function
  Pfam annotation: Domain name=efhand; Domain location=13-41; Score =18.4; E_value=0.027; Accession=PF00036.23; Description=EF hand
  Pfam annotation: Domain name=efhand; Domain location=47-75; Score =20.6; E_value=0.0057; Accession=PF00036.23; Description=EF hand
  Pfam module annotation: Pfam domain module=Dynamin_N::GTP_EFTU::MMR _HSR1::efhand::efhand; Domain location=196-356::191-421::194-357::13 -41::47-75
MKTESRSKEETKTYQEWFNLADSDGDGRISGNDATKFFALSNLSRSQLKQLWALADVKRQGFLGFTEFVTAMQLVSLAQAGQELKSDILKTQSKFDKENIKPPVLEGLDALVAQMSLTISAPPEVNGTPQPQVFPTNRWFGSKSSKKLSLNSVTSIIDGLKRLYIERLKPLEVAYQYNDFVSPLLTNTDFDAKPMVMLLGQYSTGKTTFIKHLLKCDYPGAHVGPEPTTDRFVVVMSGPDERSIPGNTIAVDADMPFGGLTTFGGSFLSKFQCSQMPHPLLDEVTFVDTPGVLSGEKQRTQRSYDFTGVVSWFAAKCDLILLLFDPHKLDISDEFKRVIASLHGNDDKIRVVLNKADQVDTQQVREYQHRLPAYESLWSIDVVTGSFNDKPMDEGFVSPLGQDLFEKEQNNLLADLMDIPKKACDRRINEFVKRARSAKIHAYIISHLKKEMPAIMGKAKARQRLLDNLEEEFAKVQREFHLPAGDFPNVEHFREVLNGYNIDKFEKLKPKMIQAVDDMLGFEIPELLKKFRNPYD

SEQ ID NO: 115239 - protein, 89 aa, Glycine max
  Coding DNA Sequence Number=SeqID_23554
  Gene Ontology: Mol. function=protein serine/threonine kinase activity; Biological process=protein amino acid phosphorylation
  Homolog annotation: Hit_ID=Q2MHE4; Match level="QueryCoverage=96%, HitCoverage=23%, E-value=2e-28, Identity=67%"; Hit description =Serine/threonine-protein kinase HT1
MYEANINERPPLPASCQPALAHLIKRCWSANPSKRPDFSDIVSTLEKYDECVKEGLPLSHNHSGLVSRNVIIERLKGCVSMSSSIPVHA

SEQ ID NO: 115240 - protein, 312 aa, Glycine max
  Coding DNA Sequence Number=SeqID_23555
  Gene Ontology: Mol. function=protein binding
  Homolog annotation: Hit_ID=A2Q1J3; Match level="QueryCoverage=92%, HitCoverage=91%, E-value=4e-95, Identity=62%"; Hit description =Putative uncharacterized protein
  Pfam annotation: Domain name=DUF506; Domain location=40-248; Score =271.2; E_value=2.2e-78; Accession=PF04720.3; Description=Protein of unknown function (DUF506)
MARIPVRFQRVAAAFDADVARVRLCESSGSEHSPESLTDLSDLVKSFMEKNETTTTGEKEEEEEEGGGVHEEELEKTEWSDSEKREMLQSFLYGKEDETDEDERDAKEKIRREVEVAFGLVGNNYKRRLISLLREKGFDAGLCKSKWEKNGRLTAGDYEYIDVNFKGKRYIVEISLAGEFEIARPTDQYSSLLDVFPLIFVGKVEEMKQVVRLMCTAIKGSMKRMKLHIPPWRRNVYMQAKWFGAYKRTTNAVATKRVSLPLSSDESLFPKRSIGFEVRPVKAHKCRDVYATNTGFRTGHLTAVFNSDSLGA

SEQ ID NO: 115241 - protein, 240 aa, Glycine max
  Coding DNA Sequence Number=SeqID_23556
  Gene Ontology: Mol. function=Rho GDP-dissociation inhibitor activity; Cellular component=cytoplasm; Biological process=negative regulation of cell adhesion
  Homolog annotation: Hit_ID=Q705X3; Match level="QueryCoverage=96%, HitCoverage=98%, E-value=1e-102, Identity=79%"; Hit description=Rho GDP dissociation inhibitor 2
  Pfam annotation: Domain name=Rho_GDI; Domain location=45-240; Score =61.4; E_value=3e-15; Accession=PF02115.8; Description=RHO protein GDP dissociation inhibitor
MGFDEKVKDNDGAGDDDASHRVHAAKAGTDHESGHEGGGTFSRYRSESSIAATEDEDDEEERKIELGPQCTLKEQLEKDKDDESLRRWKEQLLGSVDINSVGETLEPNVKILSLAIKSADRPDIVLAIPEGGNPKGLWFTLKEGSRYRLMFTFQVENNIVSGLKYTNTVWKTGVKVDSSKEMIGTFSPQAEPYTHEMPEETTPSGMFARGQYSARSKFVDDDNKCYLEINYTFDIRKEWQ

SEQ ID NO: 115242 - protein, 130 aa, Glycine max
  Coding DNA Sequence Number=SeqID_23557
  Gene Ontology: Mol. function=6-phosphofructokinase activity; Cellular component=6-phosphofructokinase complex; Biological process=glycolysis
  Homolog annotation: Hit_ID=Q9STQ7; Match level="QueryCoverage=36%, HitCoverage=9%, E-value=5e-12, Identity=75%"; Hit description =Pyrophosphate-dependent phosphofructo-1-kinase
MDEDKPETHDGRPKRSTKRSEFPCPRNEGPLSSACIRKPSELKPNVSLSGVKVVTDLVVVFDDVEPCLIGSVRFLGTKFVDSDSDVLVIDKSFGFDAAVEEAQGAINFAYVEAESTENGNDIVKLIGRYS

SEQ ID NO: 115243 - protein, 107 aa, Glycine max
  Coding DNA Sequence Number=SeqID_23558
  Homolog annotation: Hit_ID=A5BZW2; Match level="QueryCoverage=46%, HitCoverage=3%, E-value=9e-09, Identity=52%"; Hit description =Putative uncharacterized protein
MEYFVDDKRHDVNFQVGDWVFVKLRPCRQASVTRASYSKLTKRFFGPFQILRKYHLEDKVLFEEHDNVREGTKQPSPEAQKTESQLANTNQRPKRLVTKPQYLKDFI

SEQ ID NO: 115244 - protein, 190 aa, Glycine max
  Coding DNA Sequence Number=SeqID_23559
MKVRNHLFPTTRCDSIGKIELKVKDTLYYYRYSKPTEAPYARGQDNIPMLGERLDSYPKDQQKQPWQYEIHHSCKYRKQKIYNSQAYVSESPYFIGHTQTFQDLTRLGSSARLDLKVDHIRPENREEGSENRAKGEALGDKAENFGLRRDFMAWKGFKGFATGNKDFAFYAMLFELEGNLHSPGNQTHTA

SEQ ID NO: 115245 - protein, 215 aa, Glycine max
  Coding DNA Sequence Number=SeqID_23560
  Gene Ontology: Mol. function=thymidine kinase activity; Cellular component=cytoplasm; Biological process=DNA replication
  Homolog annotation: Hit_ID=A7Q347; Match level="QueryCoverage=85%, HitCoverage=71%, E-value=1e-68, Identity=71%"; Hit description =Thymidine kinase
  Pfam annotation: Domain name=TK; Domain location=20-190; Score=135.9; E_value=1.1e-37; Accession=PF00265.9; Description=Thymidine kinase
MVPYFHLLESKERNKLNGLAIASFIRNVAIIKSSKDTRYGLDSIVTHDGAELPCWALENLSSFKQKFGIDAYEKLDVIGIDEAQFFDDLYEFCLQAADHDGKTVIVAGLDGYGWILHYRVHAEGVSTFTGRRSFGSVLDIIPLADSVTKLTARCEICGKRACFTLRKTQDKQIELIGGVDVYMPVCRQHYVSGQVAMEATRHVLESHKVECASHT

SEQ ID NO: 115246 - protein, 343 aa, Glycine max
  Coding DNA Sequence Number=SeqID_23561
  Gene Ontology: Mol. function=binding; Cellular component=cytoplasm; Biological process=positive regulation of multicellular organism growth
  Homolog annotation: Hit_ID=A7R1X7; Match level="QueryCoverage=100%, HitCoverage=98%, E-value=1e-144, Identity=75%"; Hit description =Chromosome undetermined scaffold_383, whole genome shotgun sequence
  Pfam annotation: Domain name=Mo25; Domain location=1-343; Score =461.2; E_value=1.3e-135; Accession=PF08569.2; Description=Mo25 protein family
MKGLFKSKPRTPADVVRQTRDLLLFVDRSPETRESKREEKLFGFASIIELDMPSSGIIRAVVEFMSELFKNIRELKSILYGNSESEPVSEACAQLTQEFFKEDTLRLLIKCLPKLNLEARKDATQVVANLQRQQVQFKLIASDYLEKNMDLMDILIVGYENQDMALHYGAMLRECIRHQIVAKYVLNSPRMKKFFDYIQLPNFDIAADAAATFKELLTRHKSTVAEFLSKNYEWFFAEYNTKLLESSNYITRRQAVKLLGDMLLDRSNSAVMTRYESSKSIQIEAFHVFKLFAANQHKPADIVGIFVANKSKMLRLLEDFKIDKEDEQFEADKAQVMREIEAL

SEQ ID NO: 115247 - protein, 96 aa, Glycine max
  Coding DNA Sequence Number=SeqID_23562
MAGGVDARRTMTNDGDYNGKERRQWLQWQEVAQRSQPSTSTNPNMCYKPSLSNIDSLVGNDDVRQNRQFCERSWTQLKSRWNRIHPPVQKFNGCYK

SEQ ID NO: 115248 - protein, 338 aa, Glycine max
  Coding DNA Sequence Number=SeqID_23563
  Gene Ontology: Mol. function=DNA binding; Cellular component=nucleus; Biological process=regulation of transcription
  Homolog annotation: Hit_ID=A7R040; Match level="QueryCoverage=68%, HitCoverage=53%, E-value=7e-63, Identity=54%"; Hit description =Chromosome undetermined scaffold_296, whole genome shotgun sequence
MDLFAGDHFPVPDHVAPFPDSGDLVFAADLLSHRPNPQKLRPIRSVPAAPIAHPPPPPLSHDPIPSGSGHAPCHESSSSLDAEDEDDDDNSSASTEGHGPIKKRRKTVRKLEDFLKDLMAKVMEKQEQMHEQLLEIIENKERERIKREEAWKNEEMERIRKDEEARAQVNSRNLALISFIQNLLGHEIQIPQQPVEPCSKREEDEVEVSARKDLNNDPSDNNRWPDVEVQALITVRTSLEHKFRFMGSKGSIWEEISEAMNGMGYNRSSKKCKEKWENINKYYKRTIGSGKKRRQNSKTCPYFDELDILYRNGLLSIGNALSNTSDVPQIEVKELTET

SEQ ID NO: 115249 - protein, 235 aa, Glycine max
  Coding DNA Sequence Number=SeqID_23564
  Gene Ontology: Mol. function=nucleic acid binding; Cellular component= spliceosome; Biological process=nuclear mRNA splicing, via spliceosome
  Homolog annotation: Hit_ID=A7PUX9; Match level="QueryCoverage=54%, HitCoverage=34%, E-value=1e-64, Identity=94%"; Hit description =Chromosome chr4 scaffold_32, whole genome shotgun sequence
  Pfam annotation: Domain name=RRM_1; Domain location=27-98; Score =99.1; E_value=1.4e-26; Accession=PF00076.13; Description=RNA recognition motif. (a.k.a. RRM, RB
MTTRIAPGVGANLLGQHAAERNQDATAYVGNLDPQISEELLWELFVQAGPVVNVYVPKDRVTNQHQGYGFVEFRSEEDADYAIKVLNMIKLYGKPIRVNKASQDKKSLDVGANLFIGNLDPDVDDNLNQIQDLYMSVTKLYTKSSTTSTVELPPPISASEALIVNTLCALGLAFAFWIANTVYSIELVTHPSLTLFFIWITELPIVTLLYSRYRQNRKQCTYLRAVGRGVLGVPV

SEQ ID NO: 115250 - protein, 409 aa, Glycine max
  Coding DNA Sequence Number=SeqID_23565
  Gene Ontology: Mol. function=metal ion binding; Cellular component =integral to membrane; Biological process=ubiquitin cycle
  Homolog annotation: Hit_ID=A5APA2; Match level="QueryCoverage=81%, HitCoverage=78%, E-value=1e-47, Identity=36%"; Hit description =Putative uncharacterized protein
  Pfam annotation: Domain name=zf-C3HC4; Domain location=129-169; Score= 16.7; E_value=0.0011; Accession=PF00097.16; Description=Zinc finger, C3HC4 type (RING finger)
MELDLNQEPLEPTHASPDEFDSLLEELESAHEHVQDRIRRLEAITSRARQYQRRPLFHTPIQITNFTGQTSTPADAREEEMQSQEVEERVVESGRGCKRKGAHLIAKALGRTETDASKEGGSTGNFYDCNICLDRARDPVLACCGHLFCWQCFYQVQIVYSNARECPVCKGEVTETGIIPIYGNSSADGSRESGLKGAGMRIPPRPAAPRIESFRQQLISQGASSSVIQNIWRFHHLIGGLGARVQSQSQTPNAATDRNNGLLAQSRLQTGNDRGTGSSQTPISTLLVQGAASFSSLSSALNSAMDSAERLVEDLESYIHNHPTNGVNTNSTHDGNVAATDSTPAASTSHFSRNVDTTADIGLEIQTTDSNIQTETSPLDPSSSSSHRGSTRVSTSRQVSNDRRRRRSR

SEQ ID NO: 115251 - protein, 75 aa, Glycine max
  Coding DNA Sequence Number=SeqID_23566
  Homolog annotation: Hit_ID=Q2HTN3; Match level="QueryCoverage=94%, HitCoverage=19%, E-value=6e-08, Identity=50%"; Hit description=Zinc finger, RING-type
MAIIIVILIFAQFLMGFFSIYIRHCSDSPSTNIHNHPGSSKRSRRSSRKLDQTVIDTFSIYHPMEGRFKNLGGLL

SEQ ID NO: 115252 - protein, 1025 aa, Glycine max
  Coding DNA Sequence Number=SeqID_23567
  Gene Ontology: Mol. function=protein kinase activity; Cellular component=cytoplasmic vesicle; Biological process=protein amino acid phosphorylation
  Homolog annotation: Hit_ID=A7Q7Z7; Match level="QueryCoverage=96%, HitCoverage=96%, E-value=0.0, Identity=57%"; Hit description =Chromosome chr18 scaffold_61, whole genome shotgun sequence
  Pfam annotation: Domain name=HEAT; Domain location=555-591; Score =13.9; E_value=0.22; Accession=PF02985.13; Description=HEAT repeat
  Pfam annotation: Domain name=HEAT; Domain location=594-631; Score =3.2; E_value=9; Accession=PF02985.13; Description=HEAT repeat
  Pfam annotation: Domain name=HEAT; Domain location=673-707; Score =0.6; E_value=22; Accession=PF02985.13; Description=HEAT repeat
  Pfam annotation: Domain name=Pkinase; Domain location=39-384; Score= -6.9; E_value=3.3e-08; Accession=PF00069.16; Description=Protein kinase domain
  Pfam annotation: Domain name=Pkinase_Tyr; Domain location=39-384; Score=-168.6; E_value=0.043; Accession=PF07714.8; Description =Protein tyrosine kinase
  Pfam module annotation: Pfam domain module=HEAT::HEAT::HEAT::Pkinase:: Pkinase_Tyr; Domain location=555-591::594-631::673-707::39-384::39-384
MSLNMKTLTQALAKTAAVIEKTVQTTVQEVTGPKALQDYELLDQIGSAGPGLAWRLYSGRARDPSRQHQYPVVCVWVLDKRSLSEARMRAGLTKAAEDSFLDLIRTDAAKLVRLRHPGVVHVVQALDESKNAMAMVTEPLFASAANTLGIVDNIPNLPKDLRGMVADERAFALQEMGILEVKHGLLQIAESLDFLHNHAHLLHRAISPENILITLSGAWKLAGFGFAVSATQTSGDSSNLQPFHYATQISASSNLIYFCQQKSLHFVIIPVRLFFLEYDVEDSILPLQPSLNYTAPELARSTASSAGCSSDIFSFGCLAYHLIARKPLFDCHNNVKMYMNTLTYLSSGAFSSIPSELVPDLQRMLSPNESSRPSAMDFTGSPFFRHDTRLRALRFLDHMLERDNMQKSEFLKALSDMWKDFDSRVLRYKVLPPLCAELRNVVIQPMILPMVLTIAESQWSSSWLLLNAYSGTLCCCGWVVTKRSSNKKNGSRLCLEELMYSLFGLISYDISTCDKNDFEQSTLPALVPVFSSAAGETLLLLVKHAEFIINKTSQEHLVSHVLPMIVRAYDDTDARLQEEVLKKSVSLAKQLDAQLVKQVVLPRVHGLALKTTVAAVRVNALLCLGDMVSRLDKHAVLDILQTIQRCTAVDRSPPTLMCTLGVANSIFKQYGVEFVAEHLLPLLMPLLTAPQLNVQQFAKYMLFVKDMLHKIEEKRGVAVTDSGTPEIKLAPMVNGHQSEAMRTSSSSIPASTKSSSWDDEDWGPKPKGTASSIQNSIDVTSQSMAGNPVGQVTSLQKHLSLAALSAKQTTKPCPSVDVEWPPRASSGVTLQFGDTETQTIAAGTSSPSNLESDDPFADWPPRPNGSVSGGSGISNNGTLGMPLNKVGFNSMRSTSSNMGPQTSNSWPVNSQSSAESISLNSRNPISTMGSLNSGGLGQQKSLGFVKQGQAFPASIVSYNNVQSTATDLGSIFSSNRNEQIAPKLAPPPSTTVGRGRGRGRGAASTTGSSHTKSHAEQPPLLDLLG

SEQ ID NO: 115253 - protein, 528 aa, Glycine max
  Coding DNA Sequence Number=SeqID_23568
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7QRD6; Match level="QueryCoverage=95%, HitCoverage=92%, E-value=0.0, Identity=61%"; Hit description =Chromosome chr13 scaffold_149, whole genome shotgun sequence
  Pfam annotation: Domain name=Glyco_hydro_1; Domain location=24-526; Score=658.6; E_value=5e-195; Accession=PF00232.9; Description =Glycosyl hydrolase family 1
  Subcellular localization annotation: CTP_CleavageSite=20; ConfidenceScore=5.08e-01
MWVKVVLLLLAALSLFHLAAASLNRSSFSADFFFGTASSAYQYEGAAREGGKGPSIWDTFTHSHPDRIADHSNGDVAIDSYHRYKEDVAMMKDIGFNAYRFSISWPRILPRGNLQGGVNQEGITYYNNLINELIANGQQPFITLFHSDFPQALEDEYGGFLSPKIEQDFANYAEVCFREFGDRVKHWITLNEPVLYSNGGYGSGGSPPNRCSKWFANCTAGDSTTEPYLVTHHLILAHAAAVKVYREKFQASQKGQIGVTLNSAWVVPLSQSKEDREAAYRGLAFMYDWFMEPLYSGTYPAVMVNRVGGRLPKFTKREYLMVKGSYDFIGLNYYTSTYATSSPCPRERPTAFTDACVRFTSKSFYVKLLHTFLLTSIEFSSFTCLPTIHFVALASAVRNGLLIGPKAASDWLYVYPPGIQGLLEYTKEKFNNPIIYITENGIDEVNDGKMLLNDRTRIDYISHHLLYLQRAIRNGVRVKGYFAWSLLDNFEWNAGYSLRFGLVYVDYKNGLKRYRKRSALWFKIFLHQ

SEQ ID NO: 115254 - protein, 204 aa, Glycine max
  Coding DNA Sequence Number=SeqID_23569
  Gene Ontology: Mol. function=pyridoxal phosphate binding; Cellular component=cellular_component; Biological process=Mo-molybdopterin cofactor biosynthetic process
  Homolog annotation: Hit_ID=A7PWN4; Match level="QueryCoverage=85%, HitCoverage=22%, E-value=8e-50, Identity=58%"; Hit description =Chromosome chr19 scaffold_35, whole genome shotgun sequence
  Pfam annotation: Domain name=MOSC; Domain location=94-200; Score =17.0; E_value=1.2e-05; Accession=PF03473.8; Description=MOSC domain
MKLLWIQVPEMGFISTFIDLSQGMLFVESPRCEERLQIRLESDVYGVIEEIELYGQRYEVYSYDNETNSWFSEAIGKTCSLLRYSSFDQDFMLNKIKGAATCRDPKNKLNFANEAQFLLVSEESVSDLNRRLSSDVQKGIYGKVMQVSASRFRPNLVVSGGRPYAEDGWRYIRIGNKYFSVSANNLLNDSIEQVSSYCAIGHSR

SEQ ID NO: 115255 - protein, 169 aa, Glycine max
  Coding DNA Sequence Number=SeqID_23570
  Gene Ontology: Mol. function=Mo-molybdopterin cofactor sulfurase activity; Cellular component=cellular_component; Biological process =molybdenum incorporation into molybdenum-molybdopterin complex
  Homolog annotation: Hit_ID=A7PWN4; Match level="QueryCoverage=72%, HitCoverage=15%, E-value=7e-56, Identity=81%"; Hit description =Chromosome chr19 scaffold_35, whole genome shotgun sequence
MLLAMRHGNGSSVCILYGHHNSMKLCHEMGPIISFNLKRPDGSWYGYREVEKLASLSGIQLRTGCFCNPGACAKYLGLSHLDLISNTEAGHVCWDDLDIINGKPVGAVRISFGYMSTYEDVKEVCLTDIKDFMLLFIFLLCEGKAWCNGKLLPCGLEVMGSNPGNNLCL

SEQ ID NO: 115256 - protein, 133 aa, Glycine max
  Coding DNA Sequence Number=SeqID_23571
  Subcellular localization annotation: CTP_CleavageSite=40; ConfidenceScore=5.32e-01
MTLRSLFEEPRNPGLRDLRPQLFSSPYLSSFYLSSPSNTSSSSPSGSFCFELRAFLIYVVEPASGPAPDHAKSAGCGPPTAEPSPPEPFIFEADLEPSPQPEPEPSAPVPDLPISQDPPSAPALDLNDAAQDD

SEQ ID NO: 115257 - protein, 45 aa, Glycine max
  Coding DNA Sequence Number=SeqID_23572
MNVIFKKKFQNLCGMEEEKDDWRRHFKEKMSLEEAHNHKKPWIRA

SEQ ID NO: 115258 - protein, 186 aa, Glycine max
  Coding DNA Sequence Number=SeqID_23573
METVGGEGSGFHVLKLCNSCLASGNRLPRLCNRLPEMKSLEIVMAAQVIHDRVEMECLEGAWETLEGNARCRFRGTIRFMATSLVHPEELARTLQRTVEWILPTPTPYRLVEPVQVIEVTSSEEDPEEDQEELPPEPAVDALDFLEGDEDPLLEVDSPEVVMSVSEADSTEESGPGEMATSGGYSS

SEQ ID NO: 115259 - protein, 78 aa, Glycine max
  Coding DNA Sequence Number=SeqID_23574
MLSSPERVQMTTLASACQSDLGSPNDEVRITLRSLCMLPDSRVMIAKGGVVDKSGAFAPTYPQFVMRNSDLRSSCKAV

SEQ ID NO: 115260 - protein, 166 aa, Glycine max
  Coding DNA Sequence Number=SeqID_23575
MGLGKDCLGNADVVDIKGNPYKYGLGYEPGMPGRRNVPSRFRADRIWPGRISQCFTSAGMVSGEEVAAIEEEFPQDPPSFVQPCHPDSQVGNWRVISQSEVYTADSICEGRFFEEPNNEGLTIDFDRDISQTINKEEEEDVLSPELERLVAQEEREMKPHTRRNRI

SEQ ID NO: 115261 - protein, 87 aa, Glycine max
  Coding DNA Sequence Number=SeqID_23576
  Subcellular localization annotation: CTP_CleavageSite=36; ConfidenceScore=5.63e-01
MPISPCKSISWSVSSRHGDRAHKTPSGPGRVQQGPRVSSSGYGPLSVLQGARTPPPPPTRSHHHRDCACKTPSGPEEVQQGLGVVKL

SEQ ID NO: 115262 - protein, 181 aa, Glycine max
  Coding DNA Sequence Number=SeqID_23577
  Homolog annotation: Hit_ID=A5BEV8; Match level="QueryCoverage=93%, HitCoverage=23%, E-value=1e-13, Identity=29%"; Hit description =Putative uncharacterized protein
DALNQIASEVDRLRYLDNNPSSCGCVMRSMHGLPCAYQGLCEAEVSIKKEIETISKRFDKLDVSGKYVDAFHSVQSNNSPVKRSASCSEPPQPTRIIPMLDQFAPFIQGFIRDVVDVKADGNCEYRSIAALLGMGEDSWPLVRNELIKELGRWLHEYMNLFCGTERFEQLNLSLLVDGFSK

SEQ ID NO: 115263 - protein, 71 aa, Glycine max
  Coding DNA Sequence Number=SeqID_23578
MSKNKVLKEHKGTFLSWFKETIFAYDNASETLRNEASILVSRQATAKKSHISLREYSPPAIYNKQVVLHGR

SEQ ID NO: 115264 - protein, 128 aa, Glycine max
  Coding DNA Sequence Number=SeqID_23579
MAAKVLYEEKFKVGHLHTFGRSPGYGKRSNYPRALLNKSTRALAKDMSRPGNGTFAGALWDSNSEPQVCEGREGPDREHTQHWSQEEAYCLLPMSLKRSAPQHLTSHGDPQDMLEGMSSSISPVPRRV

SEQ ID NO: 115265 - protein, 347 aa, Glycine max
  Coding DNA Sequence Number=SeqID_23580
  Subcellular localization annotation: CTP_CleavageSite=41; ConfidenceScore=5.57e-01
MAEPSKKRKGSSSTAAAAAHRRHGPSGAPTAPIPPSLSSPRSSTLFSSDDQRLRYLSQFSSRIILDPKYLDVEFFNDETFDCYQVFQNSGLVDFMSLKLPYYPELVKVFYCNLKIQDGIIMSEVHGTSMVIDQSLFFSLTHLPSQGAPFEGTIVDDWKFDYSSHDARRMVCNDQAEMTGRLLAGFDSMWAFLTGRQIDWAHLVRYRMHKALRAKAPLPYPHLITLFLRHFQIPLDDEPFVQIKRSFAIGAGAVTFFGYRKDRNGQWLKKDALPPQDERTPSPPPQREDSALMNEVLSELRGLRSYVGDRFDSLDTRFSGMDIRLTQLEEDVGYIRQSFDLPPPPPSS

SEQ ID NO: 115266 - protein, 131 aa, Glycine max
  Coding DNA Sequence Number=SeqID_23581
  Homolog annotation: Hit_ID=A5ATL8; Match level="QueryCoverage=65%, HitCoverage=68%, E-value=2e-20, Identity=65%"; Hit description =Putative uncharacterized protein
RRKLGGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 115267 - protein, 65 aa, Glycine max
  Coding DNA Sequence Number=SeqID_23582
MENWQTALEKIRGAPDSWVEDASLGNKFMGLRKKMENRELANSARQQIRGACRLVGGGCMNCARQ

SEQ ID NO: 115268 - protein, 78 aa, Glycine max
  Coding DNA Sequence Number=SeqID_23583
MLAKPADWLSEKVWSVLSYSNLAPTSHTSDLTVDRDRLIFGLVSQMNMNVGALISGQITSMAQSNSSRLGFPALITAL

SEQ ID NO: 115269 - protein, 143 aa, Glycine max
  Coding DNA Sequence Number=SeqID_23584
MATAEALDEKQEARKEDTCQQSFEGLYRAAILTETEGNMWAVIDKCKEKLNLAPTHEQRLEDEYAKISAEREARKRVIDSLHQEATMRMDRFALTLNRSQELPRLLAKAKAMADTYSAPKKIHRLLSYCQHTIDLMDHMIRNR

SEQ ID NO: 115270 - protein, 246 aa, Glycine max
  Coding DNA Sequence Number=SeqID_23585
  Homolog annotation: Hit_ID=Q5PJ30; Match level="QueryCoverage=70%, HitCoverage=37%, E-value=7e-73, Identity=72%"; Hit description =Putative exported protein
  Pfam annotation: Domain name=DUF1996; Domain location=84-246; Score =83.0; E_value=9.8e-22; Accession=PF09362.1; Description=Domain of unknown function (DUF1996)
  Subcellular localization annotation: CTP_CleavageSite=41; ConfidenceScore=5.10e-01
MDQHVTAVFLPPDQRMRRTARNVFLSQYCLPPACTVLSLMEIMMKRTTLTTALSAPALLLAMHAAHAAPQAHVVCGYSHTLGDDAIMMFGRPNEAMLHDFFGNTHTDASSTRETLRKLEETTCDNKADSSAYWAPSLRLPDGTIVKPAYQKTYYQASNVETWPLQPFPAGLSLLAGDHHGSAPNPHITFLCANGKGYTTKTGEVCGLRKAGDAVQFNIGIQFPNCWDGVNLKPAHGVANATYDTKG

SEQ ID NO: 115271 - protein, 72 aa, Glycine max
  Coding DNA Sequence Number=SeqID_23586
  Subcellular localization annotation: CTP_CleavageSite=62; ConfidenceScore=5.25e-01
MFAYSTFKVEPHMGNPSPCVQESSTTRDPRSLALFRNKKKRPAALLKRCCTIRLFNQRFLIEYASGGDQGIF

SEQ ID NO: 115272 - protein, 145 aa, Glycine max
  Coding DNA Sequence Number=SeqID_23587
  Subcellular localization annotation: CTP_CleavageSite=47; ConfidenceScore=5.50e-01
VPINVSFSPKVAQGFPVSTGTPGFIFLRSDLPSQVLQWLLFLSAVSSCSATDGVVRNGKKHRRTSALASVAVTLRVTTTPAALNAPLQGASHSPFRLRNCWEGRSVRASSLLRQLAKGGCAARRLSWVTPVFSQSRRCKTTASEL

SEQ ID NO: 115273 - protein, 124 aa, Glycine max
  Coding DNA Sequence Number=SeqID_23588
MTDPLNESISCFLIRVDPWAVVPSPSKDYTSLPSEGCMPSPSKDYSSSPSEDYPSSSSEGYAPSPLEDYTSSPSEDYPPSPSEDYTSSPLEGYMPSPSKNYMSSPSEGYIPSPLEGCTPSLSDD

SEQ ID NO: 115274 - protein, 158 aa, Glycine max
  Coding DNA Sequence Number=SeqID_23589
  Gene Ontology: Mol. function=helicase activity; Cellular component =chromatin; Biological process=protein amino acid phosphorylation
  Homolog annotation: Hit_ID=Q9LTU4; Match level="QueryCoverage=99%, HitCoverage=10%, E-value=3e-42, Identity=54%"; Hit description =Helicase-like protein
MNNLDHKSLTFFSQMTDQQAQIYNRIIQVVNQNKGGMFFLYGYGGTGKTFIWKTLAASLRADNKIVVMVASSGIASLLLPGGRTTHSKLKIPVSIFEDSTCNIHQRTQLAELLNEASLIVWDEAPMAHKFCFEALDQSLRDVIKAKSSSDKIFGGKVM

SEQ ID NO: 115275 - protein, 173 aa, Glycine max
  Coding DNA Sequence Number=SeqID_23590
  Gene Ontology: Biological process=transposition, DNA-mediated
  Homolog annotation: Hit_ID=Q1J7G7; Match level="QueryCoverage=19%, HitCoverage=47%, E-value=2e-11, Identity=96%"; Hit description =Transposase
MCRNCRIVVVSLQSDENVSVCSWKRCNKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 115276 - protein, 106 aa, Glycine max
  Coding DNA Sequence Number=SeqID_23591
SHDSCKSLSEELSDYCRGRHCSHTKHHSQRREKDRRPQEVNISLPYFHGKDNVEAYLDWDMKVEQLFACHHISEERKVPLAKAFKGMSSIGGLPLLGNKGSCGILQ

SEQ ID NO: 115277 - protein, 159 aa, Glycine max
  Coding DNA Sequence Number=SeqID_23592
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=41%, E-value=5e-18, Identity=100%"; Hit description=LacZ protein
MQAGTTGFPTGKRAGTKAGTGPPLEVDGIDKLDNKTHCGAADVVHFRQRTLRWKWGRDMTPRHIINDLSGRHRGGAPIRPIVSRITIHWPSFYNVVTGENPGVTQLNRLAAHPPFASWRNSEEARTDRPSQQLRSLNGEWDAPCSGALSAAGGGGYAQR

SEQ ID NO: 115278 - protein, 67 aa, Glycine max
  Coding DNA Sequence Number=SeqID_23593
MRLPGKESLLMKSPPTINEILDVSISFLNDHLEETLGSKKIEEIYSKCINLAQCGAKEVASARDFGW

SEQ ID NO: 115279 - protein, 50 aa, Glycine max
  Coding DNA Sequence Number=SeqID_23594
MDRLKWYGLGSSSSMDSFASWKMNGSRMEKEERKEMPLQGEDESRRSSPP

SEQ ID NO: 115280 - protein, 78 aa, Glycine max
  Coding DNA Sequence Number=SeqID_23595
MAGAGDGGGDYHQLDGSQCLLLDAMTTQMQQLLNRNNEELYRRIEGLEHQMNPNAGRPYGRNKRVNNGPNRIERARQN

SEQ ID NO: 115281 - protein, 101 aa, Glycine max
  Coding DNA Sequence Number=SeqID_23596
MILRGSSICTAAAADDDDNIHFTAARAWRQGEQKADVTKAGVAAHDVQHYVKESDWAAQCTRQDKMSNEELKLQDPRCRIQCPGHPARKYWTHKSVISLTD

SEQ ID NO: 115282 - protein, 198 aa, Glycine max
  Coding DNA Sequence Number=SeqID_23597
LDWLPSVRTAKREEVEAPEEDEEENAELRDINIATTKALEQETKRACREEHGRNKFRGALWGSNNELKLRREERDQSRVDSLILKDELKACSRSKRSLSQRLCETETNMLAIITKYQEELNLAATHEHRVADEYTQVYTEKEARGRVIKSLHQEATMWMDQFALTLNGSQKLPRLLAKAKVMVDTYSAPKEIHRLLSY

SEQ ID NO: 115283 - protein, 69 aa, Glycine max
  Coding DNA Sequence Number=SeqID_23598
MEGDSIIHTVAYADDVVRHPQRIPHNEDAHVPKPANVNADDPLRELMKYSFDLYDKPLQSALMGGFLGL

SEQ ID NO: 115284 - protein, 208 aa, Glycine max
  Coding DNA Sequence Number=SeqID_23599
  Homolog annotation: Hit_ID=Q6UUU1; Match level="QueryCoverage=34%, HitCoverage=46%, E-value=9e-19, Identity=71%"; Hit description =Putative uncharacterized protein
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMKVGIGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 115285 - protein, 94 aa, Glycine max
  Coding DNA Sequence Number=SeqID_23600
MLAIINKYKEELNLATTHEHKVADEYARVYAKKEARGRRSTPGHISNPHPGYNRGAYPYSLPPNYTPPAIHEDMGHVPPLILEGEPLWHPDGVH

SEQ ID NO: 115286 - protein, 45 aa, Glycine max
  Coding DNA Sequence Number=SeqID_23601
MENCTRQSNYAWLQLMGGGCMNEIKFMGLQENSGEHLLGYSWNWE

SEQ ID NO: 115287 - protein, 104 aa, Glycine max
  Coding DNA Sequence Number=SeqID_23602
MGIAPTETPSGPEEVQQGPGGSHPQRHPVDLKKSNRALGFPALVTGLCRPYRAPVPPTKFMSSWHRDCAHKTPSGPEEGQQGLGVASSKYGSLSVLGSACRPQQ

SEQ ID NO: 115288 - protein, 96 aa, Glycine max
  Coding DNA Sequence Number=SeqID_23603
MNKFFRYTLLNQIRKRSSKNIAQFLDSFPSCVDYLRKKGAKVAARQKIATLTIIIAKADLLMEIRIAKIEVTTTQTEFVAKNADFVAFAKKLQILH

SEQ ID NO: 115289 - protein, 50 aa, Glycine max
  Coding DNA Sequence Number=SeqID_23604
MVWRLLSTLLLLYSAAIKIQEVKDSIDEEDPRPTSSTYGATSCGIKNIFI

SEQ ID NO: 115290 - protein, 99 aa, Glycine max
  Coding DNA Sequence Number=SeqID_23605
MGAKYLEVVKRGLHPNNRWSPDEIRKTLKKFIIWEINSDKGYTQGGFFGFQQGPYNQQGQWRSHPGNQFNKYHGGPSNRPIQQGPNIFQRTTKLNETLT

SEQ ID NO: 115291 - protein, 92 aa, Glycine max
  Coding DNA Sequence Number=SeqID_23606
  Gene Ontology: Biological process=transposition, DNA-mediated
  Homolog annotation: Hit_ID=Q1J7G7; Match level="QueryCoverage=32%, HitCoverage=42%, E-value=2e-10, Identity=100%"; Hit description =Transposase
DLPSQWLLFLSAVPPVQLLTGWCVTAKAPPDISAGKCSGHAARNHHTPPRLMRRYRARPIRHSGCATVGKGDRCGPLRYYASWRKGDVLQGD

SEQ ID NO: 115292 - protein, 171 aa, Glycine max
  Coding DNA Sequence Number=SeqID_23607
MTLLLSNILPSDRIANLPLQKYQLVCVVPTWGSHPQRHPVDPKKSNRALGFPALGSRLQTPSGPEEVQQGLGVASSKYGSLSVLGSACRPQQGHQVPPTNRAFIKKFCVSRQAQGETPQQPGDGRQRATDAPPSPLEFTSAHPQKGLSIAYTTWPTNRRPSPKPKDAPSCS

SEQ ID NO: 115293 - protein, 56 aa, Glycine max
  Coding DNA Sequence Number=SeqID_23608
MSPYLRLSLTSAQIMGVRSKGCDHPLIVTKFFFLIPLIFLVSCLVHTVKGFEATQI

SEQ ID NO: 115294 - protein, 158 aa, Glycine max
  Coding DNA Sequence Number=SeqID_23609
DGEGDTHLGPLLHLKDPSPHELPQPNIVRHIPASPTPVKESVPFAEDKGKIEALEERLRAVEGLGNYPFSDLADLYLVPNIVIPPKFKVPDFDQYKGRHVRKGIFGCIVERWGAYSADEKLLVHFLSKTGLAGSGCGMVYQSGSFPDPIMERLGDFLH

SEQ ID NO: 115295 - protein, 205 aa, Glycine max
  Coding DNA Sequence Number=SeqID_23610
  Homolog annotation: Hit_ID=A5B5G7; Match level="QueryCoverage=46%, HitCoverage=6%, E-value=2e-10, Identity=43%"; Hit description =Putative uncharacterized protein
MAKLTTKNQQHYLKPEIINGKEFLIFGVFSILGSIHLSGRENFWCEDPKGQQRLKTKLSCKVLDESLSDCEVSREKLPSYGELNPQLVLPTRWRKNAMVLQTPGEKEFEYVTECLVNEDGGRMLAYIKKLGDPNDESIGHVMFEELENNRHKEKPKVELKTLPAHLKYVFLEDNETKPIIINISLQKKEEDQLVQILKSHKATIG

SEQ ID NO: 115296 - protein, 87 aa, Glycine max
  Coding DNA Sequence Number=SeqID_23611
MMTKVMNKKLKRSKNNSSESKNISSESRTSQEFKNQEEFKTQEESLQSRIKIQDSRFNISRSQESRSRFKTQDSTMKKKLNQDKYYQ

SEQ ID NO: 115297 - protein, 94 aa, Glycine max
  Coding DNA Sequence Number=SeqID_23612
  Homolog annotation: Hit_ID=Q2HW78; Match level="QueryCoverage=67%, HitCoverage=11%, E-value=6e-07, Identity=42%"; Hit description=RNA -directed DNA polymerase
MYKERDVVITVIACVVWHPRGRDQNRDVLDRITAVLETLVQERDVEPAEYRGLMAFRKNYPPKFSGDYDPEGARLWLAQTEKIFEAMGCREEHK

SEQ ID NO: 115298 - protein, 91 aa, Glycine max
  Coding DNA Sequence Number=SeqID_23613
MSGFTRDSPQISASPHQLDLAPYASEPYNAQWNAPGLLRDKHTLRSSCILGEMEVDEPWLGLWPPLNYQVDMGASQHRTLELGWCLALVVS

SEQ ID NO: 115299 - protein, 283 aa, Glycine max
  Coding DNA Sequence Number=SeqID_23614
VAKDQLTIKDKRDGEEKLEKQKKKKDSKALSSKSKGKEKDSSKKIVNKENHFVTKCDIKIALFLKQSFYLLLSRETSLSTAIPLELEVIPQVKELLDEGLVPKSLNPCTLLVPKIGIIRHQIPMIGGMMNVSCGATLFCKITHAPTTFMICVHRDSLGRNNQHENKEKGMFYSNTFLNFLNTDQGLPMDPKRIKVIPEWPTPTSPLIELVRNYVPSWEDAQERGFQSLPYSNISNITNTYGEGMMQSYPLRALVRRLQEDWARDAREGPKVLMSLRIDFGPMS

SEQ ID NO: 115300 - protein, 118 aa, Glycine max
  Coding DNA Sequence Number=SeqID_23615
  Gene Ontology: Mol. function=aspartic-type endopeptidase activity; Biological process=DNA integration
  Homolog annotation: Hit_ID=A5AG02; Match level="QueryCoverage=99%, HitCoverage=22%, E-value=2e-14, Identity=37%"; Hit description =Putative uncharacterized protein
MIIEESIHVSFDESNAILPRKDILDEISESLEDMHIHVEEHKGKGDGNNEDPQIDEIKTNDDLPREWRASRYHPLDNIIGDISKGEELKQCERNNVWELVEKPENYPVIGTKWVFKNS

SEQ ID NO: 115301 - protein, 44 aa, Glycine max
  Coding DNA Sequence Number=SeqID_23616
MASVPYTLRHIESSVHGLKDDFVGCLCLTVGLGMFNRGYEVLYA

SEQ ID NO: 115302 - protein, 98 aa, Glycine max
  Coding DNA Sequence Number=SeqID_23617
  Gene Ontology: Biological process=transposition, DNA-mediated
  Homolog annotation: Hit_ID=Q1J7G7; Match level="QueryCoverage=30%, HitCoverage=42%, E-value=2e-10, Identity=100%"; Hit description =Transposase
LAQELPGINRDTRIYFILRSDLPSQWLLFLSAVPPVQLLTGWCVTAKAPPDISAGKAAQLLGRAIGAGLFAITPAGERGMCCKAIKLGNARVFPVTTL

SEQ ID NO: 115303 - protein, 78 aa, Glycine max
  Coding DNA Sequence Number=SeqID_23618
MELQRLNQHEVNDKRKKGIALKASSSIQEESDNEDLEEDEDLSLFVKRFNKFLKMRGNQRCQNFKPKRRTEESSQTLR

SEQ ID NO: 115304 - protein, 151 aa, Glycine max
  Coding DNA Sequence Number=SeqID_23619
  Subcellular localization annotation: CTP_CleavageSite=46; ConfidenceScore=5.54e-01
MTVPISAPSLFATNSAAGCGGTTQCTAISAVHRGMVSFSSEVLVFLAMENASGISSTTPTSTNSVIPQIRPTSTIITSADNQRQRCSARPMRSAAPETSIIFPRMVPRPITAARKPSVPPIPLSMALTISSGPMPIIAPTKKLASRSARNG

SEQ ID NO: 115305 - protein, 80 aa, Glycine max
  Coding DNA Sequence Number=SeqID_23620
MFSCMQRRSTAGDLIPIDLEINATCRRRNQERIRKFLQDLEVAAIPEKEPQSSEASSSFPIAEHSHLDLSKTTSWLKGIL

SEQ ID NO: 115306 - protein, 243 aa, Glycine max
  Coding DNA Sequence Number=SeqID_23621
  Homolog annotation: Hit_ID=Q6WAY6; Match level="QueryCoverage=76%, HitCoverage=37%, E-value=6e-22, Identity=31%"; Hit description =Putative uncharacterized protein
LPNGVDYEELRKYKDALLGGRKPYLFSGFLPSLNKIAAVVGDSAKEMDRMKQTWNGVVGLPRKYLEGKARDMANQEKWGPFADILALLIFGVVLFPNVDGLVDLAAIDAFLAYHHSKESPVVAILADLFDTFDRRKSRLGPTFGWIGGNAINWFPHWKEGKEGVLFSCGDYPNVPLIGTRGCINYNPALAIRQLGYPMRGTPTEESLSPFLVRDLGAQSLKVIQRVHKAWRSPLRKDKELRGI

SEQ ID NO: 115307 - protein, 280 aa, Glycine max
  Coding DNA Sequence Number=SeqID_23622
  Gene Ontology: Biological process=transposition, DNA-mediated
  Homolog annotation: Hit_ID=Q6UUU1; Match level="QueryCoverage=25%, HitCoverage=46%, E-value=2e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 115308 - protein, 53 aa, Glycine max
  Coding DNA Sequence Number=SeqID_23623
NSGAFDQDVLASPVWALARIGTFMRWKEFDCWDGVGSYSKHSTMNKNLRVDRQ

SEQ ID NO: 115309 - protein, 43 aa, Glycine max
  Coding DNA Sequence Number=SeqID_23624
MDSGRFQVSIPGTTAPVVLGASSPLVLIEFWHLELRRNDHVKY

SEQ ID NO: 115310 - protein, 90 aa, Glycine max
  Coding DNA Sequence Number=SeqID_23625
MPISPCRCIGIAPISHPVGPKKSNRALGFPALESHPQRHPVDPEKSNRALGFPALVTGLCSPTGCPFPPARSRHHRDRACKTPSGLEEVQ

SEQ ID NO: 115311 - protein, 57 aa, Glycine max
  Coding DNA Sequence Number=SeqID_23626
MGVQIAPRPTSTFFIVLRSSTESLDKKELRRSDFLIAIEEYVGAKGNTLVDHKKRKI

SEQ ID NO: 115312 - protein, 66 aa, Glycine max
  Coding DNA Sequence Number=SeqID_23627
  Subcellular localization annotation: CTP_CleavageSite=38; ConfidenceScore=5.13e-01
MPCKHVLNVSSARLASHLSLLALSASGSLSQRSLTHVKCENGVKQAFKDRKPFLKPEVKEKRELGG

SEQ ID NO: 115313 - protein, 98 aa, Glycine max
  Coding DNA Sequence Number=SeqID_23628
  Homolog annotation: Hit_ID=A5BT64; Match level="QueryCoverage=86%, HitCoverage=20%, E-value=2e-09, Identity=41%"; Hit description =Putative uncharacterized protein
MLKGSERISMGRNVSALIGKSVPQILEKCKDSGPLQSTDVVIHLANRSVAYPVGFIEDVLVRVGELIFPVDFYILNMEDGFSQGSVPIILGQTLYENY

SEQ ID NO: 115314 - protein, 154 aa, Glycine max
  Coding DNA Sequence Number=SeqID_23629
MLLRGVYADLPRAPASWLVEIWVHGRLRRDKMVDEPRSRPITCEPVSSGPIDDPLRARTLPTRPQKRPQWRTGPKSPGRGAPERVRAPSCPDPVAPRGRCRASRVVWECSPNRAGSGWGPAMCPGRMWNGESRSADRLGTLTDADCDGGPSPGC

SEQ ID NO: 115315 - protein, 127 aa, Glycine max
  Coding DNA Sequence Number=SeqID_23630
  Homolog annotation: Hit_ID=UPI0000498F17; Match level="QueryCoverage =38%, HitCoverage=56%, E-value=3e-19, Identity=95%"; Hit description =beta-galactosidase
MQLARQVSRLESGHGRHRGGAPIRPIVSRIKIHWPSFYNVVTGKTLALPNLIALQHIPLSPAGRNSEEARTDRPSQQLRSLNGEWDAPCSGALSAAGVVVTRSVTATLASADVRPWLFAVTHHPVRS

SEQ ID NO: 115316 - protein, 122 aa, Glycine max
  Coding DNA Sequence Number=SeqID_23631
VPPVQLLTGWCVTAKAPPDISAGKCSGHAARRVPFAIQAAQLLGRAIGAGLFAITPAGERGMCCKAIKLGNARVFPVTTLNSMAKIQDPKERKLILIFTNKGGPNLGPWAQKSILRFMRTLG

SEQ ID NO: 115317 - protein, 127 aa, Glycine max
  Coding DNA Sequence Number=SeqID_23632
  Gene Ontology: Biological process=transposition, DNA-mediated
  Homolog annotation: Hit_ID=Q1J7G7; Match level="QueryCoverage=25%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARNHHTPPRLMRRYRARPIRHSGCATVGKGDRCGPLRYYASWRKGDVLQGD

SEQ ID NO: 115318 - protein, 58 aa, Glycine max
  Coding DNA Sequence Number=SeqID_23633
MGIQKNSQAGEGRHKRIQAGEEMKRMNSTSFQGLEKPENSWKAFGTKKEEEVQRDSRL

SEQ ID NO: 115319 - protein, 34 aa, Glycine max
  Coding DNA Sequence Number=SeqID_23634
MKILSSGVVFTLEVDKSGAFAPTYPPSKRKIRPT

SEQ ID NO: 115320 - protein, 67 aa, Glycine max
  Coding DNA Sequence Number=SeqID_23635
  Subcellular localization annotation: CTP_CleavageSite=51; ConfidenceScore=5.46e-01
MSPPPLETSQSLKTSSSWSNPASALDLASSIKRKGPVTRAMSKRLQEDWARAAEEGPRVLMNLRVDF

SEQ ID NO: 115321 - protein, 149 aa, Glycine max
  Coding DNA Sequence Number=SeqID_23636
  Homolog annotation: Hit_ID=A5B939; Match level="QueryCoverage=52%, HitCoverage=49%, E-value=1e-12, Identity=55%"; Hit description =Putative uncharacterized protein
  Subcellular localization annotation: CTP_CleavageSite=37; ConfidenceScore=5.12e-01
MESRAPSGPFLPAHPGNGSAGGRVQRLEEHRTSRGVRCAPRRPLKIRRTECLPRPVVLITASGLQGKGSRQNGSVTSGKGLALRAGHGGPSPEPVGCRVDCSSCFRGESGSSRAGRGTDWERALSGPLLRASNSQLRTGTDKGNSDWFN

SEQ ID NO: 115322 - protein, 158 aa, Glycine max
  Coding DNA Sequence Number=SeqID_23637
MTTLTQMWMTLLLSNVPPSDHNSDLLLRKCQLVYAILTRMSVHVAQFTADAIYLFVGMPPTKHPLDPDKSNRALGFPALITALCQSFGVPVTPSKVIRPPITRAFIEKCCTARQAQGDAPQAADAPPPPHQADPVGSFGMERYLQHLVRHQAANHRGQ

SEQ ID NO: 115323 - protein, 76 aa, Glycine max
  Coding DNA Sequence Number=SeqID_23638
MSKRLQEDGARAAEEGLRVLMNLRTHLLLEVVSPLSLPSPFCYHSSSKKQRSPLMKKILGLQAPMELTSEAELATY

SEQ ID NO: 115324 - protein, 44 aa, Glycine max
  Coding DNA Sequence Number=SeqID_23639
MSTQGAEGMGKEKDGKLARFKGWVVANFQGLNKVDLGIKWMNGM

SEQ ID NO: 115325 - protein, 64 aa, Glycine max
  Coding DNA Sequence Number=SeqID_23640
MVAWPEDWPEAQAGEAPAGAPDDAEEARMDKEMMDLLGFLGGSGATVNAVKVFPNTQKWTRMNA

SEQ ID NO: 115326 - protein, 52 aa, Glycine max
  Coding DNA Sequence Number=SeqID_23641
MAPNHKTMEEIHGENDEEQEIKWNGKGGMVIGDATSRRRWVKNKLTTIGGHE

SEQ ID NO: 115327 - protein, 272 aa, Glycine max
  Coding DNA Sequence Number=SeqID_23642
MEESMSPFLVRDFGAQNFKAIQRIHKAWETPLRKDQELRGIRNGIIGGYHEWLKVHVRVSKHRKRRRSPSSQNELGKAKLAKEKFKLAATHIRKECAGLREENATTARALEQETKRARKEEYGRNKFRGALWGSNNELKLRREERDQSRAHSMVLKEELVACSRSKKSLSQRLCETETNMLAIIAKYQEELGLATAHKHRVVDEYAQVYAEKEARGRVIDSLHQEATMWMDRLALTLNGSQELPRLLAKAKAMADTYSAPKKFMGFSAIVSI

SEQ ID NO: 115328 - protein, 78 aa, Glycine max
  Coding DNA Sequence Number=SeqID_23643
MAAQARQVFYVEDPCDSRWAVVLQGRTICIGHDVDGLTLDVTDMPSFSKDIPSTTVEQEEDDGHGNTTTVPATIIKPS

SEQ ID NO: 115329 - protein, 58 aa, Glycine max
  Coding DNA Sequence Number=SeqID_23644
RNEYGEATSSHVTIGYPGYTFYPGSIATDKSIKVLLNRTNQPHHLVNIIGWGYYTRKR

SEQ ID NO: 115330 - protein, 266 aa, Glycine max
  Coding DNA Sequence Number=SeqID_23645
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVFVALDHDFDPKVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115331 - protein, 134 aa, Glycine max
  Coding DNA Sequence Number=SeqID_23646
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=64%, HitCoverage=72%, E-value=3e-24, Identity=68%"; Hit description=LacZ protein
MIKSNENWITKTLVSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115332 - protein, 31 aa, Glycine max
  Coding DNA Sequence Number=SeqID_23647
VASTNKHCFKIKLLPQNKVFPRDQGSGNRLP

SEQ ID NO: 115333 - protein, 132 aa, Glycine max
  Coding DNA Sequence Number=SeqID_23648
MDNEEGVQEQMKKTIEDKATATASSTVREAEPVLQPALNPGLDRNTAVFGRRYSPQAYPYGLPPDFTPRATPKDLSQAPTFEGQLPPYDDYPGQDDGEGDTHLGPLLHLKDPSPHELPPPNIVCHIPASPTP

SEQ ID NO: 115334 - protein, 151 aa, Glycine max
  Coding DNA Sequence Number=SeqID_23649
MMTMIVDTLPVFYYGKWWAMHLQSFEDLVFASERIDVGLKKGKFSHPAWTNEKTGANEEGEKEGETHAVTVIPIRPSFPPTQQCHYSANNKPPPYPPPSYPQRPSLNQPQSLSTALPMTKTTFSTNQKYTNKKEFCSKKPVGFTPNSVVIC

SEQ ID NO: 115335 - protein, 57 aa, Glycine max
  Coding DNA Sequence Number=SeqID_23650
  Gene Ontology: Mol. function=aspartic-type endopeptidase activity; Biological process=RNA-dependent DNA replication
  Homolog annotation: Hit_ID=Q2HW89; Match level="QueryCoverage=78%, HitCoverage=4%, E-value=5e-09, Identity=61%"; Hit description =Integrase, catalytic region; Ribonuclease H
MGEDVAEELKLQHANNFQGVTLRWEANHMIEEVHEGSFGTHANGHAMARKILRAGYY

SEQ ID NO: 115336 - protein, 118 aa, Glycine max
  Coding DNA Sequence Number=SeqID_23651
MRYDFVAASLPSIFLNGLQLSLVMSPEAILPSGPVSVFVAVIDPDASCLKKCRPTTSRLPAEYAPIFRQYIEDAPRTCRTFVLIKVLVAPGAVLLTGRGAAGAVRWAGALSAAGGSFT

SEQ ID NO: 115337 - protein, 119 aa, Glycine max
  Coding DNA Sequence Number=SeqID_23652
MVEDAQQRLAFRGLNGGGCMNDNQFMGLRIRLDDRGCMNRARQSNRRVSDSMVEDAYGGGCTNSATQSIRGAPNKMVEDARKAIGNKFVGLRIRFDGEGCTNSAWKSIRGAPDSVVEDA

SEQ ID NO: 115338 - protein, 222 aa, Glycine max
  Coding DNA Sequence Number=SeqID_23653
MGDQEETQEQMKADMSALKEQMASMMEAMLSMKQLIEKNATTAAAVSSAAEADPTLLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAAPPIVLSTEGPPSATEERRKLDLLEERLRAVEGFGDYPFADMTDLCLVPMCIPRSPSAGLRQV

SEQ ID NO: 115339 - protein, 189 aa, Glycine max
  Coding DNA Sequence Number=SeqID_23654
MRSGLISGKTNTPDVLAGQWVEGIVAHTPVYMEWYRKNTTLFLSVAQQLHDPRTTITHNVAGSGVEQTHFKIPHPQSMYSTPSPVHQTFGHTGESVTATTHEWITDLFGVDFNTPNSAASYLATLQQFDAPHSFGEQGQSSSAATTNIENTNIEQQHHHDVGDPVILERRNLRRNRRPPPCGTGHCLGH

SEQ ID NO: 115340 - protein, 187 aa, Glycine max
  Coding DNA Sequence Number=SeqID_23655
  Gene Ontology: Biological process=transposition, DNA-mediated
  Homolog annotation: Hit_ID=Q1J7G7; Match level="QueryCoverage=17%, HitCoverage=47%, E-value=1e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKGCTGASAEYVIQDIFRFLAH

SEQ ID NO: 115341 - protein, 133 aa, Glycine max
  Coding DNA Sequence Number=SeqID_23656
MRPLQRRVPFAIQAAQLLGRAIGAGLFAITPAGERGMCCKAIKLGNAQGFPSHDVVKRRPVNCNTTHYRANWSSTAVAAALELVDPPGCWNLVSYCLDKRDCALSEQYELCLKVTASCRNLPFGGRATRGLAL

SEQ ID NO: 115342 - protein, 145 aa, Glycine max
  Coding DNA Sequence Number=SeqID_23657
KLLPERNVVVYYTEFDEFKEELERRHWDKELTDFRDGNIDVAIVKEFYANLYDPEDKSPKQELAAKLCIPGRGFELNADGQPLKILRKNMTTLAQTWSVLSFSNLIPTSHTSDVTLDRARLIYGIIMKMDMNVGYLISHQISLTA

SEQ ID NO: 115343 - protein, 68 aa, Glycine max
  Coding DNA Sequence Number=SeqID_23658
MTPVKPKGRNRRAHEGAARGKRLGGGAYGKTALPRPSHFPVKYLPGIFQEISAPFVSHFRSPQSNDRA

SEQ ID NO: 115344 - protein, 108 aa, Glycine max
  Coding DNA Sequence Number=SeqID_23659
  Gene Ontology: Mol. function=transporter activity; Biological process= transport
  Homolog annotation: Hit_ID=Q7CVH6; Match level="QueryCoverage=100%, HitCoverage=34%, E-value=4e-45, Identity=81%"; Hit description =Putative uncharacterized protein
MNEKIDIAYLSGGDAYFGPNFGGAEVYTLARTGWPEKCPNAAALFKNLKFDIAMENTLMGSILGGEDSKAAAAAWVKANPKALDGWLQGVTTADGKPGADAVKGKLGL

SEQ ID NO: 115345 - protein, 91 aa, Glycine max
  Coding DNA Sequence Number=SeqID_23660
GYIYLEIVTLRTREGTSLVDKFKWRVHPLGDCYTENKRGYISCGSVQVEGTSTWFFKENKGGYIPCGSWACKGFYKVERNLKNRRLFGDWM

SEQ ID NO: 115346 - protein, 335 aa, Glycine max
  Coding DNA Sequence Number=SeqID_23661
  Gene Ontology: Mol. function=hydrolase activity, hydrolyzing O -glycosyl compounds; Cellular component=cell wall; Biological process= carbohydrate metabolic process
  Homolog annotation: Hit_ID=A7Q8D6; Match level="QueryCoverage=37%, HitCoverage=53%, E-value=4e-32, Identity=58%"; Hit description =Chromosome chr5 scaffold_64, whole genome shotgun sequence
  Pfam annotation: Domain name=DUF581; Domain location=206-250; Score =7.6; E_value=0.0018; Accession=PF04570.5; Description=Protein of unknown function (DUF581)
  Pfam annotation: Domain name=Glyco_hydro_16; Domain location=1-110; Score=-60.1; E_value=0.0044; Accession=PF00722.12; Description =Glycosyl hydrolases family 16
  Pfam annotation: Domain name=MtN3_slv; Domain location=60-129; Score =68.2; E_value=2.8e-17; Accession=PF03083.7; Description=MtN3saliva family
  Pfam module annotation: Pfam domain module=DUF581::Glyco_hydro _16::MtN3_slv; Domain location=206-250::1-110::60-129
PTHDEIDFEFLRNLSGDPYILRTNVFTQGKGNREQQFYLWFDPTRNFHTYSIIWKPQHIIPTFWKIKKHGSREDFSSLPYICTLLNCSLWTYYGIIKAREYLVATVNGFGIVVETIYVILFLIYAPKGIRGRTAILAVILDVAISAEAVATSQLALQGEARGGAVGVMGAGLNIVMYFSPPSAMGKAAYNIPPPYLRIAKSLWAMGCLKGQVNSVIRERSFCFYCNKNLGHDMDIYMYSGTEVIWGQETSVRRVLLFMANAEGDFDELVDPLKVEDKIGVVPHGLSTNSDVVKRCAFFGCGKNLQMEEMKVDLDLLVGDPASLEKKIDAIRFGGP

SEQ ID NO: 115347 - protein, 43 aa, Glycine max
  Coding DNA Sequence Number=SeqID_23662
MEKIWGIPFYLGTAGQTHALTYVMSSRSTSFEPKSQLTINLDP

SEQ ID NO: 115348 - protein, 170 aa, Glycine max
  Coding DNA Sequence Number=SeqID_23663
MASMMEAMLGMRQRMENNIATAAVVSSAAEVNPTLPATAHHPLPNAVGRERSTLGHTSNPHLGYNRVAYPYGLPPNYTPPAMRDDAGHVPSPILEGEPPRQADEVHEDHREYAQGDVDFYPPVPVEGPAPNVLPQHNPTTQPIFLSTEGPPPGGGRKKETQSHRGEIKSC

SEQ ID NO: 115349 - protein, 93 aa, Glycine max
  Coding DNA Sequence Number=SeqID_23664
MWGSNNELKLRREERDQSRVDSLILKDELKSCSRSKRNLSQQLCETETNMLAIISKYQEELNLATTHEHRVADEYALVYAKKEARGRVIDSLH

SEQ ID NO: 115350 - protein, 158 aa, Glycine max
  Coding DNA Sequence Number=SeqID_23665
  Subcellular localization annotation: CTP_CleavageSite=59; ConfidenceScore=5.48e-01
MKHFTDTLISAQHSKPVYTPLAPNTQTASPRALADSLMQLARQKNPNRATGGGALESTRNATIAYRKCLSDYIEPGGSTSSRAAATAVELQFALYWRNSEEARTDRPSQQLRSLNGEWDAPCSGALSAAGVVVTRSVTATLASADVRRCFCRYAPPRQ

SEQ ID NO: 115351 - protein, 52 aa, Glycine max
  Coding DNA Sequence Number=SeqID_23666
MAQPPPCERTLREMAAPDFTYESLRIQYPDEGVPYILKTELIHLLPKFHGLA

SEQ ID NO: 115352 - protein, 240 aa, Glycine max
  Coding DNA Sequence Number=SeqID_23667
MARTKKTCQMTSEDSIEEQASQGSFVTHGRVLTVAIGRPEHPGRVCIARAGITIKQYFGPAPRTSRTSSSMALEDLEQLTQNIRDQLEETITKKVTQQLMLSFSQMESQFQSQMQSHGLILPPEPEVGPSATRVSTKKSCVDPSGNDPDTGDSEKDELYVEENPPHLVALARLYKGSTIVHNIPLHNDQVKVGVEEVREIDALILVPTQEVQLVGQTLNTFVAWPTHLVKHLSEQAFHCH

SEQ ID NO: 115353 - protein, 206 aa, Glycine max
  Coding DNA Sequence Number=SeqID_23668
  Homolog annotation: Hit_ID=Q84VH5; Match level="QueryCoverage=84%, HitCoverage=35%, E-value=5e-66, Identity=84%"; Hit description =Envelope-like protein
DLIKAAGLLKTVTKLGDCYEGLVREFIVNIPSDISNRKSDDYQRVFVRGKCVRFSPAVINKYLGRPTDGVIDIAVSEHQIAKEITAKQVQHWPKKGKLSAGKLSVKYAILHRIGAANWVPTNHTSTIATESPLSLHYKLFEGTHVPDIVSTSGKAAASGAVSKDALIAELKDTCKCWKQPSKPPQRRRWSRCDQRLQRVALMMKKQ

SEQ ID NO: 115354 - protein, 101 aa, Glycine max
  Coding DNA Sequence Number=SeqID_23669
ISELFLSTKFRALLSLSLHSSPSSSKLLSMASYGGEHDEDMTKSKGKDPLEGLGGPMTRARARKAKEALQQVLSILFEYKPKFQGEKSKVVSCIMAQMEED

SEQ ID NO: 115355 - protein, 52 aa, Glycine max
  Coding DNA Sequence Number=SeqID_23670
MDWQSPNQRSICSKLELDSLVITYIKAFKIVETDASGIGYGGCDTLYPSHIY

SEQ ID NO: 115356 - protein, 52 aa, Glycine max
  Coding DNA Sequence Number=SeqID_23671
MCLVGMAFASGDATPPSPKTARLMAEMIKLGDQMRKMSYDNEENDGENEKGE

SEQ ID NO: 115357 - protein, 83 aa, Glycine max
  Coding DNA Sequence Number=SeqID_23672
MTVTEYSTYVWGPAVRAYLYREMCSATDYKTKSIGGCPSQPLNIHGITLKGKQDENWEQLFTPMIGQWNKQVDFRVDGYPRQE

SEQ ID NO: 115358 - protein, 231 aa, Glycine max
  Coding DNA Sequence Number=SeqID_23673
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=56; ConfidenceScore=5.38e-01
MVKVGTSYVPINVSFSPKVGQGFPVLPVASVSISCPLPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115359 - protein, 183 aa, Glycine max
  Coding DNA Sequence Number=SeqID_23674
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=72%, E-value=5e-24, Identity=66%"; Hit description=LacZ protein
  Subcellular localization annotation: CTP_CleavageSite=56; ConfidenceScore=5.58e-01
MENGFAAALSLSLLSIFLASSRKSPPRSAQYANRLSPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115360 - protein, 221 aa, Glycine max
  Coding DNA Sequence Number=SeqID_23675
MVLKEELVAYSRSKRSLSQRLCETETNMLAIIAKYQEELSLATAHEHRVADEYAQVYVEKEARGRAIDSLHQEETMWMDRKNTITKRATGIPIAPDPNLERWVIKRRHRTDEADMSALKEQMASVMEAMLGMRQLMEKNAATAAAVSSAAEADPTLLATAHHPPSNIVGWGRDTMGHDGNPHLGYNRAAYPYGLPPNYSPPVLQDDAGHVASPVLEREPPQ

SEQ ID NO: 115361 - protein, 132 aa, Glycine max
  Coding DNA Sequence Number=SeqID_23676
  Pfam annotation: Domain name=G-patch; Domain location=1-42; Score =24.0; E_value=0.00024; Accession=PF01585.14; Description=G-patch domain
MVARVMLGNGYEPGMGLGKDNGGRTSLISARGNRGKFGLGYKPTQADIRKSITGRKSGGQGSRLGQEVEGSPPCHISRSFISAGLGHEGQVVAICEDDSPSGSDLVRPCPPGFRLGNWRVDERPDIYATSIM

SEQ ID NO: 115362 - protein, 91 aa, Glycine max
  Coding DNA Sequence Number=SeqID_23677
  Gene Ontology: Mol. function=tetracycline:hydrogen antiporter activity; Cellular component=integral to membrane; Biological process=response to antibiotic
  Homolog annotation: Hit_ID=Q47336; Match level="QueryCoverage=46%, HitCoverage=46%, E-value=1e-17, Identity=100%"; Hit description=LacZ- alpha peptide
MNEKNEQSTITSSGMKHPGDPLVLERPPPRWSSNSPYSESYYNSLAVVLQRRDWENPGVTQLNRLAAHPPFASWRNSEEARTDRPSHSCAA

SEQ ID NO: 115363 - protein, 117 aa, Glycine max
  Coding DNA Sequence Number=SeqID_23678
MSKALRSNAPLPYPHLISLFLHHFEVPLDSKPFVQIKKSFSIGAAMVASFGYRKERDGSWSVMDRFDNLQTYVGERFDSLESQVDIRFGEMDSRITKIEGNITFIRDCFDLPPPPST

SEQ ID NO: 115364 - protein, 105 aa, Glycine max
  Coding DNA Sequence Number=SeqID_23679
MKMKEENNFKAKNIIISTLGIDEYFRVSNLIAIAESKDLTNMSLATLFGKLQEHEMELMRLYQHEEHDKRKKGIALKASSSSIHEENDKEDSNEKNLEEDNDFSL

SEQ ID NO: 115365 - protein, 94 aa, Glycine max
  Coding DNA Sequence Number=SeqID_23680
MSGFTRDSPQISASLHQLNLAPYASEPYNAQWNAPGLLRDKHTLRSSRILGEMEVDEPWLGLWLPLNYQVGFVVDLGIAFVDNWAVGKEKEWQS

SEQ ID NO: 115366 - protein, 157 aa, Glycine max
  Coding DNA Sequence Number=SeqID_23681
GSHPQRHPVDLKKSNRALGFPALVTGLYRPYRALVPPASSCHHDIGKDCARKTPSGPEEGQQCLGVASSKYGSLSVQGSACCPQQGHQAPYQSSFHLEVLRLQAGAGRNTTAAWGWPAAGNRRTAITSRVHLSSSTKRLERCLRHMADQQATKSKAK

SEQ ID NO: 115367 - protein, 193 aa, Glycine max
  Coding DNA Sequence Number=SeqID_23682
  Homolog annotation: Hit_ID=UPI00016518E3; Match level="QueryCoverage =31%, HitCoverage=37%, E-value=8e-19, Identity=72%"; Hit description =conserved hypothetical protein
LNAGGRPNTCKSSGSTESLLSGDERRTATLELRHGPDSYGRQQWGILHNGRKPDAAMPQEAPANSVPAAAVIRRVQALIGITGRKAHAGGVAVKCVEIWRNTGVASGANALNRPPGEYGRKRTFQRWIGAFGNSETGAAWLSSARVVKCWVKSRNERNPYPLLPAVRPGTQRRLPVINWRKVGMTSSHHGPYE

SEQ ID NO: 115368 - protein, 217 aa, Glycine max
  Coding DNA Sequence Number=SeqID_23683
MVGFTLISPRDETRLPARRPPLMHREKRGTRGCINYNPVIAIRQLGYPMRGAPSKEGLIPFIIRGFNSTNSGVLQRVHKAWEMLQRKDKERRGSSNRPVDSYRRWLKAYTQDLDWLLSLRTTKGVEVETLEEDEEVQALKTEREKAQTIKEKFKSAAVRIRKENAELRGINIATVKALEQETRGPVGKNMAGTNSEGLCGVVTASLSSEERKGTNRE

SEQ ID NO: 115369 - protein, 233 aa, Glycine max
  Coding DNA Sequence Number=SeqID_23684
  Homolog annotation: Hit_ID=Q5CEG7; Match level="QueryCoverage=38%, HitCoverage=84%, E-value=6e-36, Identity=82%"; Hit description =Senescence-associated protein
  Subcellular localization annotation: CTP_CleavageSite=37; ConfidenceScore=5.57e-01
MNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGIKHWAEITLRQHPQGPSQCFVLIKTVGIPLVRTSSELTVRRPGEEAPKGPFPIRPPTGTRRPALAAEAARAVHRQPTGSGLGPPCPALRANPFPEVTDPFCRLPLPTLFHRPEAVHLGDLMRL

SEQ ID NO: 115370 - protein, 80 aa, Glycine max
  Coding DNA Sequence Number=SeqID_23685
MASRDQVWSFCTQDTRRYLTVIRTLLSSRGGGPDDKQRPSLVILHPRYAEIPYGYSHPFSCYLNDKSRSPATLVNREERN

SEQ ID NO: 115371 - protein, 35 aa, Glycine max
  Coding DNA Sequence Number=SeqID_23686
MKHSSKLKGGGHMNENAGNSWSSEKRPPPAPIALR

SEQ ID NO: 115372 - protein, 127 aa, Glycine max
  Coding DNA Sequence Number=SeqID_23687
FVVDLGMAFMDNWVVGNFMCLPHGLRDMCMISLRLLALNEHRSGVIDILIGSVRHIGWCKLGGKPYGGKAPDGGIGFTLVTALVAATATILSSSSSSWPPSLWPFALSWPPCRPSSALAPLLLHPLL

SEQ ID NO: 115373 - protein, 265 aa, Glycine max
  Coding DNA Sequence Number=SeqID_23688
MEDNAVAVAATSAVAKVNPMPPSGLNQMNHLTSARVGKDLGSTGDPHYVQLQNKHAFPPYGLPPNYTPPNVAYTPSENVNNSTPILIESQQPQSDHAHVSQPMGETHEIPHHNLADFEPCLGYATEGQAVGGIPLQNTLEGPQFRPQPQPFYGKMVDYTPSCFVDLVFASERIKVGLERGKSDHPALINMKTGENEEDENEGETLAMTAIPTRSNFPSVQQCHYSANISPSHYPPPSHPQRPSLNQPQSLPAAHPVPKHQPKRNL

SEQ ID NO: 115374 - protein, 252 aa, Glycine max
  Coding DNA Sequence Number=SeqID_23689
  Pfam annotation: Domain name=Retrotrans_gag; Domain location=80-175; Score=3.6; E_value=0.024; Accession=PF03732.8; Description =Retrotransposon gag protein
NLVPLDLEIKATLRRNRVERRRKLLQDRRVASILEEETHFSNSSSSNSPSSRESAAYLLEAISMADDHQQRVTLEDYSSSSMPQFFTSIARPEKNPRGGLHSFKGNSLKTWEEVVEKFLKKYFLESKTVEGKAAISSFHQFPDESLSEALERFRGGEIKLKTPEEEIELIKNMSASNHAILRNRVHQPTKKSLLELSSHDALLAQNKLLSRQLEILTETLGDVVATYPSAGGRRVTCGCVFQERNTCGVATN

SEQ ID NO: 115375 - protein, 16 aa, Glycine max
  Coding DNA Sequence Number=SeqID_23690
EKGSSAAEDCNMREAR

SEQ ID NO: 115376 - protein, 70 aa, Glycine max
  Coding DNA Sequence Number=SeqID_23691
MDSKLELFNMSVLNCKCKSHKYRWQDVEFWFGISMKNVMEGSLLFGGCNWRQVKWFGNCGALNVTSKDWS

SEQ ID NO: 115377 - protein, 122 aa, Glycine max
  Coding DNA Sequence Number=SeqID_23692
MSDFLFDGGYIGARAPLLSTSKIKREIKVRETQFHTILKIRLLSFETNVRGAKPSSNINTTPELRMFFLTSFLRFFRRFPQINVGGDSVHFPPWENAPVSLASLARKRACCDTEFDTQFIPL

SEQ ID NO: 115378 - protein, 138 aa, Glycine max
  Coding DNA Sequence Number=SeqID_23693
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=73%, E-value=2e-24, Identity=66%"; Hit description=LacZ protein
MHGCALGSNFCLCAESVEIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115379 - protein, 111 aa, Glycine max
  Coding DNA Sequence Number=SeqID_23694
  Subcellular localization annotation: CTP_CleavageSite=58; ConfidenceScore=5.45e-01
ATDGVVRNGKKHRRTSALASVAVTLRVTTTPAALNAPLQGASHSPFRLRNCWEGRSVRASSLLRQLAKGGCAARRLSWGELELHRGGGRSRTSGSPGLQEFDMHDFGFEYQ

SEQ ID NO: 115380 - protein, 76 aa, Glycine max
  Coding DNA Sequence Number=SeqID_23695
MGEPCSSYGHHEMALKGKIMKGKLFMIGLSESRVNKSICRRTMHQSEKIHQQEAQLKKVIANLEAEKEHMKRRSLT

SEQ ID NO: 115381 - protein, 87 aa, Glycine max
  Coding DNA Sequence Number=SeqID_23696
MLPKCFREEFHGFQFISCFACFHLHLVTFKSGEVQQGPRAPRQPEDGQQWATDALPQPLESTSAHLQGWSIAYDTWPTSRQLRPKPK

SEQ ID NO: 115382 - protein, 115 aa, Glycine max
  Coding DNA Sequence Number=SeqID_23697
MLLKHYGSSGCHFSTKWVRWLPPRRARLLRPEARKTGVAAHDVQRYVKESDRAAQCTRQDKMSNEELKLQDPRCRIQCPGHPARKCTRQDKRIEAAGSTMSDTMSRTSCPKILDT

SEQ ID NO: 115383 - protein, 59 aa, Glycine max
  Coding DNA Sequence Number=SeqID_23698
MGAKYLEVVKRKLHATKQWSPDEIRVTIRYLRMQLTRCPWMTKAQNSSMRVYHPTCCSE

SEQ ID NO: 115384 - protein, 155 aa, Glycine max
  Coding DNA Sequence Number=SeqID_23699
MGEVEEVQEQIKADMEAMKEQMATMMEAMISMEKIMEANAVAVATTSVVAEVNPMPPSGLNQMNHPTSTRTHEGQAVGGIPMPNTLKGPQFRPQPQPLHFAVGRAPPAMAEKGKLDQIEERLKDIEGGEDYAFSNLEELFLVQEHGHSQVQGAGL

SEQ ID NO: 115385 - protein, 96 aa, Glycine max
  Coding DNA Sequence Number=SeqID_23700
IQLMLLFLSGAGSYPCSVSNSLKASKLTINQPVAPIEEFNLKLSELGIEIHSVLTRRSQWSSQPSSSPQLSSKETFILKSEAKTISEINNLGEEFV

SEQ ID NO: 115386 - protein, 181 aa, Glycine max
  Coding DNA Sequence Number=SeqID_23701
MIMRGQDIYSSQDEATTSPSSSKSEEAKGEESSEEIYPQEEGQPLMVKEECKEVSVSSKRLAKKERHFEIKTNIKEISLLRQPPHFLLCKKTLVSIATSLRLEFNPQVKELLDEGLVRKRLNPCALLVPKIGVPMNPKRIKVIPEWPAPPSVRKIWGFQDLTNFYKSVEEKSPEFQNLGFE

SEQ ID NO: 115387 - protein, 109 aa, Glycine max
  Coding DNA Sequence Number=SeqID_23702
MWMDRFALTLNESQELPRLLAKAKAMADTYSAPEEIHGLLGYWKNTITKRVTRHPYRTRSKSRTMGDQEETQEQMKANMSALKEQMASMMEAMLSVRQLMEKNAATATA

SEQ ID NO: 115388 - protein, 106 aa, Glycine max
  Coding DNA Sequence Number=SeqID_23703
  Homolog annotation: Hit_ID=Q2HW87; Match level="QueryCoverage=69%, HitCoverage=8%, E-value=6e-08, Identity=35%"; Hit description=RNA -directed DNA polymerase (Reverse transcriptase); Zinc finger, CCHC -type; Peptidase ...
  Homolog annotation: Hit description=aspartic, active site; Retrotransposon gag protein
MGKVFTLNGIEASKSKDIIQVSKDEMFISANQVLTSLKEYSQVYMILPNLDVETKVSMCDLPIVIEFLEVFPKDVSSLPPAREIKFFIDLLPSVGPISIALIGCLL

SEQ ID NO: 115389 - protein, 32 aa, Glycine max
  Coding DNA Sequence Number=SeqID_23704
MPRDMNGSRMEKEEREETPVQGEDESRRSSPP

SEQ ID NO: 115390 - protein, 142 aa, Glycine max
  Coding DNA Sequence Number=SeqID_23705
GLSNMERSMIDAASGGALGDMTPTEARNLIEKMAFNSQQFSARNDAIVLRGVHENVAGPSKPYVPPPMQQQQQQSQQRQQGTEAPPQPSLEELVRQMTIQNMQFQQETRASIQSLTNQMGQMATQLNQAQSQNSDKLPSQTV

SEQ ID NO: 115391 - protein, 246 aa, Glycine max
  Coding DNA Sequence Number=SeqID_23706
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=21%, HitCoverage=50%, E-value=1e-23, Identity=100%"; Hit description=LacZ protein
MTPVNRKAGQESARGSRQGETPGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115392 - protein, 200 aa, Glycine max
  Coding DNA Sequence Number=SeqID_23707
  Pfam annotation: Domain name=Transposase_23; Domain location=80-150; Score=-5.2; E_value=0.0044; Accession=PF03017.5; Description =TNP1ENSPM transposase
  Subcellular localization annotation: CTP_CleavageSite=38; ConfidenceScore=5.89e-01
MGSPPAPTTTPPPPPPPPPPPSPPSPPPPPPTSDASASTSAVKRTRKASRLQSLSTRPPGVHHLRELEGGPYYSRNDPETGDSDRCGLYIEADPARLVAIERVYEGSTIVHNTPLLLGQVKVSVEEVRDADAPVPVPTDEVSLVGQALHTFLAWPTHLVKSLSQQVAVSPPKPPPKPDPEVDDPLYLMTLTIPELFLRPY

SEQ ID NO: 115393 - protein, 118 aa, Glycine max
  Coding DNA Sequence Number=SeqID_23708
MIKWKVGVEEVKDADAPVHALNTFLAWPTHLVKRLSEQVMWDATVFGVFNEDFPLYIKHEDLSEIAHGGQCLNISIIQLWILIWLRQVYERGIRMCMDSSSHSPSRDLGNRNLNQKVT

SEQ ID NO: 115394 - protein, 148 aa, Glycine max
  Coding DNA Sequence Number=SeqID_23709
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MQLARQVSRLEKRAVSRNAINRSNSCSPGDPLVLERPPPRWSSNSPYSESYYNSLAVVLQRRDWENPGVTQLNRLAAHPPFASWRNSEEARTDRPSQQLRSLNGEWDAPCRRRIKRGGVWWLRAAVTATLASADVRRCFLAVTHHPRQ

SEQ ID NO: 115395 - protein, 153 aa, Glycine max
  Coding DNA Sequence Number=SeqID_23710
MKIVISIPLRNCDFAGGEHYQDNCYSYSINNFDWRQESTMYNHHEKGRAPDLESVLADFMTYQASSKANCYSTQQQGTQFGKDYSFEDYQWESEWQPCYHNEAEGLFNLDDLLMQFKGTIDSMQQAFKRAETQIAKLVDKMIQVVVRREEEYT

SEQ ID NO: 115396 - protein, 125 aa, Glycine max
  Coding DNA Sequence Number=SeqID_23711
MPPTVPVNHYSDPEGQHNRIRILWCYPMLMYTERRLALTLKCGSQTSRAANRSRRRNPNTSPDHSIGTGATGGVYKGQGRSQRELMTRALPRNSIVFEDQQLANDPIPITMKFQRLPGPVGPACL

SEQ ID NO: 115397 - protein, 52 aa, Glycine max
  Coding DNA Sequence Number=SeqID_23712
MVWPAQSSRVDELSESSSQAELLLVVPFRASGVLKATSADPWSASFMVETRT

SEQ ID NO: 115398 - protein, 76 aa, Glycine max
  Coding DNA Sequence Number=SeqID_23713
MHMPKLSANCKEEQANKKRKEVVLEPDDDPGHLRANVFQEGGNDENPKTGQIQAKGPSGEGRRPKWRRIKPPSGEG

SEQ ID NO: 115399 - protein, 229 aa, Glycine max
  Coding DNA Sequence Number=SeqID_23714
  Homolog annotation: Hit_ID=Q9AVH2; Match level="QueryCoverage=20%, HitCoverage=16%, E-value=1e-19, Identity=97%"; Hit description =Putative senescence-associated protein
MTEGCGEGFCLANLPGDAFSLWGNFFEAKKQMMADAKFAGLLGSAVLGKPRANFGCWPLLPPVISFVPGFANLWLAPRELSLCLGGGSSCHNMAKTQGHTHTHTHTLTQAQGGGGAWSSVRPGTHLVSTRQAKRERADERILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 115400 - protein, 189 aa, Glycine max
  Coding DNA Sequence Number=SeqID_23715
MGTNQTGKRFYQVKVKNLDTTSIKELGRLMEPLQMQAFRKTYGKDLRVDLSREMSSRGKKTISFLRVSPLFEQNCNCGQGFNKRYLEDKARGMANQGDWVPFMDVLALLIFGVVLFPNVDGLVDLAAIDVFLAYHHSKESLVVAVLADLFDTFDQRIDWDQLLAGIGGRTINWFPRWKEGKEGVLFSCG

SEQ ID NO: 115401 - protein, 68 aa, Glycine max
  Coding DNA Sequence Number=SeqID_23716
MECCGTLRIAQQCFLLTSGMSQNFTNWLTMGVKYLEAVKRRLHATKHWSPEEIRNLAFELTSMNERDL

SEQ ID NO: 115402 - protein, 60 aa, Glycine max
  Coding DNA Sequence Number=SeqID_23717
MTRQKAYGFAISTTQEAATNKKRTEKGASGVVIAYEIMRQLGGHLEESISFVSFVVATGH

SEQ ID NO: 115403 - protein, 142 aa, Glycine max
  Coding DNA Sequence Number=SeqID_23718
MTQRFGKYGRPHDVQIQNEHAFLPYGLPPNYTPPNVAYTPSEIVNNSTPILIESQQPQTDHAHVSQTMGETHEISHHNLADFEPCLGYATEGQVVGGMPLQNTLEDPQYHPQPHPLDSTAGKTSCYGRNWKVESSRGKAQGH

SEQ ID NO: 115404 - protein, 117 aa, Glycine max
  Coding DNA Sequence Number=SeqID_23719
MTKLGLCLSSGPPPLDDKRVRITIRMTKLGLCLSSGPPPLDDKRVRITIRMTKLGLCLSSGPPPLDDKRVRITIRYLRVSWVQNDQTWSLLVIGPAASDDKGVRITIKVSPRIMVAE

SEQ ID NO: 115405 - protein, 153 aa, Glycine max
  Coding DNA Sequence Number=SeqID_23720
MRSKSSVGDLVPLDLEIEATCRRSNAERKRKILQDRTTPPILEEPQSSESSSFFPQTRESIRGAPKANIMAKDQPRRVTLEDYPSSAVPQFFIIIAWLEVQAHNITYPHSLIQLIQGNLFYGLPNEDTYAHLATYIEVCNTVSLQVCRKMLCG

SEQ ID NO: 115406 - protein, 78 aa, Glycine max
  Coding DNA Sequence Number=SeqID_23721
MAPLLNGRCDGRKFPNDMTKSKGKDPLEGLGGPMTRARARKAKEALQQVLSILFEYKPKFQGEKSKVVSCIMAQMVED

SEQ ID NO: 115407 - protein, 97 aa, Glycine max
  Coding DNA Sequence Number=SeqID_23722
  Subcellular localization annotation: CTP_CleavageSite=30; ConfidenceScore=5.22e-01
MYPLLFSVTTTHVDVPSTCTTKDVPSNVLRQSSQAGEGRHKRIQAVSPLFFWKREKRDTKRIQTNKVWKPENSESFWQRKKKKKKKFKKMFKEIERL

SEQ ID NO: 115408 - protein, 128 aa, Glycine max
  Coding DNA Sequence Number=SeqID_23723
  Pfam annotation: Domain name=zf-CCHC; Domain location=56-73; Score =31.2; E_value=3.8e-06; Accession=PF00098.14; Description=Zinc knuckle
MELQHLNQNEETDKKKRSIALKASSSIQEENEEEDSDDEEDFSLFVKKSQEDSQVLRCYKCNQLGHIKANCPSNEEWPEKSDKKRYDERRTKKAYIAWDDNDSSDGSEKEINLLTKDYESDENFSQEV

SEQ ID NO: 115409 - protein, 140 aa, Glycine max
  Coding DNA Sequence Number=SeqID_23724
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=70%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADCPAVLLPLRNHPVSS

SEQ ID NO: 115410 - protein, 164 aa, Glycine max
  Coding DNA Sequence Number=SeqID_23725
  Gene Ontology: Mol. function=aspartic-type endopeptidase activity; Cellular component=chromatin; Biological process=chromatin assembly or disassembly
  Homolog annotation: Hit_ID=A2Q2C7; Match level="QueryCoverage=59%, HitCoverage=7%, E-value=6e-10, Identity=33%"; Hit description=RNA -directed DNA polymerase (Reverse transcriptase); Chromo; Zinc finger, CCHC-type; ...
  Homolog annotation: Hit description=Peptidase aspartic, active site; Polynucleotidyl transferase, Ribonuclease H fold
  Pfam annotation: Domain name=Chromo; Domain location=68-122; Score =26.6; E_value=9e-05; Accession=PF00385.15; Description='chromo' (CHRromatin Organisation MOdi
MRFESTQTPLAQNSGTNDKTTISGKKNSSETRCKILWTFPGGGEDGRSSLQVQGELPKDLEVTEETDVYPDKVLGSRVIIQGGNEVQQTLIQWKNKALEDVTWEHNEVLCCQFPEFCLEDKALSKEVGVDRNVISEVGPRPRVWRVYTRKKTKGMKDNDVAVNA

SEQ ID NO: 115411 - protein, 48 aa, Glycine max
  Coding DNA Sequence Number=SeqID_23726
MEAQRSVWWSAEEHRPSDSCTVTDLWNSRLRLGYQKATTGKCIYPNDF

SEQ ID NO: 115412 - protein, 237 aa, Glycine max
  Coding DNA Sequence Number=SeqID_23727
MYSTNNSGWRQLTPYNQYEEQRVPDLDIVFAEFMAYHASSKANHNAIQKQEIQCAKVFFEDYQGEPESQFYYQNELERSFNLDILLMQFKDTIGSIQRAFKSAEIQVGKLVEEVTQAMSRREEEIVKVDTQEESPVNEHDLEEEDKEKAQQWKQCLQTHTQQEDNFQVNTCSHQLTIKEERHEDHEASIILGQPCLTFASCVFDMGKAIKHPDDSKDWFEAEISEQEMKLTASAMIL

SEQ ID NO: 115413 - protein, 65 aa, Glycine max
  Coding DNA Sequence Number=SeqID_23728
MGVQIAPRPTWALQNIPPEGCCFWRKQPGSPGRAELAWASWEFRKGFNRSSTFFIRSSSFFDLQR

SEQ ID NO: 115414 - protein, 129 aa, Glycine max
  Coding DNA Sequence Number=SeqID_23729
  Gene Ontology: Biological process=transposition, DNA-mediated
  Homolog annotation: Hit_ID=Q1J7G7; Match level="QueryCoverage=28%, HitCoverage=65%, E-value=3e-10, Identity=71%"; Hit description =Transposase
  Subcellular localization annotation: CTP_CleavageSite=52; ConfidenceScore=5.20e-01
MVKVGTSYVPINVSFSPKVGQGFPWLLFLSAVPPVQLLTGWCVTAKAPPDISAGKCSGRVPFAIQAAQLLGRAIGAGLFAITPAGERGMCCKAIKLGNARVFPVTTLNSILMGYTHPYPFHLPKELIEW

SEQ ID NO: 115415 - protein, 46 aa, Glycine max
  Coding DNA Sequence Number=SeqID_23730
MLNGMPQGSSTISTRCVRVVSSEKWRLRNLGWGGLRHWKCGRQALW

SEQ ID NO: 115416 - protein, 131 aa, Glycine max
  Coding DNA Sequence Number=SeqID_23731
LEVYFGNYTMIEMEESSGFPVLFGGENSNPPNDGCKDKILGLELIARLQNNGLKDKIFLGLKLIARLQHRTRGLRNLTRIHGVDLTNETQDTCPRRYIKKEIYEEVLGISYSMVNQSEKVVAHDLKKSHFL

SEQ ID NO: 115417 - protein, 216 aa, Glycine max
  Coding DNA Sequence Number=SeqID_23732
  Gene Ontology: Biological process=transposition, DNA-mediated
  Homolog annotation: Hit_ID=Q1J7G7; Match level="QueryCoverage=21%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPNFPLGSSLNQSRAYQDNPYGVYPDLSSLSGSGVIQNFVTCIKRSAPSKDHIKRIVASLNTHIKLIDTVDLEGGPVGKPVVPAALMNRPTRGERRFAYWALAECILAYYVGTDEGVSEVLHVAEKKAAP

SEQ ID NO: 115418 - protein, 179 aa, Glycine max
  Coding DNA Sequence Number=SeqID_23733
  Gene Ontology: Biological process=transposition, DNA-mediated
  Homolog annotation: Hit_ID=Q1J7G7; Match level="QueryCoverage=17%, HitCoverage=45%, E-value=4e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPEFDGSVYVRLDSARLVYYKVAIKLANIKLIDTVDLEGGPVGKPVVPAALMNRPTRGERRFAYWALAECILAYYVGTDEGVSEVLHVAGEKRLH

SEQ ID NO: 115419 - protein, 173 aa, Glycine max
  Coding DNA Sequence Number=SeqID_23734
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTPHQCQHSKPVYTPLAPNTQTASPRALADSLMQLARQLKWFHIDQYKSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115420 - protein, 62 aa, Glycine max
  Coding DNA Sequence Number=SeqID_23735
MDVCRKVPFTKFLCVQMRNATKEALRKRSRRDAAAEGTSTAPEFDNHRFKSAGHQQRFKAIK

SEQ ID NO: 115421 - protein, 240 aa, Glycine max
  Coding DNA Sequence Number=SeqID_23736
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=1e-22, Identity=31%"; Hit description= UPI00006A17C9 related cluster
MLLSSNVIYICVRVIMLVRMIRTRLFAAARVKSCPGMHSSCVIASLSGCARTVGRPPISGGGPGTVRVWSTLKMRTRSPLKVRACNPLKARMYSPLEVRACSPLKVRACSPLLARTCSLLKVKACSPLLARTCSPLKVRACSPTKVRTCSPLMARACSPLKVRTCGPLKVRACSPTKVRACSPLMVRTCSPLKARTCSPLEVRACSPLMVRTWSPLKARTCSPLKVRACSPTLARTCSPL

SEQ ID NO: 115422 - protein, 200 aa, Glycine max
  Coding DNA Sequence Number=SeqID_23737
KEHALRCPYRTRARVRVMGKVEEAQEQVKADMEAMKEQMATIMEAMMSMKKIMEANAVTVAATNAIAKVNPMPPSGLNQMNHPTSDMVGKDLGSTAQIQNKHAFPPYGLPPNYTPPNVAYIPNEDTHQIPHHNLADFEPCLGYATEGQAVGGIPLQNTLEGPQYHPQLHLLHYTTSKNPHAMAEMGKLDHLEERLRPLKE

SEQ ID NO: 115423 - protein, 235 aa, Glycine max
  Coding DNA Sequence Number=SeqID_23738
MAEILSKDSFEAPEEDKEVQALKNELGKAKLAKEKFKLAATHIRKEYAELREENATTTRALEQETKRARKEEYGRNKFRGALWGSNSELKLRREERDDSRAYSMVLKEELVACSRSKRSLSQRLCETETNMLAIIAKYPEELSLATAHEHRVADEYAQVYAEKKARGRVIDSLHQEATMWMDRFALTLNGSQELPRLLAKAKAMADTYSAPEEIHGLLGYCQHMIDLMAHIIRNR

SEQ ID NO: 115424 - protein, 117 aa, Glycine max
  Coding DNA Sequence Number=SeqID_23739
MITVGRLPTKCFISHNRLYTHVKIKYETKYHFLSVTCSCKCAKNHDHAVNVSPSTTANARGRTPPFPSCDVPIKEGPIVFVVQICVINLYDWLTILESLFTLTKSPKTLYETDGVYD

SEQ ID NO: 115425 - protein, 87 aa, Glycine max
  Coding DNA Sequence Number=SeqID_23740
VQMSYVYEDITKGKDHEAVEGPMTRGRLKQAQHIIETRLFLSGFLVEPIIRLIKVILVASTLTYLPSLEVASSKTSVACIKRSAPTQ

SEQ ID NO: 115426 - protein, 163 aa, Glycine max
  Coding DNA Sequence Number=SeqID_23741
MSLHSSSSVNGEGSTPKDPLYKILDELRSLKLWKEKQERKEKGKRRVEEISQDEREKIREEERRKIMKEMKREKHASYSSHNSCKSLSEELRDYYDGRHRSHLRPHSHRSHHDVSSFGACRPRIFFINGFLCSWKMNGSGIEKEEREETPLQGEDESRRSSPP

SEQ ID NO: 115427 - protein, 112 aa, Glycine max
  Coding DNA Sequence Number=SeqID_23742
MVNKIKIEKFTRNNSFNLWHIKIQALLKEEGIGAPLSDQPLKIDKLVLELQEEKPLSLAPMRILSSLSVGKDSITLEEVKSNLYSRELRLKASSNGDKASTSELLVTDSAKG

SEQ ID NO: 115428 - protein, 40 aa, Glycine max
  Coding DNA Sequence Number=SeqID_23743
MLEGTKQGRPSKDQMVNFQGMAFKANVEVECREVICVAID

SEQ ID NO: 115429 - protein, 315 aa, Glycine max
  Coding DNA Sequence Number=SeqID_23744
  Gene Ontology: Mol. function=aspartic-type endopeptidase activity; Biological process=proteolysis
  Homolog annotation: Hit_ID=A7PT07; Match level="QueryCoverage=61%, HitCoverage=13%, E-value=5e-40, Identity=40%"; Hit description =Chromosome chr8 scaffold_29, whole genome shotgun sequence
MSFSLIGSMLYTIKKDIDYPWKQDIIGDPSTNLITNSTVRVETIKTKVVSKQKSVEEASPSIPIEKPLFKPFKVSEKAKRKIRDLRKTKSLVEGVGDNHSELLNKIGSLLKVIPETPQTSENTSKMVTRSTSKLINVINEDSDQNLNNTNETGSVSEKNINPINSKHWKTPSKLYYQRPTAPDLLLEERGENNFKSFSANNIYEWNIDAQTEYNIMNTLQHMTMVAKAYQTSHEYSEETIIDILVAGFSGQLKGWWDNDDDKEIPDAINTLILTIAQHFIGDPSLWKDRSAELLSNLKCRTLADFRWYRDTFLTR

SEQ ID NO: 115430 - protein, 119 aa, Glycine max
  Coding DNA Sequence Number=SeqID_23745
MGIAPTETPSGPEEVQQGPGVSSSGYRPLSALQGARSPQDCARKTPSGPEEGQQGLGVANSKYGSLSSGPPTNRAFIKKYCAPRQAQGETPHQHWDGRQRAIDAPPSPLEFTSAHPQKG

SEQ ID NO: 115431 - protein, 101 aa, Glycine max
  Coding DNA Sequence Number=SeqID_23746
  Homolog annotation: Hit_ID=A5CAY8; Match level="QueryCoverage=94%, HitCoverage=17%, E-value=3e-10, Identity=46%"; Hit description =Putative uncharacterized protein
  Pfam annotation: Domain name=RVT_2; Domain location=1-101; Score= -180.6; E_value=0.0088; Accession=PF07727.5; Description=Reverse transcriptase (RNA-dependent DNA pol
MRDEMDSMASNQVWDLVELPVGGYKVPSVCRPGSSNTKKDSQKATLRDISFKTTKVKVEVTLYDQDDILLATNDKGMLYEVKQFLSKNFDMKGYGRGILLS

SEQ ID NO: 115432 - protein, 239 aa, Glycine max
  Coding DNA Sequence Number=SeqID_23747
  Gene Ontology: Mol. function=motor activity; Cellular component=cell projection
  Homolog annotation: Hit_ID=UPI00016621D1; Match level="QueryCoverage =94%, HitCoverage=44%, E-value=1e-13, Identity=28%"; Hit description =UPI00016621D1 related cluster
VLAFRGLHALTFGGLHVLPFRGLHVLAIIGLHTLPFKGLHALAIRGLHALTFKGQHVLAFRALHVLIFRGLHVLAFRGLHILGFRRIHVLAFRGLHIHAVRGLHVLAFRGLYVLAFRGLHVLAYRGLHVLAFRGLHILLQRTPRPRLQRATRPPSEARPRHREDYIRLHALAFRGLRVLTFRGIHALAFRGLHVLTLIGLHVLTFRGLHVLAFRGLHVLTFGGLHVLYNDPPRRTVSTL

SEQ ID NO: 115433 - protein, 115 aa, Glycine max
  Coding DNA Sequence Number=SeqID_23748
MLKCQYDRSVSAEDDVNLRVSMGLPAAIDEGRRRDVSLCVLSGFSSYRQQKRMFIRITTRTAKKNVYTDNHSGISARQRDSNVSMTDLVSAEDDVNLRVSTGFATVIDEGHRRQR

SEQ ID NO: 115434 - protein, 92 aa, Glycine max
  Coding DNA Sequence Number=SeqID_23749
MGDHVQHVHQLTLVFVDAFDLHVEQLFRVGHHVEVERQPDRQLFFCSAAWLRARALFTGRKINMLFKLAQVGSNRYAGCGRYSRPAPQRAAG

SEQ ID NO: 115435 - protein, 56 aa, Glycine max
  Coding DNA Sequence Number=SeqID_23750
MAVASGGSNLARLGELGGKLLPYFPINRGRSEGERGSALLIFNCSSSFFVALRSST

SEQ ID NO: 115436 - protein, 91 aa, Glycine max
  Coding DNA Sequence Number=SeqID_23751
  Gene Ontology: Mol. function=oxidoreductase activity; Biological process=metabolic process
  Homolog annotation: Hit_ID=A8I4A2; Match level="QueryCoverage=96%, HitCoverage=35%, E-value=6e-24, Identity=64%"; Hit description=Short- chain dehydrogenase/reductase SDR
  Pfam annotation: Domain name=adh_short; Domain location=8-91; Score= -39.0; E_value=0.0045; Accession=PF00106.16; Description=short chain dehydrogenase
MSATFQNKVVVVTGGTSGIGLATAKYFANQGAHVYITGRRQAELEAAIKTIGGKVKGVQADMSKLADIDRLYDAVQQNHSQIDVIYANAGG

SEQ ID NO: 115437 - protein, 111 aa, Glycine max
  Coding DNA Sequence Number=SeqID_23752
  Gene Ontology: Mol. function=transporter activity; Cellular component= intracellular; Biological process=transport
  Homolog annotation: Hit_ID=A5BH80; Match level="QueryCoverage=90%, HitCoverage=59%, E-value=4e-26, Identity=59%"; Hit description =Putative uncharacterized protein
MLDKGCNGLAGEEVLAQEDERGRCFEPETSEDEWQKSRTRSLRRKAMTASTRLAYSLRKRNTRVANSDFASIFIEDVRDANEEKAVNSFRQVLLTRDLLPDSHDDYHEMLR

SEQ ID NO: 115438 - protein, 107 aa, Glycine max
  Coding DNA Sequence Number=SeqID_23753
  Gene Ontology: Mol. function=nucleoside-triphosphatase activity; Cellular component=intracellular; Biological process=regulation of transcription, DNA-dependent
  Homolog annotation: Hit_ID=Q1H102; Match level="QueryCoverage=100%, HitCoverage=29%, E-value=5e-21, Identity=47%"; Hit description=Sigma- 54 factor, interaction region
MEYPWPGNIRELENVIHRAVLVSTSNTLYPKDLNLPKISFNRPEFAADEESSIVAPITTRISYERQSALYKLESVLEELFEQAPENLYELINGTTVSKAYEHSKNNQ

SEQ ID NO: 115439 - protein, 63 aa, Glycine max
  Coding DNA Sequence Number=SeqID_23754
MNLFVKARAWFNPITQGMAILIANTSSKFHRDEKLGNTHAMHGKWENTRVPHEQTSKPLVCNL

SEQ ID NO: 115440 - protein, 47 aa, Glycine max
  Coding DNA Sequence Number=SeqID_23755
MSWNCLTMNPIQQIHGSFKAYIHKDTAFLLHCSKFLRHPLPKKSRAS

SEQ ID NO: 115441 - protein, 226 aa, Glycine max
  Coding DNA Sequence Number=SeqID_23756
  Homolog annotation: Hit_ID=A2Q4S5; Match level="QueryCoverage=51%, HitCoverage=17%, E-value=3e-10, Identity=35%"; Hit description=IMP dehydrogenase/GMP reductase, putative
MYDQLDEACRTTTRQLAGYLTLLQIYEHFPSVHQCVTDDTYQETSPRASRWLTSKTHMKGITGAPYRARCDGLIVTDVSWLLYTEHRGVRAFQEISCFQGQLRWGPMVVTVRPERVVFADYMEWFFRISHPFMTPTQAGDQQRDASAADPEDYIQPPSPQVPVPFDPLPHVGYEAIAQRLERVLNLRIVTAGIELYDIMQDCLTIARGGLSADGTVRARQRRRTDH

SEQ ID NO: 115442 - protein, 146 aa, Glycine max
  Coding DNA Sequence Number=SeqID_23757
MNVCFTSGSCMTWKTCPVVEELLQRLIDYGQLEVSIGGREEPQICMQSEEKKVPLTPKALVICFTRKGTGSTPIYPRTAPKPTPFAYQSNKVVPWKYTPPASSERVATEVDSLSAKVTNITGLNGVTRSGRVFASPHPTELTSKGK

SEQ ID NO: 115443 - protein, 208 aa, Glycine max
  Coding DNA Sequence Number=SeqID_23758
MTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLMSLSMQSQGFAPFSCPTPDQFRAEVAWPGDWPEAQAGEAPPEAPGDGEEAHEDEEMADLLDFLGGSGDT

SEQ ID NO: 115444 - protein, 186 aa, Glycine max
  Coding DNA Sequence Number=SeqID_23759
  Gene Ontology: Biological process=transposition, DNA-mediated
  Homolog annotation: Hit_ID=Q1J7G7; Match level="QueryCoverage=20%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVGDPEVDHNCWDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 115445 - protein, 49 aa, Glycine max
  Coding DNA Sequence Number=SeqID_23760
MEELINKTQLSPQNNPNIITSAWRLLNRISSLHTTAVILLPRTRFTIIT

SEQ ID NO: 115446 - protein, 66 aa, Glycine max
  Coding DNA Sequence Number=SeqID_23761
  Subcellular localization annotation: CTP_CleavageSite=44; ConfidenceScore=5.12e-01
MTTNLSESVNSMLKNTTHLSMSSLVEETYFKTAQLFAKRGRQTRAMMNSGTQYSGVVFDVMNSSQQ

SEQ ID NO: 115447 - protein, 135 aa, Glycine max
  Coding DNA Sequence Number=SeqID_23762
MTHQISPHLAFFTPRQNKKAEQGTNPETLKRDNQTQKHLYISQLIPRNERNGQHPTRKELKNQDSHENHPSTSNMARLVMSFKTKKGDIGSKGLSKELIQGRLIWLETYKNKMPKSSPNMHVKQEVSTRVKPRLL

SEQ ID NO: 115448 - protein, 67 aa, Glycine max
  Coding DNA Sequence Number=SeqID_23763
MPVDTQRLTSSSAPSIILTHEVRVLLSSSGDIQARRLVRFFSAGQGVIKFDGMGKCRGCPTLSLSRQ

SEQ ID NO: 115449 - protein, 23 aa, Glycine max
  Coding DNA Sequence Number=SeqID_23764
MEGGIGPILDLTPKEEKIIEGLK

SEQ ID NO: 115450 - protein, 95 aa, Glycine max
  Coding DNA Sequence Number=SeqID_23765
  Homolog annotation: Hit_ID=A5BEV8; Match level="QueryCoverage=77%, HitCoverage=9%, E-value=9e-12, Identity=45%"; Hit description =Putative uncharacterized protein
MDKWTNITDMGCVIASRYNVNVVSLPRQQNMTFFPLRSQPPPDSSVHRVICIGHVYGNHFVQVFLRDQCPLPPLAFIVEYTLSLSGKEVAHPIHR

SEQ ID NO: 115451 - protein, 250 aa, Glycine max
  Coding DNA Sequence Number=SeqID_23766
  Gene Ontology: Mol. function=transporter activity; Cellular component= outer membrane-bounded periplasmic space; Biological process=transport
  Homolog annotation: Hit_ID=Q3JHJ0; Match level="QueryCoverage=95%, HitCoverage=97%, E-value=5e-69, Identity=53%"; Hit description =Lysine-arginine-ornithine transport system, binding exported protein
  Pfam annotation: Domain name=SBP_bac_3; Domain location=33-244; Score= 241.7; E_value=1.6e-69; Accession=PF00497.11; Description=Bacterial extracellular solute-binding proteins, family 3
MASSRFTARLRQTLALAVLAGCAFGAQAKIDQVRFAVDPTYPPFESKTPQGKLVGFDIDLGNALCAQMQAKCVWVESQFDGMIPALKAPLKQIDFTVPLYDTHTQLIARKGSGLLPTAESLKGKTVGVEQGTVQERYALAKWQPHGVNVVPYGDQAQVESDLISGRLDVVFTDAAQAANGFLKQPQGKDFELAGPIVEDPIIGPGTAIGLRKGDTELKTALDNAFAEIQKNGTFDNIQKKYFATDVSIPH

SEQ ID NO: 115452 - protein, 293 aa, Glycine max
  Coding DNA Sequence Number=SeqID_23767
  Gene Ontology: Mol. function=DNA topoisomerase (ATP-hydrolyzing) activity; Cellular component=chromosome; Biological process=DNA topological change
  Homolog annotation: Hit_ID=A6X559; Match level="QueryCoverage=100%, HitCoverage=45%, E-value=1e-151, Identity=87%"; Hit description=DNA topoisomerase IV, B subunit
  Pfam annotation: Domain name=DNA_gyraseB; Domain location=2-75; Score= -59.5; E_value=0.015; Accession=PF00204.16; Description=DNA gyrase B
  Pfam annotation: Domain name=DNA_gyraseB_C; Domain location=220-282; Score=85.4; E_value=1.8e-22; Accession=PF00986.12; Description=DNA gyrase B subunit, carboxyl terminus
  Pfam annotation: Domain name=Toprim; Domain location=101-212; Score =17.1; E_value=0.0033; Accession=PF01751.13; Description=Toprim domain
  Pfam module annotation: Pfam domain module=DNA_gyraseB::DNA_gyraseB _C::Toprim; Domain location=2-75::220-282::101-212
MSAVGMLSVFIREPEFVGQTKDKLATVEAQRIVENAIRDPFDHWMTASPREASRLLEWVIDRADERLRRRQEKETVRKSATSKLRLPVKLADCSQNAAAGAELFIVEGDSAGGSAKQARNRANQAILPLRGKILNVASAGREKLTANQQIADLIQAIGCGTRKNYREDDLRYDRVIVMTDADVDGAHIASLLITFFYQEMPDLIRNGHLYLAVPPLFRLSQGGKAFKGLGEMRAEQLKETTMDPKKRTLLRVQVDEEYVDETRNTVDELMGTKPEARFRFIQDRAAFVEELDI

SEQ ID NO: 115453 - protein, 284 aa, Glycine max
  Coding DNA Sequence Number=SeqID_23768
MSPFLVRDFGAQNFKAIQRIHKAWETPLRKDQELRGIRNGIIGGYHEWLKVHTRGLVWLAKLKVVSEESFEAPEEDEEVQALKNELGKAKLAKEKFKLAATHIRKECAGLREENATTAKALEQEAKRACKEEYGRKKFRGALWGSNSELKLRREERDQSRAHSMVQRSLSQRICETETNMLAIIAKYQEELGLATAHEHRIADEYAQVYAEKEARGRVIDSLHQEATMWIDRFALTLNGSQELPRLLAKAKAMADTYSAPEEIHGLLGYCQHMIDLMAHIIRNR

SEQ ID NO: 115454 - protein, 86 aa, Glycine max
  Coding DNA Sequence Number=SeqID_23769
MYPLILLKFNPFSAPNPPFELVERCRSSVEICVDDIISTIVNRDKLCQSSELNALQMPSNFELMSKYTNPHDTHTHTPSEEAQGQS

SEQ ID NO: 115455 - protein, 571 aa, Glycine max
  Coding DNA Sequence Number=SeqID_23770
MAFGGLAARPGELLLHPEGMTVVLSSDSITKATGCLCEGSTNQERWEMIYDSHVARALYKQNAEKAGDHKTIMENISFDLPHTIYINILRNLKGLGDLDNIYYVALINKALWYQGVYHVFDKMDDNSKHTTIAKGHRTKKRHEQSGVSIPKQKVVAEAALAPKREKVSKPAPAPKEVVILSTVPKCVKTRTVKPNPKISDKEWFISFIRNKETSASLSSDNDSTEDTHVSTPLQASIFSTQTTFTSIPHSLRKVQETKNSSFETSSLFKLLSGQRMTMYTHYHNLPYDGTVKAKINKAKRSSPREKTSGVATNVYSRKTLEKPEQGLRISKIRVRKLFTHGEARPGELRLKPEVTGSPWRAGSFTLKSFGGPGKPEASLGELGSHQLLHGGTFKDKKSTQNNIPKDLFEKHKRDPLQEVEPPNRIHANMYILNQAASYQLGLHISKAVEIKIVADKVCPRLPIWDVVKKGNKLYYNEKIPSRRMKVEVLNYSRNWTSSSGYDGSGNTDHHDFIQVLHLVRMYHFDDVYSCLTKDADSYSIIKRLLSPLMVDFNHGDAAEDKGEEVGGGAIH

SEQ ID NO: 115456 - protein, 65 aa, Glycine max
  Coding DNA Sequence Number=SeqID_23771
MAIVVAMVVVIGGGDKGDIGGSNDRGDIGANNSGSSNNDSGDGGGSSVNGVNDDGDSGVGVDSQW

SEQ ID NO: 115457 - protein, 139 aa, Glycine max
  Coding DNA Sequence Number=SeqID_23772
MTHRAGSPRRHLTVIRTSSFRRRRPKCDQQRPIWSSAPMIRGDDLTVSDGDLFVSRGGGPDDKQRPSLVILTHDMRRYLWLFAPFCHPEAAGPMTSRDQVWSFCTHDTRRYLMVIRTLLSSRGGGPDDKQRPSLVILHP

SEQ ID NO: 115458 - protein, 110 aa, Glycine max
  Coding DNA Sequence Number=SeqID_23773
HVTCTLISSRGGGPDDTRRYLMVIRTLLSSRGGGPDDKQRPKAAGPMTSRDQVWSFCTLVSSRGGGPDDTRRYLTVIRTLLSSRGGGPDDKQRLSLVILHPCIIQRRGIL

SEQ ID NO: 115459 - protein, 120 aa, Glycine max
  Coding DNA Sequence Number=SeqID_23774
MVMGDFISRLSFPACLHFSGENTETFSSLTSYPELRRSEFLIGGYVGARASLLSTAPLFVTMIQELVARGDTLRLSAPRHSVTPSVIDEHRPMWSSAPFPEMSASSSGDFLKSPQLFRTT

SEQ ID NO: 115460 - protein, 91 aa, Glycine max
  Coding DNA Sequence Number=SeqID_23775
MIAQQCFFFTSGMLRNFTDYLKMGVKYLEMVKRRLHATKQWSQEEIRISKLFQSIKFCALLFLSLYSSPSSSKLLSMASYGGELLLDSSSP

SEQ ID NO: 115461 - protein, 90 aa, Glycine max
  Coding DNA Sequence Number=SeqID_23776
MATMMEAMMSMKKIMEANAVTIATTSTVAKYEWPHAVQIQNEHAFPPYGLPPNLHQPMWRTLPMRMSITPLLYSLRANNLNLIMHMSLDP

SEQ ID NO: 115462 - protein, 62 aa, Glycine max
  Coding DNA Sequence Number=SeqID_23777
MESGDMRRYLMRYLMVIRTFRQPGANELVGAQRLTSSFAPFVILTHGVRWQAEIPYGHPHLS

SEQ ID NO: 115463 - protein, 82 aa, Glycine max
  Coding DNA Sequence Number=SeqID_23778
  Homolog annotation: Hit_ID=A5BSR3; Match level="QueryCoverage=78%, HitCoverage=20%, E-value=1e-07, Identity=48%"; Hit description =Putative uncharacterized protein
MARTKKTGKITIEAAKEIAEKIDSFEEQATLGSFIPHGRQDVLTAAIGRPEHPGRVRAARANVTIKQYLDRLIEAVPESNKH

SEQ ID NO: 115464 - protein, 138 aa, Glycine max
  Coding DNA Sequence Number=SeqID_23779
MLGQTEEGVCDMRSWVRGQWIPFDADAIGQLLGYPLVLEEGQECEYGQRRNRYDGFDEEAIASCYVYRGKILPGLLPGDGCGSCMAPTRHPLDPDKSNRALGFPALITGLCQSFGVPVTPSKVIRPPITRAFIEKYCT

SEQ ID NO: 115465 - protein, 80 aa, Glycine max
  Coding DNA Sequence Number=SeqID_23780
  Gene Ontology: Mol. function=transferase activity, transferring groups other than amino-acyl groups; Cellular component=1-2nm peptidoglycan-based cell wall; Biological process=lipopolysaccharide core region biosynthetic process
  Homolog annotation: Hit_ID=A4W967; Match level="QueryCoverage=100%, HitCoverage=25%, E-value=1e-36, Identity=85%"; Hit description=Lipid A biosynthesis lauroyl (Or palmitoleoyl) acyltransferase
MLARMSKAAIVPFVPRRKPDGSGYELIMLEPELAPPLDDAETTARWMNGIVEKCILLAPEQYMWLHRRFKTRPNGTPSRY

SEQ ID NO: 115466 - protein, 339 aa, Glycine max
  Coding DNA Sequence Number=SeqID_23781
  Homolog annotation: Hit_ID=Q84VI1; Match level="QueryCoverage=100%, HitCoverage=49%, E-value=1e-140, Identity=78%"; Hit description =Envelope-like protein
MATSPKETSAPGSPAVPSSPHQEQPEFNIQPIQIIPGQASAPEKLAPRRQQGVKIAENPSLATSPREVDTEMDKKIRSIVSSILKDASVPDADEDVPTSSTPNGSVPDVDKDVPTSSAPNAEALPSPSEEESTEEEDQASEETPAPRAPEPAPGDLIDLEEVESDEEPIANRLAPGIAERLQSRKGKTPIKRSERIKTMAQKKSTPITHTTSRRSKVAIPSKKRKEISSSDPDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDITNRK

SEQ ID NO: 115467 - protein, 112 aa, Glycine max
  Coding DNA Sequence Number=SeqID_23782
MKIKSKTFPKIELKCFRNASVSDYVEILHHSSPFFVVLQSSTELRRSDFLIAVATYPSAGGRRVTRGMRVPRKEYARSRHQRLFEENVGKTEEDAIYELLVKGQELYLRTGK

SEQ ID NO: 115468 - protein, 92 aa, Glycine max
  Coding DNA Sequence Number=SeqID_23783
GFPGGPRDPSVLTSFAEHVAHAVWSGQERPDLKLVSHGRKLTLIGRPVPEIEGLVAATGLSPLIDCSVITGDPGLISTFFLIIIIIIHMNFL

SEQ ID NO: 115469 - protein, 100 aa, Glycine max
  Coding DNA Sequence Number=SeqID_23784
MYQYPFEGHHTDTSASEHSFGGVVETQPHFSWPTMTPSQQHDAPMATPNAPFAPQWNEFSAEAKQVEAGRHHGRRNPDCQARRWDRQCGTSLRHHEHHNE

SEQ ID NO: 115470 - protein, 313 aa, Glycine max
  Coding DNA Sequence Number=SeqID_23785
  Homolog annotation: Hit_ID=Q6WAY6; Match level="QueryCoverage=32%, HitCoverage=18%, E-value=3e-11, Identity=36%"; Hit description =Putative uncharacterized protein
AVNWFPRWKEGKEGVLFSCGDYPNVALIGTRGCINYNPTLSIRQLGYPMRGAPTEESLSPCLVSDLGAQGLKVIQRIHKAWRNPLKKDKELRGIRNGVIEGYHGWLRIHARGLDWLSKLKVIDEENFEAPEEDEEARLAKEKFKSAATHIRKECTDLQEENAAATKALEQETKRARKEEYDREKFRGALWGSNNELKLRREERDRSRVQKEFGSTLGSHGAKRASGAGGQYKEELNQSMAHEQKLVEDFARVYAEKEARGRVIDALHHEATIWMDRFALTLNGSQDLPRLLAKAKAMAEVCTAPEEIHGLINY

SEQ ID NO: 115471 - protein, 100 aa, Glycine max
  Coding DNA Sequence Number=SeqID_23786
MGLGKDGLGNADVVDIKGNPYKYGLGYEPGMPGRRNVPSRLRADRVWFGRISQCFTSAGMVSEEEVAAMEEEFPQDPPSFVQPCHPDSQVGNWRVISQSE

SEQ ID NO: 115472 - protein, 22 aa, Glycine max
  Coding DNA Sequence Number=SeqID_23787
MAIIDKCKEKLKSLAATHEQKG

SEQ ID NO: 115473 - protein, 91 aa, Glycine max
  Coding DNA Sequence Number=SeqID_23788
  Gene Ontology: Mol. function=structural constituent of ribosome; Cellular component=chloroplast; Biological process=translation
  Homolog annotation: Hit_ID=Q32703; Match level="QueryCoverage=46%, HitCoverage=100%, E-value=2e-13, Identity=85%"; Hit description =Putative uncharacterized protein
MNSQYICFYLMPFFVHGSIFWCPRRRGTTPIHPELGGYSGEQISSGDDGVGPVAQRIRARGYEPRCRGFESLLAHNRPKKGRIFPSGVGKS

SEQ ID NO: 115474 - protein, 66 aa, Glycine max
  Coding DNA Sequence Number=SeqID_23789
MSHDCVEQSKTLIETLILQALRAWHNDANLVVASKLDCSLSHIRVCRNFNENRFDGMHVALVNHEG

SEQ ID NO: 115475 - protein, 653 aa, Glycine max
  Coding DNA Sequence Number=SeqID_23790
  Gene Ontology: Mol. function=catalytic activity; Cellular component =nucleus; Biological process=metabolic process
  Homolog annotation: Hit_ID=Q2HUK9; Match level="QueryCoverage=99%, HitCoverage=96%, E-value=0.0, Identity=78%"; Hit description =Tetratricopeptide-like helical
  Pfam annotation: Domain name=PPR; Domain location=136-170; Score =18.5; E_value=0.026; Accession=PF01535.11; Description=PPR repeat
  Pfam annotation: Domain name=PPR; Domain location=246-280; Score =28.4; E_value=2.6e-05; Accession=PF01535.11; Description=PPR repeat
  Pfam annotation: Domain name=PPR; Domain location=348-382; Score =45.6; E_value=1.8e-10; Accession=PF01535.11; Description=PPR repeat
  Pfam annotation: Domain name=PPR; Domain location=35-69; Score=27.2; E_value=6.2e-05; Accession=PF01535.11; Description=PPR repeat
  Pfam annotation: Domain name=PPR; Domain location=383-417; Score=9.5; E_value=0.58; Accession=PF01535.11; Description=PPR repeat
  Pfam annotation: Domain name=PPR; Domain location=419-453; Score =11.8; E_value=0.31; Accession=PF01535.11; Description=PPR repeat
  Pfam annotation: Domain name=PPR; Domain location=485-519; Score=3.8; E_value=2.7; Accession=PF01535.11; Description=PPR repeat
  Pfam module annotation: Pfam domain module=PPR::PPR::PPR::PPR::PPR::PP R::PPR; Domain location=136-170::246-280::348-382::35-69::383 -417::419-453::485-519
  Subcellular localization annotation: CTP_CleavageSite=86; ConfidenceScore=5.54e-01
MTMTQSVFRTSSTARTKTANLTSMFGKYVDKTSVHSWNTVIADLSRSGDSVEALSAFASMRKLSLHPNRSTFPCAIKACAALSDLRAGAQAHQQAFAFGFGHDIFVSSALIDMYSKCARLDHACHLFDEIPERNVVSWTSIIAGYVQNDRARDAVRIFKELLVEESGSLESEDGVFVDSVLLGCVVSACSKVGRRSVTEGVHGWVIKRGFEGSVGVGNTLMDAYAKCGEMGVARKVFDGMDESDDYSWNSMIAEYAQNGLSAEAFCVFGEMVKSGKVRYNAVTLSAVLLACASSGALQLGKCIHDQVIKMDLEDSVFVGTSIVDMYCKCGRVEMARKAFDRMKVKNVKSWTAMIAGYGMHGCAKEAMEIFYKMIRSGVKPNYITFVSVLAACSHAGMLKEGWHWFNRMKCEFNVEPGIEHYSCMVDLLGRAGCLNEAYGLIQEMNVKPDFIIWGSLLGACRIHKNVELGEISARKLFELDPSNCGYYVLLSNIYADAGRWADVERMRILMKSRGLLKTPGFSIVELKGRIHVFLVGDKEHPQHEKIYEYLDKLNVKLQELGYMPNVTSVLHDVDEEEKGMVLRVHSEKLAVAFGIMNSVPGSIIQIIKNLRICGDCHSAIKLISKAVNREIVVRDSKRFHHFKDGLCSCGDYW

SEQ ID NO: 115476 - protein, 311 aa, Glycine max
  Coding DNA Sequence Number=SeqID_23791
  Gene Ontology: Mol. function=hydrolase activity, acting on acid anhydrides, catalyzing transmembrane movement of substances; Cellular component=proton-transporting two-sector ATPase complex; Biological process=proton transport
  Homolog annotation: Hit_ID=Q2HUJ7; Match level="QueryCoverage=93%, HitCoverage=72%, E-value=1e-99, Identity=62%"; Hit description=V -ATPase subunit C
  Pfam annotation: Domain name=V-ATPase_C; Domain location=1-304; Score= 168.0; E_value=2.5e-47; Accession=PF03223.6; Description=V-ATPase subunit C
MEYHCLCRSLIFVGETGWPPLVGFVWDEAKYPTMSPLKEIVDGIHSQVAKIEDDLKVRVSEYNNIRSQLNAINRKQTGRCVDVVMTGIVFKYSMFYFFADLLDYFSLAVRDLSNLVKPEDIVPRSSKKLYEDNEYALYTVTLFSRVADNFRTSAREKGFQIRDFEYSPETHENRKQELDKLVQDQERLRASLLQWCYTSYGEVFSSWMHFCAVRLFAESILRYGLPPSFLVIYSSKIKVQSNDPWDFQTLITEYWVFQACVLAPSVKSEKKVRSILEGAYWKTEDEVGAGMAGLAGDADAHPYVSFTINVA

SEQ ID NO: 115477 - protein, 71 aa, Glycine max
  Coding DNA Sequence Number=SeqID_23792
MEESLASGIWKRETVSKSLIGEEYDREWKAETDREVMMMKILVCVNLTREIAEKGKRMRHCPEDKLQKWDL

SEQ ID NO: 115478 - protein, 381 aa, Glycine max
  Coding DNA Sequence Number=SeqID_23793
  Gene Ontology: Mol. function=metal ion binding; Cellular component =intracellular; Biological process=inflorescence development
  Homolog annotation: Hit_ID=A7PA06; Match level="QueryCoverage=98%, HitCoverage=97%, E-value=2e-62, Identity=37%"; Hit description =Chromosome chr14 scaffold_9, whole genome shotgun sequence
  Pfam annotation: Domain name=CCT; Domain location=334-378; Score =81.1; E_value=3.6e-21; Accession=PF06203.5; Description=CCT motif
  Pfam annotation: Domain name=zf-B_box; Domain location=1-46; Score =34.7; E_value=3.4e-07; Accession=PF00643.15; Description=B-box zinc finger
  Pfam module annotation: Pfam domain module=CCT::zf-B_box; Domain location=334-378::1-46
MLPCDYCHSKPAILFCRPDSAKLCLLCDQHVHAANALSLKHVRFQICDSCKTDTAVLRCSTDNLVLCHHCDVETHGAAASSHHQRHRLHGLSGCPSVTEIVSALCLDFRAQDPVVPTAASGGRDEVYEQVLEIARQRNDDLGAEQLKFDESPINDVVVVDEMLMQQTPFTSLLMLPNSESEFDSRKSNDNNGYGTEAGDLLWNYNPAYQPPQVWDFQLQKSRDCHEPRVVTFDGLEVPKLFQDEHNMKYSTIGDDIDILSRNNQSDQSSSSHAKKKEENNKKAKGGLSSESKLFESIPYNGTNNVVVMEHLVGGNENVGTLTARVSLEELAKNRGDAMLRYKEKKKTRRYDKHIRYESRKARADTRKRVRGRFVKASDVQA

SEQ ID NO: 115479 - protein, 173 aa, Glycine max
  Coding DNA Sequence Number=SeqID_23794
  Gene Ontology: Mol. function=acyltransferase activity; Cellular component=plastoglobule; Biological process=metabolic process
  Homolog annotation: Hit_ID=A7PA00; Match level="QueryCoverage=100%, HitCoverage=21%, E-value=4e-57, Identity=62%"; Hit description =Chromosome chr14 scaffold_9, whole genome shotgun sequence
MAARFGAKIVPFGAVGEDDLGEVRYGSTNEQLSGLVEVTSVLTFVVFDYDDLVKIPYFRSEIESLTNEATQLRSDAGGEVANQPVHMPLILPKVPGRFYYYFGKPLETEGRKQELRDDKQKSHELYLQVKSEVERCIAYLKVKRESDPYRGIGPRLLYQATHGFESEVPTFEI

SEQ ID NO: 115480 - protein, 168 aa, Glycine max
  Coding DNA Sequence Number=SeqID_23795
  Gene Ontology: Mol. function=nucleic acid binding; Cellular component= intracellular
  Homolog annotation: Hit_ID=A2Q4C0; Match level="QueryCoverage=100%, HitCoverage=98%, E-value=2e-17, Identity=35%"; Hit description =Histone H4; Zinc finger, C2H2-type
  Pfam annotation: Domain name=zf-C2H2; Domain location=36-58; Score =18.5; E_value=0.025; Accession=PF00096.17; Description=Zinc finger, C2H2 type
  Subcellular localization annotation: CTP_CleavageSite=62; ConfidenceScore=5.26e-01
MADPTAIYEFFKQQPSNGGGKRAPPPSSAGGTTRTFQCHFCHRKFYTSQALGGHQNAHKLERAAARRSSANANLNLNVVPPAATNGPMPMLEPTELFFHHHPPYWLDVEPLQHFHHHHTTAPLSSFHAAASSVSAPQQQQLLLSAGHNNVVDVAASSDHVNLDLTLRL

SEQ ID NO: 115481 - protein, 48 aa, Glycine max
  Coding DNA Sequence Number=SeqID_23796
MASRFDQALLLGIIFVAFVLTSGEKGLGLASVRMMGNILAVLVRSVNL

SEQ ID NO: 115482 - protein, 284 aa, Glycine max
  Coding DNA Sequence Number=SeqID_23797
  Homolog annotation: Hit_ID=A7P9Y8; Match level="QueryCoverage=94%, HitCoverage=51%, E-value=2e-53, Identity=47%"; Hit description =Chromosome chr14 scaffold_9, whole genome shotgun sequence
MGGVYIFFHHCQLGTGEAAHVQSERATNTCQQLLNGNNIQSLAEQSSKEIQTSMTPASLSISSEREQSAPLMYTPQVSFSQKTGHIEEDPRKSAAAAVAAKLTASTSSAQMLSFVLSSLASEGVIGNPMKESSADYHSEKRTKLENDQQPSFIPSQNPQQPLPPFPLSESIQHNAPTTNQQSTPSEPPPPPSSSPPPLPPPPPPMSQYPVPQFMQTAGSISSMAYGYGVAQQPSMAAYPGVGPSLNGVSSFTPPPMGTYQGFQGTDGNYYNQPSSMPMAPISRQ

SEQ ID NO: 115483 - protein, 78 aa, Glycine max
  Coding DNA Sequence Number=SeqID_23798
MVHDDDVEGEENTIWKHMKSSSLAWVTHSCEYGMRFGRQNESKDNDFCLWQQSCTDLEKEVAAQWWLGTRVMVAGEGS

SEQ ID NO: 115484 - protein, 95 aa, Glycine max
  Coding DNA Sequence Number=SeqID_23799
MKKKNEKFSLSVGLDLEHSWKPSILVFHLLPNQENMEQKQKPEGIRCWNSKESLIQARMVLHYTNTLSVLSSELSLKLPNSIIVHVEKATEGSFH

SEQ ID NO: 115485 - protein, 306 aa, Glycine max
  Coding DNA Sequence Number=SeqID_23800
  Homolog annotation: Hit_ID=A7P9Y4; Match level="QueryCoverage=44%, HitCoverage=82%, E-value=9e-51, Identity=67%"; Hit description =Chromosome chr14 scaffold_9, whole genome shotgun sequence
  Pfam annotation: Domain name=Pollen_Ole_e_I; Domain location=20-146; Score=-18.5; E_value=0.0017; Accession=PF01190.8; Description=Pollen proteins Ole e I family
EPARTKLPGKTRFPISQISVMGFVYCDFCSNSSFSRHSYFLPGAEVKVDCMFKALSEKTSEQISLSVNRTTNKYGMYKLEIPSVDGVKCAEDSAVVSSCQASLIGSSSSACNVPGYKTTSNVIAIKARRANLCIYSFNALTFRPSKRDITLCDSGTDLYNGSNQNLEVLYSWWLEAIKSRSVEKLNHLMVSELYMPAWLSTCFSAKGKYHHDMTCANNIVGKYHHDMTWKHDLCKASRDKPTIQDSSGALIGVRSKKNDDDVVEGGDRSQMLEMDISHGIKDEQGKQGVSLYFGIANLEGKFYLMK

SEQ ID NO: 115486 - protein, 62 aa, Glycine max
  Coding DNA Sequence Number=SeqID_23801
  Subcellular localization annotation: CTP_CleavageSite=23; ConfidenceScore=5.05e-01
MVSELYMPAWLSTCFSAKGGSMTCVKLPSTNPPSKILRELSLELDLRRMMMMWLKGVTDLRC

SEQ ID NO: 115487 - protein, 68 aa, Glycine max
  Coding DNA Sequence Number=SeqID_23802
MDWGGLNVDQISALNKENGELCTYMDMDPAIHHIMWKHKGWLKRQKKGKKKSAKGDKEVQSEKSECAK

SEQ ID NO: 115488 - protein, 96 aa, Glycine max
  Coding DNA Sequence Number=SeqID_23803
MEVMDHVRMKRQEKLEKMIAAENMPMEFIRREKESSILNCIENWVAKIWMGVREEGKGRQILSKESIGWLQHSVVLQNLVVISSHLQHLIESYLSS

SEQ ID NO: 115489 - protein, 18 aa, Glycine max
  Coding DNA Sequence Number=SeqID_23804
MAKFEMPVIEQFTELFKD

SEQ ID NO: 115490 - protein, 230 aa, Glycine max
  Coding DNA Sequence Number=SeqID_23805
MSDGDVKDMKMKKKVKAVENDNNMEGQAHFDNNFMFEVLKHVDAWTLTLAAGSNNHDSWSSCSVASVASMRFISSHSPSHNKHHLLPPYWLSLILPTPERARFVRGKACDKPHLNFASSGGVGAGVVDGNLLVGEDPEVKVTKEVTLGLGSRTTQTAPRVVASIYWGGGAVARSVMQGGGVTTVVVKDVGTWVGAYTNLVGPPGRVVVGVCYGGVCRGGDDAQKERERLG

SEQ ID NO: 115491 - protein, 274 aa, Glycine max
  Coding DNA Sequence Number=SeqID_23806
MDSVSREERAYFERGVITVDSGKLEPAIASMVQRGEKETHDVVEGESGGGWRKRNPIGGFKAVYVVIHGGSGWVPGSATANRQGGVMGISASNYRNFNDRKAMIPPKLARPKYEVVWKGDVNGDQKESKFICGKWPRGLCLLMCKGSRGSSVMIIIAPSAIIAVKVLAMFVESARWHEQFGMSFRAILCLLKVAGSIHNNAAEGWTIIIGMQVAWERGFKDLFIESDSTTIISLINDGCSSDHAFNHVVEAIKDFARKDDITNGVISLEKPACG

SEQ ID NO: 115492 - protein, 35 aa, Glycine max
  Coding DNA Sequence Number=SeqID_23807
MKEGGGGLGLGRESKIEVQEVMSYGSASQECMWAS

SEQ ID NO: 115493 - protein, 43 aa, Glycine max
  Coding DNA Sequence Number=SeqID_23808
MTDAGRAELSLTKLTRLTMEKSTPKEFESKVPPKDIPKEDKKH

SEQ ID NO: 115494 - protein, 40 aa, Glycine max
  Coding DNA Sequence Number=SeqID_23809
MKVMKKGKRHSHSGEKKKNKRYREQNLDVEIIVATQNSEG

SEQ ID NO: 115495 - protein, 642 aa, Glycine max
  Coding DNA Sequence Number=SeqID_23810
  Gene Ontology: Mol. function=nucleotidyltransferase activity
  Homolog annotation: Hit_ID=Q5BPR8; Match level="QueryCoverage=70%, HitCoverage=95%, E-value=4e-69, Identity=36%"; Hit description =Putative uncharacterized protein
  Pfam annotation: Domain name=NTP_transf_2; Domain location=48-125; Score=14.2; E_value=0.0054; Accession=PF01909.14; Description =Nucleotidyltransferase domain
MDRQENLLAFSMPSQLLSIDEELWRMAEERAQEILWTIEPIVLSEVNRKDVIDYVQRLIRGYYGAEVLPFGSVPLKTYLPDGDIDLTALSHEDAEEDLAQAVCNILQSGDDPEYQVRLVKCTVKNIAVDISFNQMAGICTLRFLEQSTSWWTPWLVINICGRNISLVYYQSFSFISAWSSRDYYGSFDWDHNYVSIWGPKPLSSLPEIAETPECDQGEFLLQKEFLRNYRNMCSFPSRASETMTHEFPVKFMNILDPLRNDNNLGRSVNIANLHRVRFALSYGARRLKQILTLPGENMGAALEKFFFSTLDRNGKGERADVAVPVSPFGIGRSEESVLRGDCESYCGGLQYVQLYRNYAMPIAVHSSSPSSPSQDDILAPSTQQNWSMFYQGGTDVYIPGQTLYHPTYNLEGRGKSRGTGTYIPDLNYNSYWDMHTKPSRPRRFASSKYNALPKSPSKKQQAEEVHSVTDINANSDSRLFEFSSEDSPLLLCNCKAIPPTQAQESTPLAKFHSETDMDVTSQLLEFSNEDFPLLPKVYSETHMEGNSRSFELSKKDFPLLQSTHKTALSESAAKLTKQAKSFPSSKESKLKNIEFGTFKKSQSLIEPSLSTKGEREDSGVPLSQETVLVVPKVAAERKDESP

SEQ ID NO: 115496 - protein, 296 aa, Glycine max
  Coding DNA Sequence Number=SeqID_23811
  Gene Ontology: Mol. function=protein serine/threonine kinase activity; Biological process=protein amino acid phosphorylation
  Homolog annotation: Hit_ID=A7QP55; Match level="QueryCoverage=79%, HitCoverage=82%, E-value=3e-75, Identity=61%"; Hit description =Chromosome chr1 scaffold_136, whole genome shotgun sequence
  Pfam annotation: Domain name=DUF579; Domain location=49-296; Score =372.3; E_value=7.6e-109; Accession=PF04669.4; Description=Protein of unknown function (DUF579)
  Subcellular localization annotation: CTP_CleavageSite=57; ConfidenceScore=5.58e-01
MQPSNKKKHPPTSSPAPRLLPLLAATLFLLFLFRQTLLHPTADLCFSSSSAVPLSPSEATIAAEFDSSPLTLVTILHYATARALPQQTKGEIRRSFDVLQSLAPCNFLVFGLGHDSLMWDSFNPRGTTLFLEEDPKWTLSALQRFPILRAHIVRYSTRLAEAKELLSSYKDYCPGVSKNTTDHPLKGDRWCKLALGTLPNEVYNRDWDVIMIDGPRGYFAAAPGRMAVIYSAAMMARGRKGSGVTHVFLHDVDRGVEKQYAKEFLCMKYRVGGIGKLWHFVIPPVVNPSDIAHGFC

SEQ ID NO: 115497 - protein, 218 aa, Glycine max
  Coding DNA Sequence Number=SeqID_23812
  Gene Ontology: Mol. function=nucleic acid binding; Cellular component= intracellular; Biological process=multicellular organismal development
  Homolog annotation: Hit_ID=A5BCW3; Match level="QueryCoverage=99%, HitCoverage=100%, E-value=5e-63, Identity=53%"; Hit description =Putative uncharacterized protein
MAMEVEQNQNHQLGFPFWKPLRRRFGPESPFFAHGNLERELLAKQLALELTEEKQQLEKWMQEEEGRVYPTSWLLSIHVSEVHDSFFQAKVARGYDMYECLVERCGLKFKSYNSRQQHLVDKHKFPTSFEFFKKAKPSKKHRLKSQRKQAVCKEDSSGMMEVENASMDDLVSAVSKLNTSDSTPSSISFGRRHKGLSFVPRAVQRGGGSNSTASVTKK

SEQ ID NO: 115498 - protein, 180 aa, Glycine max
  Coding DNA Sequence Number=SeqID_23813
MVEGEILVEGGACINILPVTNGNSSNTHGVVALDVTIESHRRLIIFMAISSQANFNMLLGHEWMQFRLQLFFWNKERHLTLSSYFAQMLTYIAEKMVVTNVAEKMENSRSTLTNLALNKVSYVAQFASSSRSIHPTLLKVHHRGVVGGESWLDAKKDLAIEMVAPAYTLMFKCKSRNYLA

SEQ ID NO: 115499 - protein, 895 aa, Glycine max
  Coding DNA Sequence Number=SeqID_23814
  Homolog annotation: Hit_ID=A7P9U7; Match level="QueryCoverage=49%, HitCoverage=98%, E-value=1e-100, Identity=48%"; Hit description =Chromosome chr14 scaffold_9, whole genome shotgun sequence
MVDFWTSVPSYELKINGIPRTVVSTSKPEDLIIFLDFSIPTRNSTEQVLNALHVNSGILTPLHGRSNGTRGFSFKLKNISRTEIITIELQATSILGRTGTPVSPVAPITFLYDPMKPNVVLRTSSLTETRDFNINIIAEFTKPVFGFVTSIVDVSGGRLIRQGKGIIKSFLLVDCQSSDKGGVSYHSCREDSTPAISIALHSFISAGTIATSLVAAMVSLSSANLEALSILALEGASSPASNPSINLHGMIGHLQVFALTSWFSTNQFIKYSETTRGLRWLIPHHKLPWKKIDTWSSILEREKLAGRSNGLSAGEHSYNRDQQQNDLMNLSYIDHKLSFQTKNTTKFGRFHNQHDLSKTSTLYGLPLNSIEYFTYFLRGEPLSASNVIKGMESYKGWQDMEMNLFWLGVGGSCLLLLHVFAIFFLRHRIGRPPQGSLSVPRFELFLLILMLPCLSQSSTFIIKGGTTGGIITGVLLLAIPVAFILSSLLFLVIAIYTGSFAQYKEFNKITNEEKWYTKLWFFFIGRPMNGKWFNKEGLPSSFLSRFGILFDNWKGPPVLILGDQNEQNNTITKWSESDKSGIRRTKTASSEDSNEETKISTFKRVFGCIRASYIILDLLRKVGLGIISAAYPSENSNKSLFALIITLMQFIFLFTTKPYISRGVHVVESVSLLCEAGVFVILILHNGSHSVESKTWELVMLLLLMFTFIAQITNQWYAMVNSLLNLSQSQNKSLRDGLKLAAKGLILPFLPSKHWSSVISTFSQTETDILSLNPICSGTEFERRNRNGYMDPISAMTATVVPVQSPSTPSHNVIERRDPRTWGAGASSHIEVEGKWLKGHNKAGLKKELKMLRELAKASFSGDTRVDEASTSYTLGEQQHSSGEIYLGNPKRRYY

SEQ ID NO: 115500 - protein, 273 aa, Glycine max
  Coding DNA Sequence Number=SeqID_23815
  Gene Ontology: Mol. function=diacylglycerol kinase activity; Cellular component=nucleus; Biological process=activation of protein kinase C
  Homolog annotation: Hit_ID=A7P9U0; Match level="QueryCoverage=84%, HitCoverage=40%, E-value=1e-69, Identity=43%"; Hit description =Chromosome chr14 scaffold_9, whole genome shotgun sequence
  Pfam annotation: Domain name=PPR; Domain location=141-175; Score=7.8; E_value=0.94; Accession=PF01535.11; Description=PPR repeat
  Pfam annotation: Domain name=PPR; Domain location=42-76; Score=13.6; E_value=0.19; Accession=PF01535.11; Description=PPR repeat
  Pfam annotation: Domain name=PPR; Domain location=7-41; Score=36.0; E_ value=1.4e-07; Accession=PF01535.11; Description=PPR repeat
  Pfam annotation: Domain name=PPR; Domain location=79-113; Score=12.8; E_value=0.24; Accession=PF01535.11; Description=PPR repeat
  Pfam module annotation: Pfam domain module=PPR::PPR::PPR::PPR; Domain location=141-175::42-76::7-41::79-113
MPEKSSSLWTTMVCGYAQNFCSNEALDLFEDMVGEGFEPSGSTLASVLSACARSGCLELGERIHEFMMVKGVGLGDGVILGTALVYLYAKNGAIAMARRLFDEMSERNVVTWNAMICGLGAYGYVDDVLDLREWVVVPNGVTFVGVLSACCHAGLIDVGCEIFRSMKSVYGIELKIQHYGCLVDLHGRGASTNSGNTEVAERVVKEILALEPQNNVVLSAFSNMQRLDTGRKEKKESHEDSPNGGFNPFSVSLTFGNSIGAVGGKTGGILGNR

SEQ ID NO: 115501 - protein, 340 aa, Glycine max
  Coding DNA Sequence Number=SeqID_23816
  Gene Ontology: Mol. function=metalloendopeptidase activity; Cellular component=membrane; Biological process=proteolysis
  Homolog annotation: Hit_ID=A7P9U1; Match level="QueryCoverage=100%, HitCoverage=74%, E-value=1e-121, Identity=68%"; Hit description =Chromosome chr14 scaffold_9, whole genome shotgun sequence
  Pfam annotation: Domain name=Peptidase_M48; Domain location=137-329; Score=63.1; E_value=9.5e-16; Accession=PF01435.9; Description =Peptidase family M48
  Subcellular localization annotation: CTP_CleavageSite=20; ConfidenceScore=5.28e-01
MASTPFSTFCHFHKPTLLFLASDGFRLGGAPAIAFGKVRKNRKMGIFPVCRAGSAVVFRDLDADDFRHPLDQQVGWAIKNEEKGRGVDPLNTLLLRAIPGLNELGKALLVFIEKFSQTGPYISAFNLPDLYHLMVEAAEILNVDAPDLYVRQSPVPNAYTLAISGKRPFVVIHTSLVELLTKAELQAVLAHELGHLKCDHGVWLTYANILTLGAYSVPGIGGMIAQTLEEQLFRWLRAAELTCDRAALLVAQDPKVVISVLMKLAGGCPSMADQLNVDAFLEQARSYEKAASSPIGWYIRNAQTRQLSHPLPVLRASEIDEWSRTPAYKSLLKRGIQIKS

SEQ ID NO: 115502 - protein, 561 aa, Glycine max
  Coding DNA Sequence Number=SeqID_23817
  Gene Ontology: Mol. function=sialyltransferase activity; Cellular component=integral to Golgi membrane; Biological process=protein amino acid glycosylation
  Homolog annotation: Hit_ID=A7PA28; Match level="QueryCoverage=85%, HitCoverage=99%, E-value=0.0, Identity=75%"; Hit description =Chromosome chr14 scaffold_9, whole genome shotgun sequence
  Pfam annotation: Domain name=Glyco_transf_29; Domain location=122 -373; Score=-0.8; E_value=4.5e-07; Accession=PF00777.9; Description =Glycosyltransferase family 29 (sialyltransferase)
  Subcellular localization annotation: CTP_CleavageSite=21; ConfidenceScore=5.25e-01
MRQHKQVSSINRRPTVLYLVCVAALFSLLLFYTQSSFFSGAVSSDSSRIDAVSSDRDSETIHVLSNFQSSVKQCVIFSLVISVTKDNRGLGLTAHVIDHCKLILKYPEGTNSTWYNAQFKKFEPLEYNYDLCETILLWEQYRNMTTVLTREYLDARPGGWVDYAPQRIAQLGAKKCTNKTLCEENLDVLLPAKPPFHPRQFRTCAVVGNSGDLLKTRFGKEIDSHDAVFRDNEAPVNEKYAKYVGLKRDFRLVVRGAARNMVPILNGSDNEVLIIKSLTHREINAVIKTIPNPVYLFQGIVLRRGAKGTGMKSIELALSMCDIIDIYGFTVDPGYTEWTRYFSQPRKGHNPLQGRAYYQLLECLGVIRIHSPMRSKRMEDWSDIPSRQMISQAHAAALRLKRSQAGQGGDLGQFGNCKVWGNVNPDKSGPVSGSPDMSDVRRYSNYSKWEVMPFESLRKEARDHYNQMQGVSVYKMDGNKLDDLVCVRHSLKSEVYFPRASWLLIHRSVSSLIAEHNTNLNSKENEVVNMRNFIDPYDSYFKVIHDNLNQSNLDGLGFGEE

SEQ ID NO: 115503 - protein, 204 aa, Glycine max
  Coding DNA Sequence Number=SeqID_23818
  Homolog annotation: Hit_ID=A9PFB0; Match level="QueryCoverage=93%, HitCoverage=94%, E-value=3e-50, Identity=58%"; Hit description =Putative uncharacterized protein
  Pfam annotation: Domain name=Cgr1; Domain location=75-168; Score= -31.2; E_value=0.074; Accession=PF03879.5; Description=Cgr1 family
MACTIDFRCLDEGFGGKTYKRKREQQSQPQHDAAADDVIDGASLMDTDDALPPPAKRSALPSSENPDKPAFGHPSYDGVIAGRVSGRKWKQVRQRRASAAQVSRKGTTFEQREREKVIKKAYKERMMELKEEIRLNKVEKRKKKEEREKKKQENIIRSGTKFQKITNPNTLKKIAKSKQRKQLRVVPDELGPKANWMNLVRYTF

SEQ ID NO: 115504 - protein, 32 aa, Glycine max
  Coding DNA Sequence Number=SeqID_23819
MHENGTVVLFGVVEVILRVSERSLCLWCVVSE

SEQ ID NO: 115505 - protein, 77 aa, Glycine max
  Coding DNA Sequence Number=SeqID_23820
MIVVSSGGGSNDKDHVGGHDDGHMVVITYGGGSGDDDLNRTLNVTKSQSRISLITICLDYQSLWKEYFKVSLSSLRI

SEQ ID NO: 115506 - protein, 31 aa, Glycine max
  Coding DNA Sequence Number=SeqID_23821
MPRKRQGPQIDLEGKILRIEMSHEATTPTYI

SEQ ID NO: 115507 - protein, 270 aa, Glycine max
  Coding DNA Sequence Number=SeqID_23822
  Gene Ontology: Mol. function=4 iron, 4 sulfur cluster binding; Biological process=metabolic process
  Homolog annotation: Hit_ID=A7P9S9; Match level="QueryCoverage=90%, HitCoverage=50%, E-value=1e-101, Identity=71%"; Hit description =Chromosome chr14 scaffold_9, whole genome shotgun sequence
  Pfam annotation: Domain name=MTS; Domain location=25-177; Score= -91.4; E_value=0.064; Accession=PF05175.5; Description=Methyltransfera se small domain
MAQIIFGNKWRHLLGERDFWEHVGGIDVSLAPSSFGQANTRAFDALLRRLQKYVPYESDVADLYAGAGVIGLSLAATRKSIKCIEINKESKASFEKTIERLPATVDSSITWHHADASKEPFLWLLGSDVVVIDPPRKGLDASLIDALKNISSVERKAFSSSGSSNSSQEEKRPWVLRAKEDSVQIGSKPPTNIAQSVPQTLIYISCGWESFKEDCKSLLSSKAWYLEKAHGFNFFPGTQSIEVLAVFKRGPQKKKQGKKKKKHLQGAVRH

SEQ ID NO: 115508 - protein, 281 aa, Glycine max
  Coding DNA Sequence Number=SeqID_23823
  Gene Ontology: Mol. function=electron carrier activity; Cellular component=anchored to membrane; Biological process=electron transport
  Homolog annotation: Hit_ID=Q8VY59; Match level="QueryCoverage=25%, HitCoverage=40%, E-value=1e-22, Identity=67%"; Hit description=Blue copper protein, putative
  Pfam annotation: Domain name=Cu_bind_like; Domain location=13-81; Score=24.8; E_value=1.6e-07; Accession=PF02298.8; Description =Plastocyanin-like domain
MAEQHVVGGSQGWDESTDFNSWVSGRTFMVGDQRVFKYSSLHSVVELGSESEYKNCNIGNAVNSMSSGNDVKITTVSSSGTSSPSSPSLSSAASASASSSSLVFIAALLIASMLNQFWSMTIFLTPATDTTLPPPLSASVPAAKSASPSTSPTHACKDIALNDDDKCFVSFHPRRRSPPSHFHHRSILPTPSTMVATTLQPRINLESLFDSNDNNNLGFIFIVDGNNYGFRFIIVECYVSNGKLRRTLYCQNLPLHFSPLHVSERSTAMPILQSAPTVRVG

SEQ ID NO: 115509 - protein, 42 aa, Glycine max
  Coding DNA Sequence Number=SeqID_23824
MRMRSVYVNKSITQRKHSRSSNSKERNLPLLLTCEGRAGKSE

SEQ ID NO: 115510 - protein, 311 aa, Glycine max
  Coding DNA Sequence Number=SeqID_23825
  Gene Ontology: Mol. function=protein binding
  Homolog annotation: Hit_ID=A7PLR2; Match level="QueryCoverage=54%, HitCoverage=94%, E-value=2e-34, Identity=47%"; Hit description =Chromosome chr14 scaffold_21, whole genome shotgun sequence
MGLCSSVHRNEQTNMKHHLTLSFESKTESLLIPSSPFEDKEKPKNGNFVVVADDDAFKPQQWSPSRSTTTFSVKDCGDNEPISANMLCLPLQFHDAFLLHMLVMTTMDFSPGYAVYGIFLPLFGLCGVNFKLWTTTCWSFEDGKEESFFDSKAWLDSDCDDDFYSVKGEFTPSRGSTPVHHIFLNKTTPSEPCSVPEPSPTTQKKKLLDLFRESVRENQSDDAENTFGNEKKEVKPTMVHDLIPKSAHSTPYVSGGNSACSSERTMNDDHAPIREKPVKSVQCCLPSLASCRSFSERKRKTSPAIAANGTA

SEQ ID NO: 115511 - protein, 257 aa, Glycine max
  Coding DNA Sequence Number=SeqID_23826
MKMFGVWKKVKGLKEKFLTQARRETILEAVLAISSYVMGCFHLLVFVCNQIEALNAIFQQGSSREAMVAVDLATTYSYVSAFKGCYFPGSKALNAKKRYVPSYTWANIFCVKEMANKGSFEMVSDGLKDVGVGMGMIRRDSNGYILGLAINFLPHKISPKMAEALASKRTIQTARERRFSHFILETNYLQLAQAWKSKRALNPTYFDDVLEDCRYVSRGVVNFKILFVKRLGNKVVESLAKLALDTREKYWLDDLLT

SEQ ID NO: 115512 - protein, 55 aa, Glycine max
  Coding DNA Sequence Number=SeqID_23827
MDEEQWMYDSMMSGEIDMNVENEEDVDVKVEHVDCSYAFNTSQLFASRDEVLEWA

SEQ ID NO: 115513 - protein, 87 aa, Glycine max
  Coding DNA Sequence Number=SeqID_23828
  Homolog annotation: Hit_ID=Q949R9; Match level="QueryCoverage=70%, HitCoverage=55%, E-value=1e-19, Identity=75%"; Hit description =Putative uncharacterized protein At5g20090
  Pfam annotation: Domain name=UPF0041; Domain location=1-87; Score =2.9; E_value=1.2e-05; Accession=PF03650.4; Description =Uncharacterised protein family (UPF0041)
MDTKKPPETISVNMTGVMCVYSALCMRFAWMVRPRNPHLLVCHVSNETVQLYQLSRWFRAQRRYNVCNYGIYRGLEQNKKDADADAE

SEQ ID NO: 115514 - protein, 1119 aa, Glycine max
  Coding DNA Sequence Number=SeqID_23829
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A5C6S7; Match level="QueryCoverage=95%, HitCoverage=99%, E-value=0.0, Identity=39%"; Hit description =Putative uncharacterized protein
MATSGLGVAACNGASVRRQKGHVGSNLAVEAVRNVEGGWREWCAADLIFAAAAMKGKNRRSGGAIHMEYLIHIQEIKPWPPSQSLRSLRSVLIQWENGERSSGSTGVVSPSLGPNSAAGEGKLEFNESFRLPVTLSRDMSIRNSTAAVFQKNCLEFHLHETRRDKTTKGQLLGTAIIDLADCGVLRETLSIRTPLNCQRNYRNTDQPLLFIQIEPVEKSCPKSSLKDSLSKEVTKGNNGSESISELMNGEYAEEAEIASSTDDDVSSHSSAAAVTTSSESSACMPPEHEEEGNCWGHELSDLGGREVAAPGAVNAPNGPAQNSGRNDKEHEHPLASETRVEKLNEMEQDAYERLERSSSYVSSKIGSPVNGHTSITSTPNHRSATTPKQAASLNADSSSPILEENSKSRSISSDDENLDQEGCEKVSNGRNMSTGVQINNDESDFDIYSSNTTSLDSNYLVDKNPSFGLGTKDNLSEMFHSDKQYHVEDESVAQGVKDQVNLSSNSYSLGGLDNGMKGNVLKNERLKHVRSVRSSADSVRSIGSLGNNHLAEVKENGVNGDTQNNGGNIRSSDRKDAKVYPREARNAILDRKIEHLENKIKMLEGELREAAGIEAALYSVVAEHGSSTSKVHAPARRLSRLYLHACKENLQARRAGAAKSAVSGLALVAKACGNDVPRLTFWLSNSIVLRTIISKTTKGMTPSNPSGSSTSRRNGEGNDKVTQPLLWRGFSHRKTENTAFEYGGIGNWDDPNVFTSALEKVEAWIFSRIVESIWWQSLTPHMQLADAKITHKDSAKNYTNMSSSCDQEWGNLSLDIWKNAFREACERLCPIRAGGHECGCLSVLPKLIMEQCVARLDVAMFNAILRESDDDIPTDPVSDPISDPKVLPIPPGQSSFGAGAQLKTAIGNWSRWLTGLFGMDDDDPLEDIDDNDLDSNDESQNTFKSFHLLNALSDLLMLPKDMLLNASIRKEVCPMFSASLIKKILDNFVPDEFCPDPIPTDVFEALDSQDDLEDENESISNFPCNAAPTAYSPPPAATITNITGEFGSESQLRRSKSSVVRKSYTSDDELDELNYPLSSILNIGSSSSASTNSNRKGKDSRDESAIRYELLRDVWMNSE

SEQ ID NO: 115515 - protein, 607 aa, Glycine max
  Coding DNA Sequence Number=SeqID_23830
  Gene Ontology: Mol. function=translation initiation factor activity; Cellular component=nucleus; Biological process=RNA metabolic process
  Homolog annotation: Hit_ID=Q2HUL1; Match level="QueryCoverage=98%, HitCoverage=57%, E-value=1e-168, Identity=77%"; Hit description =Initiation factor eIF-4 gamma, middle
  Pfam annotation: Domain name=MIF4G_like; Domain location=5-123; Score= 61.2; E_value=3.6e-15; Accession=PF09088.2; Description=MIF4G like
  Pfam annotation: Domain name=MIF4G_like_2; Domain location=217-514; Score=160.3; E_value=5.2e-45; Accession=PF09090.2; Description=MIF4G like
  Pfam module annotation: Pfam domain module=MIF4G_like::MIF4G_like_2; Domain location=5-123::217-514
MKLFPSFLCIELLMLPQPPFKPVYYTLVIIDLCKALPGAFPAVVAGAVRTLFERIADLDMECRTRLILWFSHHLSNFQFIWPWEEWAYVLDLPRWAPQRVFVQEVLEREVRLSYWDKVKQLPCKATYNQNHASVKPSLDPICFCKPPTIIRAEKVEPSVLFSYPHALVCLAQWSLQQSRETDWSLQQRREASLLSHLSIENAPGLEELLPPKGGPNFSFGAEDDKESNEHVLSGQLNNMVKGKAPVREIISWIDESVLPNNGLEVTLRVVVQTLLNIGSKSFTHLMTVLERYGQVFAKLCPDQDKQVMLIAEVSSFWKSNTQMTAIAIDRMMGYRLVSNLAIVRWVFSAENIEQFHMSDRPWEILRNAVSKTHNRISDLRKEILSLKKNISSSEEAAKEAKAELDAAESKLTLVDGEPVIGDNPARLNRLKSHAEKTKEEVVSLQESLEAKEALLSRAIEENETILLIKHMFEVLALFLLLYKSFSNVLTERLPEGSRTLHELKSAQVDVVMAVDPEEPSSMELDNQNQRPQNSHTNGEKKGGAYNVGEKEQWCITTLGYVKAFSRQYAAEIWPHVEKLDAEVLTEDAPLLFRSAVYSGLRRPIHEA

SEQ ID NO: 115516 - protein, 73 aa, Glycine max
  Coding DNA Sequence Number=SeqID_23831
MKTLTTTLEGKPDQAVPRWIEPKMWCILSDGLKNEWNKWFYDGTSLDKEAMTTLFNKWATYFLQIKNMEFRKI

SEQ ID NO: 115517 - protein, 230 aa, Glycine max
  Coding DNA Sequence Number=SeqID_23832
  Homolog annotation: Hit_ID=Q6UUU1; Match level="QueryCoverage=26%, HitCoverage=40%, E-value=3e-18, Identity=78%"; Hit description =Putative uncharacterized protein
  Subcellular localization annotation: CTP_CleavageSite=42; ConfidenceScore=5.17e-01
WNSYVPINVSFSPKVGPGLPAVPPVQLLTGWCVTAKAPPDISAGKCSGRVPFAIQAAQLLGRAIGAGLFAITPAGERGMCCKAIKLENINQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115518 - protein, 173 aa, Glycine max
  Coding DNA Sequence Number=SeqID_23833
MAPRKLASKRSRKDKAAEGTSSAPEYDNHRFRSAEHQQRFEAIKGWSFHRERRFQLRDDEYTDFQEEIVRQRWASLVTPMAKFDPDIVLEFYANAWPIQEGVRDMRSWVRGQWIPFDADALSQFLGYPLVLEEGQECEYGQRRNQADGFDEEAITQLLCIPGQDFARTAAGRR

SEQ ID NO: 115519 - protein, 19 aa, Glycine max
  Coding DNA Sequence Number=SeqID_23834
MPIGGADIEEEELTDLRAP

SEQ ID NO: 115520 - protein, 212 aa, Glycine max
  Coding DNA Sequence Number=SeqID_23835
MAPRKLASKRSRKDKAVEGTSSAPEYDSHRFRSAEHQQRFEAIKGWSFLRERRVQLRDDEYIDFQEEIVRRRWASLVTPMAKFDPNVVLEFYANAWPTEEGVRDMRSWVRGQWIPFDADALSQFLGYPLVLEEGQECEYGQRRNQADGFDEEAIAQLLCIPGQDFARTAAGRRVRFMRTNMTTLTQIWMTLLLSNIQPSDHNSDLPLPKCQL

SEQ ID NO: 115521 - protein, 154 aa, Glycine max
  Coding DNA Sequence Number=SeqID_23836
  Gene Ontology: Mol. function=aspartic-type endopeptidase activity; Biological process=proteolysis
  Homolog annotation: Hit_ID=A5B3J2; Match level="QueryCoverage=46%, HitCoverage=16%, E-value=4e-10, Identity=45%"; Hit description =Putative uncharacterized protein
MFDNPINATCRRHNTKRIRKFLQDLEAAATLGEEPQSSEASSSFPIPEKSHIDLIEEVIMAKELRRVTHEDYSSSIVPQFFSSIARPEVQAQTITYPPSLIQLIQNNLFHGLPNEDPYAYLATYIEICNTIRLVGVTKDAIRLRLFSFSLSGES

SEQ ID NO: 115522 - protein, 84 aa, Glycine max
  Coding DNA Sequence Number=SeqID_23837
MSILTLGSKKEEKGKFPIKGKKEARKFPIKEREKEKRKERKVPTKEWEKVKKEKKKAPGQRNQKKCAERSLDRTISEQYKIVTK

SEQ ID NO: 115523 - protein, 191 aa, Glycine max
  Coding DNA Sequence Number=SeqID_23838
  Homolog annotation: Hit_ID=A0ST23; Match level="QueryCoverage=14%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSIPTQSRLWYYFVPMLSPGQHPTYTTRTTIGRPAPSLFMRWLLIKLIDTVDLEGGPVGKPVVPAALMNRPTRGERRFAYWALAECILAYYVGTDEGVSEVLHVAGEKRLH

SEQ ID NO: 115524 - protein, 119 aa, Glycine max
  Coding DNA Sequence Number=SeqID_23839
MDPWVLVPSPLEDYTSLSSEGCTPSSSEDYTSSPSEGCTPSPSKDYMSSPSEGLQSSPSEDYTSSPSEGCTPSPSEGCTALTFRGLHVLAFRGLHVLAIRGLHVLAFRGLHVLVFRGLH

SEQ ID NO: 115525 - protein, 126 aa, Glycine max
  Coding DNA Sequence Number=SeqID_23840
MTLLLSTFAQRPQCQSPPAEVSVGLCRPDMGIAPTKTPSEPEEVQQGPGVSSSGYGPLSVLQGARTPPTRSHHHRDHASPARHVLTTRGLHALTSEEVPRLERSATRPRLGHSSYLHLPEDYTSSL

SEQ ID NO: 115526 - protein, 333 aa, Glycine max
  Coding DNA Sequence Number=SeqID_23841
LKSPSEEELEVPEEGEEVQALKVELERMRVVKEKLKTTVSRVGKDNELKLRKAERDESRVESMILEDKLKACQRWKRSLTEKLSRMEESMFTIIDQYKEKLNLATSHGQRLKDEYAKVSTLQVEREARERVIESLHGKAMKWMDRFALTLNGSQELPRLLARAKEKADVYSTPEEAHGLFDYRQHMEVQEQMKADMEAMKDQMTFMMEAMLSMRRMMEDNTTAVATTSVAIEADLTHPSSINQTSRPAPDMVGQGGEVLGSMGGPHANANHSIPVLLKGQQPQLENAPFAQPMGEAREKPRDHALGEFEPHPTYVVEGPTFCGMPQPNAARAP

SEQ ID NO: 115527 - protein, 163 aa, Glycine max
  Coding DNA Sequence Number=SeqID_23842
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=49%, HitCoverage=73%, E-value=2e-38, Identity=97%"; Hit description =Chromosome undetermined scaffold_79, whole genome shotgun sequence
  Pfam annotation: Domain name=ATP-synt_ab_N; Domain location=84-152; Score=90.2; E_value=6.3e-24; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-150; Score=46.4; E_value=9.7e-11; Accession=PF09378.1; Description=HAS barrel domain
  Pfam module annotation: Pfam domain module=ATP-synt_ab_N::Complex1 _49kDa::HAS-barrel; Domain location=84-152::1-87::84-150
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASGVKGIALNLENENVGIVVFGSDTAIKEGDLVKRTGSIVDVPTGGIL

SEQ ID NO: 115528 - protein, 208 aa, Glycine max
  Coding DNA Sequence Number=SeqID_23843
  Gene Ontology: Mol. function=RNA-directed DNA polymerase activity; Biological process=RNA-dependent DNA replication
  Homolog annotation: Hit_ID=A5AZG1; Match level="QueryCoverage=23%, HitCoverage=14%, E-value=2e-07, Identity=51%"; Hit description =Putative uncharacterized protein
MSLHSSSSVNGEGSTPKDPLYKILDELRSLKLWKEKQERKEKGKKRVEEISQDKREKIREEERRKIMKEMKREKHASYSSHDSCKSLSEELSDYYRGRHSSHTKHHSQRREKDRRPQEVNISLPYFHGKDNVEAYLDWEMKVEQLFACHHISEERKVPLATLSFQGMMDSWGSSSRVMTLRVPLGRGTFPSTMKGSLWTSSKGLDKGV

SEQ ID NO: 115529 - protein, 98 aa, Glycine max
  Coding DNA Sequence Number=SeqID_23844
MDPKRIKVIPEWPTPPCVEERIPEFQEPMDLRSNLFQGGRNMMKRERRCHFKEKMSLEEAHHYRRPWIRAWRNKEMNEGRGREEHEILCSKRALKSEV

SEQ ID NO: 115530 - protein, 75 aa, Glycine max
  Coding DNA Sequence Number=SeqID_23845
MTIICLCVPLDTIEPGWQGISACHRTRSPLDGEKVWEMTIICLRSPLDLLSLNDKGRIMTIICLCMFITRLAKSE

SEQ ID NO: 115531 - protein, 181 aa, Glycine max
  Coding DNA Sequence Number=SeqID_23846
  Subcellular localization annotation: CTP_CleavageSite=36; ConfidenceScore=5.19e-01
LHALTSRGLHVLALRGLHALTLGTSYPHHQRTTRPRLERTTRPRLERTTRPRLERTTRPHHQRAGRPHLQRTTCPRLERATRPHLGELHVLVNGGLHALTLRGLHVLAIRGLHALTSRGLHILALRGLHALTFRGLRGSTHKTPSGLGGAQKGPGVSNSGYGPLSVLQGARPPSKFMPSWH

SEQ ID NO: 115532 - protein, 58 aa, Glycine max
  Coding DNA Sequence Number=SeqID_23847
MEADLKKTLKFLDATNATNLDQKAYIAWDDNDSSDGSEKEINLLTKDYESDENISQQD

SEQ ID NO: 115533 - protein, 102 aa, Glycine max
  Coding DNA Sequence Number=SeqID_23848
MQKKDKELRGSSNRSIGGCHGWLKAYTQDLDWLPNLRTTKGVEDEAPEEDEKVQEEHVSAVRRDRDQHVSHRQQVPRRIKSSHGPRAQSAGRICPSVRGKGG

SEQ ID NO: 115534 - protein, 204 aa, Glycine max
  Coding DNA Sequence Number=SeqID_23849
  Homolog annotation: Hit_ID=Q84VI1; Match level="QueryCoverage=100%, HitCoverage=36%, E-value=4e-52, Identity=79%"; Hit description =Envelope-like protein
MAQKKSTPITPATSRRSKVAIPSKKRKEISFSSSDSDDDVEPDVSTSYRGQEILLEKEESVFLPAFSSLLKFTKYRRTLLLFHGASPKETSASGSPAVPSSPHQEQPEFNIQPIQVIPGQASVPEKLVPRRQQGVKIAENPSLATSPREVDTEMDKKIRSMVSSILKEASVPEADEDVPTSSTPNVSMPDVEKDVPTSSGPNAE

SEQ ID NO: 115535 - protein, 407 aa, Glycine max
  Coding DNA Sequence Number=SeqID_23850
  Homolog annotation: Hit_ID=Q2HW90; Match level="QueryCoverage=87%, HitCoverage=70%, E-value=3e-40, Identity=31%"; Hit description =Putative uncharacterized protein
MGTNQNGKRFYQVKVKGLDVTSLKELGRLMGPLQRQAFRKVYGKILDLTVAEVFTEAVVSLAQYYDQPLRCFTFGDFQMVPTIEEFEEILGCPLGGRKPYLFSGFLPSLSKVAAVIEDSAKELDRIKQIRNGVVGLPRKYLEDRQGYGEPESGPVCGCFSFADFWVVLFPNVDGLVDLAAIDAFLAYHHSKESPVVAILADLFDTFDRRCEKNSARIVCCLPALCVWLISHLFRQDTRHLCPLQSYRSCTEKGRVVWDQHLAGIGGSTIDWFPRWKEGKEGVLFSCGDYPNVPLIGTRGCINYNPALAIRQLGYPMRGAPTEESLSPFLVRDLGAQGLKVIQRIHKAWRSPLRKDKELRGIRNGVIGGYHGWLRIHTRGLGWLSKLKVVDEEKFEAPEEDEEVRALK

SEQ ID NO: 115536 - protein, 220 aa, Glycine max
  Coding DNA Sequence Number=SeqID_23851
  Gene Ontology: Mol. function=nucleic acid binding
  Homolog annotation: Hit_ID=Q5CDC4; Match level="QueryCoverage=19%, HitCoverage=32%, E-value=2e-15, Identity=100%"; Hit description =LacOPZ-alpha peptide from pUC9
  Subcellular localization annotation: CTP_CleavageSite=69; ConfidenceScore=5.07e-01
WLLFLSAVPPVQLLTGWCVTAKAPPDISAGKCSGHAARNHHTAALNAPLQGASHSPFRLRNCWEGRSVRASSLLRQLAKGGCAARRLSWYNGCLWKGGRLRLEKAKEDYLVRLKREWEQGALDDATQKPPAAAIEEEIPSTAHSSESNTKHLNIFFPRLRKARHQAYRYRRPRGGARYQLLFPLVRVNFELGVIMVIAVSCVKLLSAHNSTQHTSRKHKV

SEQ ID NO: 115537 - protein, 170 aa, Glycine max
  Coding DNA Sequence Number=SeqID_23852
MVENLREIAHGNVSEALRKRLSLDGKRRRWLPPSSPRRAGLLPPEGTAFCWNILEGPSGHDCYLQTLCLLNTPPSTLFLWFFFRNVTELYELRNDTCFLSVMSRNLTDYTIVPSLASGMLRNFTDCALTLSFDSRHAAEFHGLPKDGCQVPRNGQAKVASHQTDGSQTKL

SEQ ID NO: 115538 - protein, 55 aa, Glycine max
  Coding DNA Sequence Number=SeqID_23853
YWAALQRRSPLAQRREGVTIGRSWPYPPFASTPKYLQVGDKQYMDNRDRSSSYLG

SEQ ID NO: 115539 - protein, 140 aa, Glycine max
  Coding DNA Sequence Number=SeqID_23854
MSALKEQMASMMEAMLSMKQLIEKNAATAAAASSAVEVDPTLLATTHHPPSNIIGRGRDTLGHDGSPHLGYNRAAYPYGNSAANFQLRREERDQSRHMMVLKEEFNCLVREVHKEACLSVYANGDQHASSIHRKYQKSWV

SEQ ID NO: 115540 - protein, 189 aa, Glycine max
  Coding DNA Sequence Number=SeqID_23855
MKGLHVLALRGLHVLTIRGLHALTSRGLHVLALRGLHALTLGTSYPPQRTTSSPSEDCMSSPSEGYTPSPSEDCMSSLSGLLVTLTVRGLYVLALKDYTSSPSEGCIPHLQRTTCPRLERATRPHLGAYTPSPWVLVTLTVRGLRVLTLRGLHVLAIRRLHALTFRGATRPRHQRAARPHRPEDYTSSP

SEQ ID NO: 115541 - protein, 68 aa, Glycine max
  Coding DNA Sequence Number=SeqID_23856
MTTDSPPLLMFPWTRSPVESPTVATYPSTGGRRGAHGCIFQGRKAHGIATNVYLRKTSEKPEHVVYER

SEQ ID NO: 115542 - protein, 195 aa, Glycine max
  Coding DNA Sequence Number=SeqID_23857
PSREEAEVPEESEEVQALKVELERTKVVKEKHKTTVTRVRKKNKFRGALWGSNNELKLRRAERDESRVEGMILEDKLKACQRSKRSLTQHLSRMEENTLAIIDQYKEKLNLVASHEQRLEDEHARVSAPQMEREARERVIEPLHGEAVKWKDRFSLTLNGSQELPRLLARAKAMADVYPSPKEVHGLLDYCQHMV

SEQ ID NO: 115543 - protein, 123 aa, Glycine max
  Coding DNA Sequence Number=SeqID_23858
  Homolog annotation: Hit_ID=A0ST23; Match level="QueryCoverage=21%, HitCoverage=53%, E-value=1e-07, Identity=100%"; Hit description =Putative reverse transcriptase
MEMTLVRANIEEDTKAVHDGFTNKISFQHHDQKIIHKPLSLREEIKDVFPKEIPHGLPPSRRSSLSIPSTSRGGPVPAFVPFSEVGKPVVPAALMNRPTRGERRFAYWALAECILAYYVGTDE

SEQ ID NO: 115544 - protein, 81 aa, Glycine max
  Coding DNA Sequence Number=SeqID_23859
  Homolog annotation: Hit_ID=A0ST23; Match level="QueryCoverage=33%, HitCoverage=55%, E-value=2e-08, Identity=100%"; Hit description =Putative reverse transcriptase
MAKFDPEIVLEFYAIKLIDTVDLEGGPVGKPVVPAALMNRPTRGERRFAYWALAECILAYYVGTDEGVSEVLHVAGEKRLH

SEQ ID NO: 115545 - protein, 108 aa, Glycine max
  Coding DNA Sequence Number=SeqID_23860
SEENFKLLVRLSPMVQKSCYVERHNGVIPHKKQIYYSMDANKRSYAPRQQQQQTVNVGYAISLLGFSQKTYYKIVLETYVVICGAMNNDDHAATRLCETEVTIKEEIE

SEQ ID NO: 115546 - protein, 207 aa, Glycine max
  Coding DNA Sequence Number=SeqID_23861
  Homolog annotation: Hit_ID=Q84VH5; Match level="QueryCoverage=81%, HitCoverage=29%, E-value=5e-82, Identity=82%"; Hit description =Envelope-like protein
MGIAVSEHQIAKEITAKQVQHWPKKGKLSAGKLSVKYAILHRIGAANWVPTNHTSTVATESFAVKLPIAFPTVLCGILLSQHPNILNYTDSVMKRESPLSLHYKLFEGTHVPDIVSTSGKDASGAVSKDALIVELKDTCKVLEATIKATTEKKMELERLIKRLSESGIDDGEAAEEEEAAEEEEEEADDEDAAEDTESDDDDSEATP

SEQ ID NO: 115547 - protein, 145 aa, Glycine max
  Coding DNA Sequence Number=SeqID_23862
  Homolog annotation: Hit_ID=UPI00006A2D9E; Match level="QueryCoverage =66%, HitCoverage=78%, E-value=6e-10, Identity=20%"; Hit description =UPI00006A2D9E related cluster
GRTPRFRGLDVLAFRGLPVLAIRGLHVSPSEGYTPSPSKGCMPSPLRGLHTLTIRGLHDLAFVGLHVLTFRGLHVLAFIELHALTFVGLHALTFRGLHALAFRGLHILAFRGLHVLTFRGPHALAFRGPHAFAFRGLHVLVASLN

SEQ ID NO: 115548 - protein, 118 aa, Glycine max
  Coding DNA Sequence Number=SeqID_23863
HFISKRPFRGNTGSNKDRKKSLKVYQSHTVRGEKVASAQDFGWQSKGEGHFGSWFPFFTVQILSGQGLTFSPWVKVYGKLGFWLKACRTAGHDICQGLASGSGMKGMSHIYSHDTHAQ

SEQ ID NO: 115549 - protein, 123 aa, Glycine max
  Coding DNA Sequence Number=SeqID_23864
RQVQGDAPQATDAPPPHQAGPAGSFDTEQYLRHLVHQQAANHWAHVQTHDCRYQMSLSLQSQGFTSFPCPTPDQYRAEVAWPGDWPEAQAGEAPAEAPDEADEAREDEEITDLLDFLGGSGAT

SEQ ID NO: 115550 - protein, 139 aa, Glycine max
  Coding DNA Sequence Number=SeqID_23865
MYQVGLCRHDIGKDRAHKTPSGPEEVQQGPGVSSSGYGPLSVIQGAHSPCKESLSQRHPVDPEKSNRALGFPALGSCLQDTQWTRRSPTGSWSCQALITGLCQFYGVPVTSSKGIRPPTNRAFIKKYCVSRQAQGETPQ

SEQ ID NO: 115551 - protein, 163 aa, Glycine max
  Coding DNA Sequence Number=SeqID_23866
MGDQEETQEHMKANMSALKEQMASMMEAILGMRQLMEKNAATAVAVSSAAEADPTLLATAHHPPSKIVGRGRDTLGHDGSSHLGYNRAAYPYGLPPNYSPPVLQDDAGHIASPVLEREPPQQSEEVHKDPQDYARRDVKFYPPIPEGPAPSTLPQPNIATQPI

SEQ ID NO: 115552 - protein, 137 aa, Glycine max
  Coding DNA Sequence Number=SeqID_23867
MAKGARKNIICLRISSGSPPLHDKRCRRSIICLYVTSDSIISGWRKGVRMTIICLHMSSGMPPLDDKRFEMTINCLCVRITIICLRMSSGSPPPDDKMCRMTIICLCVPPDSIVSRWDKGVRNHILSPHVIGHVTST

SEQ ID NO: 115553 - protein, 151 aa, Glycine max
  Coding DNA Sequence Number=SeqID_23868
MAKFDPEIVLEFYANAWPIEERVRDMRSWVRGQWIPFEADALSQFLGDPLVLEEGQQCEFSQRRNRADGFDEEAIAQLLCTPRQVRIMRTNMTTLTQTWMTLLLSNVLPRDHNSDLPLPKCQLVYAILTLMSVPRGPGMPQLGTLLDQDKV

SEQ ID NO: 115554 - protein, 139 aa, Glycine max
  Coding DNA Sequence Number=SeqID_23869
  Homolog annotation: Hit_ID=A5C365; Match level="QueryCoverage=84%, HitCoverage=15%, E-value=3e-08, Identity=27%"; Hit description =Putative uncharacterized protein
ALASIATPLGLEFIPQVKKLLDEGLVRKSLNPCALLVPKIGIIRHQVPKIGGMMNVLSGATLFCKITRTPNIFMVDQGVPMNPKRIKVIPEWPTPPSIRKIWGIHDLTNFYKSTLIELVRNYVSFMERCPERVSDLTLL

SEQ ID NO: 115555 - protein, 267 aa, Glycine max
  Coding DNA Sequence Number=SeqID_23870
  Homolog annotation: Hit_ID=Q6WAY4; Match level="QueryCoverage=30%, HitCoverage=15%, E-value=9e-11, Identity=40%"; Hit description =Putative uncharacterized protein
MGSSQKHPLKKRFNQVKIKSLEVTSLRELGQLMGQLQRQAFRKAYGKVWDLARVEVSMEPIASLSQYYDQPLRCFTFEDFQLVPTMKEFEEILGCPLGGRKPYLFSGFYPSTTRVAKYQGSVGGKGKGLGKSSEWLSFIDILAFLSLELSSFRIWKGSGLAAMDAFLAFIMARKARSSPFWPCMTRSTGDVKRATQELFVVHWLSMCGWFHTFFLQEGRPVYSLQGVKNFPIASQGQSSGEHLLRPRGDPRTSQLFSAYDRLNGPYD

SEQ ID NO: 115556 - protein, 195 aa, Glycine max
  Coding DNA Sequence Number=SeqID_23871
MEFGDIPVHFNILDAMKYPSEDLSVFRAEIIDHVVDEYMTDLYSNLHASHSSCIESEIVLDHMSEFDAESESESDIDCMPGGGVLPLEIDFIESDRTNHVSEKSSTSLLFHSLQSSFQQKNEAEKDCCQKSIRGYRLDPGGHSLHEEGRNVSKLDCKRKFVPPRIHEKCKDPGPLQSTDVVIHLANRSVSYPVVS

SEQ ID NO: 115557 - protein, 136 aa, Glycine max
  Coding DNA Sequence Number=SeqID_23872
  Gene Ontology: Mol. function=helicase activity; Biological process =viral genome replication
  Homolog annotation: Hit_ID=Q9ZQR0; Match level="QueryCoverage=66%, HitCoverage=7%, E-value=7e-19, Identity=53%"; Hit description =Putative helicase
  Pfam annotation: Domain name=DUF889; Domain location=1-136; Score= -57.5; E_value=1.4e-07; Accession=PF05970.5; Description=Eukaryotic protein of unknown function (DUF889)
MAKSPSQMSFLSRTLKILSRQLFKQHIQIYLITIATKISCKKKDVVASTKHVVDKINDYALSLIPSEEKEYCSADSIDKSDELLNPAFGVLTPEFLNSLKTSGIPNHKLKIKVGTPIILLWNLDNVDGLCNRTRLM

SEQ ID NO: 115558 - protein, 126 aa, Glycine max
  Coding DNA Sequence Number=SeqID_23873
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q8HT11; Match level="QueryCoverage=42%, HitCoverage=13%, E-value=6e-24, Identity=96%"; Hit description =Photosystem II CP43 protein
MVGFHSVYFIWMGIGANIRAFNPNLLQGSSVQLVWSGERLLGSYSLGSAQGPTGLGKYLMLPEEKFYHVETLFNGTLALTGRDQETTGFAWWAGNARLINLSGKLLGAHVAHAGLIVFLGRSNEPF

SEQ ID NO: 115559 - protein, 111 aa, Glycine max
  Coding DNA Sequence Number=SeqID_23874
  Gene Ontology: Mol. function=lactoylglutathione lyase activity
  Homolog annotation: Hit_ID=Q11SM8; Match level="QueryCoverage=98%, HitCoverage=98%, E-value=8e-37, Identity=58%"; Hit description =Putative uncharacterized protein
  Pfam annotation: Domain name=Glyoxalase; Domain location=1-100; Score= 12.0; E_value=0.0075; Accession=PF00903.16; Description =GlyoxalaseBleomycin resistance proteinDioxygenase superfamily
MMEQIFINLAVADVNKSMDFYTQLGFKNNPQFSDEQEKPLADTKKQIAGLFSLSVSSLDRVNEIVEKGLKAGGIEPSPMKDYGFMQQRNIEDHDGHTWEIFYMDMSKLPNA

SEQ ID NO: 115560 - protein, 102 aa, Glycine max
  Coding DNA Sequence Number=SeqID_23875
  Subcellular localization annotation: CTP_CleavageSite=73; ConfidenceScore=5.41e-01
MCSRLVPLFPSQLEFIVATPQSSAKFVTAILFLASPLGLLFKGSWSLSSFRMCVAATLNFSLAIFAFPNSLLRAWTSSSSSGASKLSSLTTFNLASQSKPRI

SEQ ID NO: 115561 - protein, 49 aa, Glycine max
  Coding DNA Sequence Number=SeqID_23876
MEKMKKQQWKRSFYGGWIFELQLGPLMVVFHHGDAAEDKGEEVRGGAIH

SEQ ID NO: 115562 - protein, 264 aa, Glycine max
  Coding DNA Sequence Number=SeqID_23877
MRATGRVPFAIQAAQLLGRAIGAGLFAITPAGERGMCCKAIKLGNARGELELHRGGGRSRTSGSPGLQEFDVRLHDGQHRLYLCSPSAEILAFTTPAVAIFKPVSKGRAMVHRTPVQHDEGDESDDLPQRRCKKSTTDDPPPSLSGTDVASRIRPIIYSFERYELARVPAALGVADATQLSFLFLCLGMSFGTGMKGAGWVTAREAIRTAGTGDYTTFRNAVAGAIGNRQAYVAANAASRLSSLSIPSTSRGGPVPAFVPFSEG

SEQ ID NO: 115563 - protein, 48 aa, Glycine max
  Coding DNA Sequence Number=SeqID_23878
MVIEISQRTTLNLTKCVWVCIYSQAPHVRVDMRRIFRLKLREKRGNEE

SEQ ID NO: 115564 - protein, 105 aa, Glycine max
  Coding DNA Sequence Number=SeqID_23879
MQRLLRENNEELYERIERLENRERHEEERRGGNGGGPRPNRIEGVKLNIPPFKGKSDPEAYLEWELKIEHIFSCVSIKCSKPAYRSNPQETKEIQRQVEDSLVGM

SEQ ID NO: 115565 - protein, 85 aa, Glycine max
  Coding DNA Sequence Number=SeqID_23880
MLKTEEPPKNERRTDEKRWKIFHEIAHRKHPGKALWNESLKKREVVAAQLAQASWVTSLAPTYSSRVRNTYVAFFENPWKVQVAG

SEQ ID NO: 115566 - protein, 53 aa, Glycine max
  Coding DNA Sequence Number=SeqID_23881
  Subcellular localization annotation: CTP_CleavageSite=22; ConfidenceScore=5.00e-01
LSLAHQWAKRASTAKRNYSVLSATEESGQASISRSRAKREISVLSAVVVFSQA

SEQ ID NO: 115567 - protein, 103 aa, Glycine max
  Coding DNA Sequence Number=SeqID_23882
MGPSRGFWAFSCLRWKQPSSPRRASNFEILNWAFQNIFRCWIAYGGSNPAFLGELGGNLLPLFPINRLKEAVLRIPEPPGYVFQLLWVKKIISVKKIQAEVLP

SEQ ID NO: 115568 - protein, 125 aa, Glycine max
  Coding DNA Sequence Number=SeqID_23883
  Pfam annotation: Domain name=G-patch; Domain location=1-37; Score =20.5; E_value=0.00063; Accession=PF01585.14; Description=G-patch domain
MLGNGYEPGMGLGKDNGGITSLISAKGNRRKFGLGYKPTQADIKKGITGRKSGGQGSRLGQEVKGGPPCHISRSFISTGLGHEGQVVGYVKMIRQVGRSWYDHALLVSDKEIGEWRNARTFTQQA

SEQ ID NO: 115569 - protein, 29 aa, Glycine max
  Coding DNA Sequence Number=SeqID_23884
MASMDTSAKVNSKIFPTSCRFDLFPCLLK

SEQ ID NO: 115570 - protein, 94 aa, Glycine max
  Coding DNA Sequence Number=SeqID_23885
SWIRSLSTRPPSAERPVVHVDPATGKADSPHRKKLRTYLGIVAHDKVDITYENWKEAPTAKKDLIWEDIQAEFDILEASDSRTKREVTSDRGKR

SEQ ID NO: 115571 - protein, 695 aa, Glycine max
  Coding DNA Sequence Number=SeqID_23886
GAPFAFADVDVVGAHVVGGLQAFAPGAQVQLQQRAGADRARHIQVEADRLVDMALAARVLAHAGELVDLVGTLLVVRPGFQRQARSRHRPPEVLLFLVVERAVDRVDRRGGTGNLRGAHVRRDGQQPAVAQAVRGDLAGQAVPRGAAVVAVTEVTPVVPVAAREHRVAALLLRQLRAGLDGQEVDALVETVVPTERAQADGAVLAVGDGGLRHRQRVEVNHVVEHAHLDRDQALQHVGGQQVIRRTDCPAEVDRGQVADHEVTGAARGDDLVAADDLLDHPRRAHVLQDLGAQVAGIDHARVLVRVPAVDLVAVEQERIAGLQLAEHDPLEQIDRLHRAAADALVGHQFGIAVAEAARTARLIVEVLQVPALGLLHLVRVEQVPVGAALDRFHEQALVAVVEAQVHERFDVAVPDVQVHRHRALALAKLINRHRGVVELLDPRHHATGGIGHAPDRRAAAAHIAQAVVHRVDEAAGQLPTHLAGIGQGRCVDGHVQVGQRPVRLADQLHAPLARLFFLHEVQAVVGEQAVALRVDHLAGLLQLFLRIAAQDVVAVDAAVSQAFLQANVGAVLQADIVEAVAAGTLVQAAQVDARGKLFPLGCNQVHPRFGLTDQQIDQVVGADARFALDHRLHHAAIVAHVQLRELGMHGVDAALQALGLERQAAVAGLLGDPGRHALATGAQGVAGAGQIGHAE

SEQ ID NO: 115572 - protein, 112 aa, Glycine max
  Coding DNA Sequence Number=SeqID_23887
MTGRRARFEFAHHGGRPYFLNLCLPYLRLDDSLLEAGWGRRVHLSNNAGSGNCNRIGFHYLLHAHHGLHHCGHFLFNVLHVGLHLGVGVSSTSPITLALAQVRKECNEQCNQ

SEQ ID NO: 115573 - protein, 102 aa, Glycine max
  Coding DNA Sequence Number=SeqID_23888
  Subcellular localization annotation: CTP_CleavageSite=36; ConfidenceScore=5.17e-01
MAFLGETSSQTVVNSTLGFIFPNGSIVHNDSGVSFQASTLVPIRVPNGCDFQTLKTRIHNTLKLTNKQFLDEIYYQQPFTYAAHRTCLRKMTISDSFTVGSS

SEQ ID NO: 115574 - protein, 276 aa, Glycine max
  Coding DNA Sequence Number=SeqID_23889
MAPKKLSAKRSRRDTAAEGTSAAPEFDSHHFRSVEHQQRFEAIKEWLFHRERRVQLRDDEYTDFQEEIAHRRWTLLVTPMAKFDPDIVLEFYANAWPTEEGVRDMRSWVRGQWIPFDADALNQFRADGFDEEAITQLLCVPGQDFAWTAAGRRVRIMRSSMTTLTQMWMTLLLSNVLPSDHNSNLPLPKFQLVYAILTRMNVHVAQLIANAIYLFAGMPPTRHRLDPDKSNRALGFPALITGLCQSFGVPVTPCKVIRPSVTLAFIEKYCMPRQAQ

SEQ ID NO: 115575 - protein, 149 aa, Glycine max
  Coding DNA Sequence Number=SeqID_23890
  Homolog annotation: Hit_ID=A9XTL4; Match level="QueryCoverage=46%, HitCoverage=16%, E-value=2e-10, Identity=52%"; Hit description =Fasciclin-like arabinogalactan protein 9
MILLTMGIVALNYPSHDMVPWSRLRYDNLKRCWLYGPWVLAASRSTFHALTALSQSTLASFRAQLRRPCYPVAIFGVSKVLLPREILGRNPIVSAKPLDNAPPPDDDALSPENSSGFDGQPSQLSSPPGFREDVRSHAGGSIFCCGVLF

SEQ ID NO: 115576 - protein, 157 aa, Glycine max
  Coding DNA Sequence Number=SeqID_23891
  Subcellular localization annotation: CTP_CleavageSite=28; ConfidenceScore=5.75e-01
MASPPASPPLPPPPSPPPHPPSSDASVSPSTVKRTRKASLVNVDPATSKVDGPHRKKLRTYLGIVARDKVDVMYENWKEVPTAQKDLIWEDIQAEFEIPKASESRTKKKLLKTVADQNSVDDTVYEKYNISKEKWAQFCHTRRDPSWEDVQKKARAI

SEQ ID NO: 115577 - protein, 212 aa, Glycine max
  Coding DNA Sequence Number=SeqID_23892
MSHHSSSVNGEGTSHKDPLSRILDELSSLKLWKEKLERKEKGKERVKINQDEREQISEEERRKILKELRKEKHASYSSHNPCKSLSEELRDYYEGRHRSHLRPHSHRREKERKPQEANINLPYFHGKDNVKANLDWEIRVEQQLKRKSTSKSYGSHSYPKKDQGQGILGVTPSKPKDDKGNTIEKQPLKDSMQEKTSSMKCFKCLGRGHVTS

SEQ ID NO: 115578 - protein, 123 aa, Glycine max
  Coding DNA Sequence Number=SeqID_23893
EFVEMDDLLHKAIQVEQQLKRKGVDKRSFTNFGSSSWKDKGKKDRAATSSSSTPIPSKTRSKSQEEPSKWSRDGSYHQPSDEDTTKGKDHEALEGPKTRGRLKQAQQVIETRLVICIAAIDDD

SEQ ID NO: 115579 - protein, 114 aa, Glycine max
  Coding DNA Sequence Number=SeqID_23894
MTCDHSLVLVRCLAPIIRQLVKFQDMPKNQKNIDAQSHPGPLGPSGIFLQKAVASGGSNPARLGELSSPGRAGRQPPPYFAINRGGVQEGRGSAPEALFSLSNLLGKIVSVKKI

SEQ ID NO: 115580 - protein, 182 aa, Glycine max
  Coding DNA Sequence Number=SeqID_23895
  Gene Ontology: Biological process=transposition, DNA-mediated
  Homolog annotation: Hit_ID=Q1J7G7; Match level="QueryCoverage=20%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLGCKYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 115581 - protein, 45 aa, Glycine max
  Coding DNA Sequence Number=SeqID_23896
MARKRVFNPYRVEERINEFQEPLDLRSNPFQGGGNDAILPPKGIG

SEQ ID NO: 115582 - protein, 97 aa, Glycine max
  Coding DNA Sequence Number=SeqID_23897
MDSGRFQVSVPGNSYPHEGFYLLWNARGVAGGDTEGLPKCFQGVYHQLLALQWHIRAKTRSRLDCGGEFHVSLPRFKRHVHDQFGVAGSQWVQEWSY

SEQ ID NO: 115583 - protein, 93 aa, Glycine max
  Coding DNA Sequence Number=SeqID_23898
IYISGCYSIDLVGCPLCGKIEWLKSLNIFEGMFRIFNSSMVFVLDGAHVHTLYVVYVHGGEVRHLVGNSLVAQADHRRGGVTVHDWVTLTITT

SEQ ID NO: 115584 - protein, 75 aa, Glycine max
  Coding DNA Sequence Number=SeqID_23899
MTSKIILMMPKNQELSKFQRTRLQQSSLKESRFKIQEQSGSRFKTQEKLISRFKRRNQEAIDKISQGKYFSKIQT

SEQ ID NO: 115585 - protein, 129 aa, Glycine max
  Coding DNA Sequence Number=SeqID_23900
MQTTTPNRVERPDRKTSSRLLTNYIDCNSSTNCITSSPREDYCDSGGYATTLATEQRLCDIPCWKYTHYSLLPSSPLYSVVSPGVPSYRYTAARSMGNSSRRKTQQRRHHHVTTILYNITLAERTNKGI

SEQ ID NO: 115586 - protein, 143 aa, Glycine max
  Coding DNA Sequence Number=SeqID_23901
  Homolog annotation: Hit_ID=A7QBD1; Match level="QueryCoverage=74%, HitCoverage=20%, E-value=9e-09, Identity=31%"; Hit description =Chromosome chr13 scaffold_74, whole genome shotgun sequence
YENDEDNRHDVGLEDEEEVDSKVQNDDDGGEFQHQIEGYNEKKKKAGHRKMSASDIMQVENYRKVGIRPPHMYATFTNQCGGYDKVGFIRKNMYNEVGRMRKQHTSDARGALKYLYDLRKKDPMMYVSYTVDGGSKTTTVVLV

SEQ ID NO: 115587 - protein, 54 aa, Glycine max
  Coding DNA Sequence Number=SeqID_23902
  Subcellular localization annotation: CTP_CleavageSite=18; ConfidenceScore=5.26e-01
MTSRILANSSWDSLKRSRKSALSKPPNTSSPNHFRPYLLYKVMSTPLKGIATIS

SEQ ID NO: 115588 - protein, 68 aa, Glycine max
  Coding DNA Sequence Number=SeqID_23903
MDPKRIKVIPEWPTPPSIREIWGFNILPNFYKRCRKKGIHEFQEPLDLRSNPFQGGGNDAILPPKGIG

SEQ ID NO: 115589 - protein, 77 aa, Glycine max
  Coding DNA Sequence Number=SeqID_23904
MPSKRVHLLGDCYTENKRGYISYGSVQVEGTSTWFFKENKEGYIPCGFLACKGFYKVEKKYQEPQVAWGLDVGTVYG

SEQ ID NO: 115590 - protein, 122 aa, Glycine max
  Coding DNA Sequence Number=SeqID_23905
MSSRMHCTLVSSFVIGSQKHTYSRVFHLYEILSSIGNQNCHSLGYGVEPSSCFYEKVHQVKLKHGSSHQPKLGQKMDRVTSLLRLVPNTFRTVDVLVTSSFTLTKVSQTMLKIKIDSISCPA

SEQ ID NO: 115591 - protein, 269 aa, Glycine max
  Coding DNA Sequence Number=SeqID_23906
MGQLQRQAFPKPMDFQLVPTVKEFEEILGCPLGGRKPYLFSGFYPSTTRVAKYQGSVWRKGQRPWQIKANGLSFSDILALLIFGVVLFPNMEGLVDLAVIDAFLAFHHGKESPVVAILTMPVYPLQGHRSCIEKGKANWDRLLASMEGRLLIGSLARRKEESGFYLHAKDVPSEECHQMKASRLSSHGVSVTTMRGYSKEFARHEMRREERTESLGEAVQALKAELERARVVEEKFKSIAIKLKPWNEEVKGIITGQRHDLEGRANGLP

SEQ ID NO: 115592 - protein, 336 aa, Glycine max
  Coding DNA Sequence Number=SeqID_23907
  Gene Ontology: Mol. function=transporter activity; Cellular component= outer membrane-bounded periplasmic space; Biological process=transport
  Homolog annotation: Hit_ID=Q5PFQ8; Match level="QueryCoverage=100%, HitCoverage=99%, E-value=1e-137, Identity=72%"; Hit description =Putative 2-aminoethylphosphonate-binding periplasmic protein precursor
  Pfam annotation: Domain name=SBP_bac_1; Domain location=5-278; Score =98.7; E_value=1.8e-26; Accession=PF01547.16; Description=Bacterial extracellular solute-binding protein
MKLSRLVVMTAIALGSAPAWAADAVVTVYSADGLHAGDHSWYQTQFDAFTQATGIKVQYVEGGSGAIVERLSKERSNPQADVLVTPPPFIQRAAAEKLLQDFTPQDAAQIADAQPQFVPLVNNYLSFIYNAKLLPQAPASYQQLLDAQFRNKLQYSTPGQAGDGTAVLLQAFHSFGSKDAGFDYLGKLQSNNVGPSASTGKLTALVNKGELLVANGDLQMNLAQMRSNPNVQVFWPAGPDGKRSTLALPYYVGLVQGAPQSANGKKLIDFLLSKEAQSSVSAMSYGMPVRKDVIPNDDNFKRSQAALEGVDIWAPDWNQVVSSLSADISRWHKVTE

SEQ ID NO: 115593 - protein, 191 aa, Glycine max
  Coding DNA Sequence Number=SeqID_23908
  Gene Ontology: Mol. function=structural molecule activity
  Homolog annotation: Hit_ID=A7PXX1; Match level="QueryCoverage=41%, HitCoverage=28%, E-value=1e-22, Identity=68%"; Hit description =Chromosome chr15 scaffold_37, whole genome shotgun sequence
ALVSLEGCNIGCHPINLSNLDGTWRLQYTSSSDVLILLQAVATFPFFQVGQIFQKFECCHQSNGGVIRYVVRWSIPNLLERVGAKSYHESVLDVISVPHHHDLTLKLHQVVDIDAIFPSTTNEVKVMIYADGGQFEKHWAIEKLRDMGSKFRTMRRWPEMVGLSMAIVDGGRLTVDGIVEKDKTNHKQKYG

SEQ ID NO: 115594 - protein, 264 aa, Glycine max
  Coding DNA Sequence Number=SeqID_23909
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GPGLPGINRDTRIYLFCESDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMSTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115595 - protein, 20 aa, Glycine max
  Coding DNA Sequence Number=SeqID_23910
MSQVYLSKEDRAQGRGIDLR

SEQ ID NO: 115596 - protein, 22 aa, Glycine max
  Coding DNA Sequence Number=SeqID_23911
MDEKPSTWEASLRSEEGSFLGK

SEQ ID NO: 115597 - protein, 65 aa, Glycine max
  Coding DNA Sequence Number=SeqID_23912
WNSQAGCLGTGRRHKGVAEPALNLLHQWSPLLLEDKWKQNGEGGKVGEDEWRERERRGTKFMPQM

SEQ ID NO: 115598 - protein, 285 aa, Glycine max
  Coding DNA Sequence Number=SeqID_23913
  Gene Ontology: Mol. function=RNA-directed DNA polymerase activity; Biological process=regulation of transcription, DNA-dependent
  Homolog annotation: Hit_ID=A5BCE5; Match level="QueryCoverage=49%, HitCoverage=35%, E-value=1e-18, Identity=39%"; Hit description =Putative uncharacterized protein
  Subcellular localization annotation: CTP_CleavageSite=83; ConfidenceScore=5.38e-01
MPPKVSSSSGRGGRSSTKGKEVLLALPEPITKKATTTSSGSPTQTGSSTHKGKLEGSLTQTTTIKSESSTQESPKPTTSKQTVADYAWSIQTLLALEDIGLTKIPKLAKKTWAEMASESDDDSETDLQKQIQKAKQTKIVCNQKPSQSLTKQESTPQPGNSYISKNKFFNVLQMEPEYWDKNPFKATAKAFPPGFHYKPIATNKTRKFYEFILIDTNSVSIKHFKDPKDPNLNTHSTIQILKVMQPRHYGSNLNQPKKFSAPFDPAGYNYWDYIDAWTNVFWHQN

SEQ ID NO: 115599 - protein, 312 aa, Glycine max
  Coding DNA Sequence Number=SeqID_23914
  Homolog annotation: Hit_ID=Q2HW90; Match level="QueryCoverage=70%, HitCoverage=44%, E-value=7e-19, Identity=29%"; Hit description =Putative uncharacterized protein
MGLSQKPSFKKRFYQVKIKSLEVTSLRKLGQLMGQLQRQAFCKAYGKIWDLARVEVSTESIAPCPVYDHPLRCFTFGDFQLSLMVEEFEEILGCPLGGRKPYLFSGFYPSLARISKIFQILAKELDHQKQVENGVVGIPRKCLEAKARILAGRNEWAPFIDVLALLIFGGVLFSNVDGLVDLAAIDAFLAYHNHKESPVVAMLADLYDTFDRGCEKSSARNVCCALALYVWLVSHLFLQEGRPVYPLQGHRSCVEKGKANWDQLLASMEGRLLIGSLARRKEELGLYLHAKDVQMFPGWEHGVVLIIILCSP

SEQ ID NO: 115600 - protein, 78 aa, Glycine max
  Coding DNA Sequence Number=SeqID_23915
  Pfam annotation: Domain name=Ins_element1; Domain location=10-71; Score=-23.7; E_value=0.028; Accession=PF03811.4; Description =Insertion element protein
DLPSQWLLFLSAVPPCSATDGVVRNGKSTAGHQRWQAAQLLGRAIGAGLFAITPAGERGMCCKAIKLGNARVFPVTTL

SEQ ID NO: 115601 - protein, 73 aa, Glycine max
  Coding DNA Sequence Number=SeqID_23916
MWLRMPPVSWDTVNKKWGGRQKQGFLAPVMPQFVMRNSLLLGILTTTGNTAYIKMEKITSKCTILTFQDDVPK

SEQ ID NO: 115602 - protein, 67 aa, Glycine max
  Coding DNA Sequence Number=SeqID_23917
VFSKQDCFWRKKIRSPGRAERQPPPHFPINRQKGVVLRVPDSPGYAFQLFWVKKIVSMKKIPAEELP

SEQ ID NO: 115603 - protein, 267 aa, Glycine max
  Coding DNA Sequence Number=SeqID_23918
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDFSFSFLDSLSFDPLLFIQTSPPSRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115604 - protein, 206 aa, Glycine max
  Coding DNA Sequence Number=SeqID_23919
MLKSFKQQEQMSVLELYIEKDVAGGSMFHSANSLTSCGNYLSNDETQPTTNMSNLHIDEDDDDDDDDYLVSNSYVEESLDEDDSVDGVSDTDDEVTNIPQPVRIVHPAEGAQRIENPFWNDAMHYNNINWSYPDEEEICGLELPSTFNIGQELYVGMEFDSKDAVKNAVKQYVMKVHQSFKVVESKSNKHDQRRSINKNFFDSRED

SEQ ID NO: 115605 - protein, 136 aa, Glycine max
  Coding DNA Sequence Number=SeqID_23920
  Pfam annotation: Domain name=Transposase_23; Domain location=51-121; Score=-3.7; E_value=0.003; Accession=PF03017.5; Description =TNP1ENSPM transposase
  Subcellular localization annotation: CTP_CleavageSite=34; ConfidenceScore=5.16e-01
MRQLMASFSQMQSQMQSQGLALPPEPLVGPSGARVSTKGSCVDLSGNDPEAGDSDRCGLYIEADHARLVALGRVYEGSTVVHNTPLLLGQVKVGVEEVTDANAPVHVPTDEVSLVGQAIHTFFAWSTHLVKSLSQQ

SEQ ID NO: 115606 - protein, 85 aa, Glycine max
  Coding DNA Sequence Number=SeqID_23921
MERLHEDYNVDLTLKNRSQNGIAKAGSRYLPVEDRRTMKNVEERSKTFAKFLTENVTETFRKRLGLDFLHGKFFQKFERDDLRTF

SEQ ID NO: 115607 - protein, 183 aa, Glycine max
  Coding DNA Sequence Number=SeqID_23922
  Gene Ontology: Mol. function=oxidoreductase activity, acting on single donors with incorporation of molecular oxygen, incorporation of two atoms of oxygen; Cellular component=nucleus; Biological process=regulation of ...
  Gene Ontology: Biological process=transcription, DNA-dependent
  Homolog annotation: Hit_ID=A3U6I6; Match level="QueryCoverage=89%, HitCoverage=56%, E-value=4e-37, Identity=42%"; Hit description=JmjC domain protein
  Pfam annotation: Domain name=JmjC; Domain location=21-132; Score= -9.6; E_value=0.0048; Accession=PF02373.13; Description=JmjC domain
MKSDIHYNDVTNGKILKWLPFMFFGGKGSITRSHVDIDMSHVFITQFQGIKKIWLFPWEQSSLMYKLPYNFHSLANIKEPDYQEFPALKYLNGYEAVIHPGETLYIPSGWWHYIQYETEGYSVSVRALPSNWLEKWRGFKNLVMIRHFDNAMRNLFKEKWFDFKVRKAHRKAKRAVARIPEIT

SEQ ID NO: 115608 - protein, 243 aa, Glycine max
  Coding DNA Sequence Number=SeqID_23923
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115609 - protein, 212 aa, Glycine max
  Coding DNA Sequence Number=SeqID_23924
  Gene Ontology: Biological process=transposition, DNA-mediated
  Homolog annotation: Hit_ID=Q1J7G7; Match level="QueryCoverage=19%, HitCoverage=71%, E-value=5e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDQAYRYRRPRGGARYQLLFPLVRVNFELGVIMVIAVSFGKPVVPAALMNRPTRGERRFAYWALAECILAYYVGTDEGEKKGCTGASAEYVIQDIFRFLAH

SEQ ID NO: 115610 - protein, 54 aa, Glycine max
  Coding DNA Sequence Number=SeqID_23925
MDGLVDLATINAFLAYHHSKESMVVAILADAYDTFDWRCEKNSARIVCCTPTLY

SEQ ID NO: 115611 - protein, 121 aa, Glycine max
  Coding DNA Sequence Number=SeqID_23926
  Homolog annotation: Hit_ID=A2Q142; Match level="QueryCoverage=86%, HitCoverage=37%, E-value=4e-08, Identity=36%"; Hit description =Ovarian tumour, otubain
APKKPMKRSQRSTKRDPPYWEYVDAFHSVQSNNSPVKRSASCSQPPQPTRIIPMLDQFASFFQGFIRDVVDVKADGNCGYRSIAALSGMGEDSWPLVRNELIKELGSRPTPLGNIGNILVS

SEQ ID NO: 115612 - protein, 230 aa, Glycine max
  Coding DNA Sequence Number=SeqID_23927
  Homolog annotation: Hit_ID=Q6UUU1; Match level="QueryCoverage=26%, HitCoverage=40%, E-value=3e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLVFPKVIKNTFKNEVIDFIHLIIDYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWRCQEDT

SEQ ID NO: 115613 - protein, 95 aa, Glycine max
  Coding DNA Sequence Number=SeqID_23928
  Gene Ontology: Mol. function=DNA-directed RNA polymerase activity; Cellular component=chloroplast; Biological process=transcription, DNA-dependent
  Homolog annotation: Hit_ID=A9QC62; Match level="QueryCoverage=72%, HitCoverage=6%, E-value=9e-11, Identity=52%"; Hit description=RNA polymerase beta subunit
  Pfam annotation: Domain name=RNA_pol_Rpb2_7; Domain location=27-89; Score=-3.2; E_value=0.00059; Accession=PF04560.11; Description=RNA polymerase Rpb2, domain 7
DDKYMDVPVDIMHLLHNNPLRGRAKQGGQRVGEMEVWALEGFGVALFTRDAYVINLTHMKSKQTGDLGGKLTPQMAKEFPRIPPKIDYYELYLAF

SEQ ID NO: 115614 - protein, 53 aa, Glycine max
  Coding DNA Sequence Number=SeqID_23929
MAQKYWKEQNFTHSEKKSEKAYITWDENDMESSESLALSTACLALVNYATKAI

SEQ ID NO: 115615 - protein, 83 aa, Glycine max
  Coding DNA Sequence Number=SeqID_23930
LGRIDGDPVLRETRIWATWEYMSSDGGGQQGMSGTWRYVAGVRRPWGRQVGCYCPKSKLDQSRPNPGIVLVSENLDVAKQASS

SEQ ID NO: 115616 - protein, 91 aa, Glycine max
  Coding DNA Sequence Number=SeqID_23931
MSGFTRNSPQISASPHQLDLAPYASEPYHAQWNAPGLLRDKHTLRSSRILGEMEVDEPWLGLWLPLNYQVDMGASQHRTLELGWCSPLEVR

SEQ ID NO: 115617 - protein, 216 aa, Glycine max
  Coding DNA Sequence Number=SeqID_23932
  Gene Ontology: Biological process=transposition, DNA-mediated
  Homolog annotation: Hit_ID=Q1J7G7; Match level="QueryCoverage=13%, HitCoverage=42%, E-value=5e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLCNLDLIIDEGASFRNIKLIDTVDLEGGPVGKPVVPAALMNRPTRGERRFAYWALAECILAYYVGTDEGVSEVLHVAGEKRLHRGNGLRTGGDFLEDARKILNREVRGRGKAVFP

SEQ ID NO: 115618 - protein, 120 aa, Glycine max
  Coding DNA Sequence Number=SeqID_23933
ERPKWRRAKAQVEKDKAPECRWMKAQVEKDEGPKFLSGFLVEPIIRLIKVILVASTLTYLPSPEVASTQTYLPSGSGVYPDLSSFTGSGVYPDLSSFTGSGVYPDLSSFTGSGVIQTSVA

SEQ ID NO: 115619 - protein, 228 aa, Glycine max
  Coding DNA Sequence Number=SeqID_23934
MTQELVARGDTLRLSAPRHSVTPSVIDEQRPIWSSALFPEMSTSSGGDFFKSHKLSRTTSTSIAFVGRPTRSVILTLRSCDTRRQNLVILHPFTIQTQSCPMARRDKIWSFCTLVSSRGGGPDDTRRHLTVIRTLVSSRGGGPDDTRRHLTVIRTLLSSRGGGPDDTRRHLTVIRTLVSSRGGGPDDTRRHLTVIRTLLSSRGGGPDDTQRQNLVILHPCVIWRRRAR

SEQ ID NO: 115620 - protein, 97 aa, Glycine max
  Coding DNA Sequence Number=SeqID_23935
MGSHPQRHSVDPEKSNRALGFPALVTGLYQSYRVPVPPRQGHVIIGIAPVVDPKKSNRVLELSSSNYGSLKGIRPPTNRAFIKKYCAPRRVQGETPQ

SEQ ID NO: 115621 - protein, 93 aa, Glycine max
  Coding DNA Sequence Number=SeqID_23936
  Subcellular localization annotation: CTP_CleavageSite=17; ConfidenceScore=5.36e-01
MDVWGANTFPARKYNSRAFHLKVRRSRLFRFFRRFPQINVGGDSTRIPFVEHASRESHVALPPKDFTPRTAPDDLSQAPTFEGQLPPHADYPL

SEQ ID NO: 115622 - protein, 125 aa, Glycine max
  Coding DNA Sequence Number=SeqID_23937
MRHRIPMIGGMMNMLSGATLFCKITYAPNIFMICVHKDSLGSDQGVPMNPKKIKLIPEWATPPSIRKIWGFHDLTNSYKRCRGKSPKFQEPRDLRSILFKGEGMMQSYPTKAFDRRLKVDWASDA

SEQ ID NO: 115623 - protein, 68 aa, Glycine max
  Coding DNA Sequence Number=SeqID_23938
MAATSANNAQPSYASTDIQAAMHTLSMAPPDDQWYMDTGATSHMTANGVIFGRPLCSAQVDIVIMLCS

SEQ ID NO: 115624 - protein, 278 aa, Glycine max
  Coding DNA Sequence Number=SeqID_23939
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIKATPLSIPKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115625 - protein, 72 aa, Glycine max
  Coding DNA Sequence Number=SeqID_23940
VDPWVLVPITLRGLYVLTIRGLHILACRGLHALAFRGLRVNIFSVLHIHTLGEYKVLCPWMLNQDLRSRLRG

SEQ ID NO: 115626 - protein, 57 aa, Glycine max
  Coding DNA Sequence Number=SeqID_23941
ENDRSPPAQVVAAQIRTLLYKHEGCTGLRTNHLDVILTSSVGPECVELISFVQRAIS

SEQ ID NO: 115627 - protein, 61 aa, Glycine max
  Coding DNA Sequence Number=SeqID_23942
  Subcellular localization annotation: CTP_CleavageSite=8; ConfidenceScore=5.10e-01
MVAAQLAQASKVASSRSNNFWRAQVGLLSKKLRKPTDCAKTPLFDFHHITEFHGSRKPASF

SEQ ID NO: 115628 - protein, 144 aa, Glycine max
  Coding DNA Sequence Number=SeqID_23943
MASRKLASKRSRKDKAAEGTSSAPEYDSHRFRSAEHQQRFEAIKGWSFLRERRVQIRDDEYTNFQEEIVCRRWASLVTPMAKFDPDIVLEFYANAWPTEEGVRDMRSWVRGQWIPFDADAISQLLGYPLVLEEGQECEYGQRRN

SEQ ID NO: 115629 - protein, 51 aa, Glycine max
  Coding DNA Sequence Number=SeqID_23944
MGIDYIKPRPIWALQKIPPEGGCFWRKQPCSPGRAELAWASWEATTSPILL

SEQ ID NO: 115630 - protein, 96 aa, Glycine max
  Coding DNA Sequence Number=SeqID_23945
MPISPCGRIAPTKTPSGPEEVQQGPGVSSSGYGPLSALQDARFPQQGVPVAPARSSGPPYQSSFHQKYCAPGRRRAKHHISIGMAGSGQQTHRHHL

SEQ ID NO: 115631 - protein, 120 aa, Glycine max
  Coding DNA Sequence Number=SeqID_23946
  Subcellular localization annotation: CTP_CleavageSite=66; ConfidenceScore=5.10e-01
MGIAPTKTPSGPGKVQQGPGVSSSGYGPLSVLQGARTPRQGHVIIGIAPARHPVDPKKSNRVLELSSSKYGSLSVQGSACCPQQGHQAPLPIEFSSRSVASPGRRRAKHHSSIGMAGSRQ

SEQ ID NO: 115632 - protein, 103 aa, Glycine max
  Coding DNA Sequence Number=SeqID_23947
  Gene Ontology: Mol. function=endonuclease activity
  Homolog annotation: Hit_ID=Q9AY32; Match level="QueryCoverage=38%, HitCoverage=60%, E-value=2e-13, Identity=95%"; Hit description=RRNA intron-encoded homing endonuclease
RKLGARRRSDTVLVSTINDADQGSADVAFRTPLAPYEKSKSLGSGGRHGGAAVLSGEERLVVRFRTNEVCECPGRCSGSRTRATLIVIQRVYEASLADRSGYL

SEQ ID NO: 115633 - protein, 178 aa, Glycine max
  Coding DNA Sequence Number=SeqID_23948
  Gene Ontology: Mol. function=aspartic-type endopeptidase activity; Cellular component=chromatin; Biological process=chromatin assembly or disassembly
  Homolog annotation: Hit_ID=A5ADH7; Match level="QueryCoverage=19%, HitCoverage=18%, E-value=3e-07, Identity=70%"; Hit description =Putative uncharacterized protein
MGRFVPRFHHRTAIIPRFHGDISGRRPIFQGGSFWCSSCPPYSIQGGRIIPRHGLTEIHVALQHRLRKAQEAMKTTADKHHHDVSFAVGDWVLERIEPVAYKLQLPVSSRIHPVFHISLLKLHQEPLPPSPAELSRANFNNHSLKILHGNCGMIYSRHNLEDKVVFGEGGVDSNNNTA

SEQ ID NO: 115634 - protein, 110 aa, Glycine max
  Coding DNA Sequence Number=SeqID_23949
  Homolog annotation: Hit_ID=UPI00016621D1; Match level="QueryCoverage =98%, HitCoverage=40%, E-value=7e-11, Identity=39%"; Hit description =UPI00016621D1 related cluster
LHVLAFRGLLALTFKGLHVLTFRGLRVLAFRGLLALTFRGLHILAFRGLHVLTFRGLHVLTFKGLHVLSFRGLHVLTLRGLHALAFRGLHVLTFRGLHALAFRGQDVLAF

SEQ ID NO: 115635 - protein, 161 aa, Glycine max
  Coding DNA Sequence Number=SeqID_23950
  Homolog annotation: Hit_ID=A5C7Z4; Match level="QueryCoverage=72%, HitCoverage=41%, E-value=4e-08, Identity=28%"; Hit description =Putative uncharacterized protein
MFGVFNLDFLLYIKHEDLSKIAHGGQCLSISMLQLWILGHWQMVVIVPKEHLVVWFCLLHNRPDNYLKGIIISALKGLDDAPQPKSKAPARWIVAKCNRQKGSTECGYYIMHWMSTIILGSFRNNWEAYFNDPRPLEPERLKALRIQWHIIISELELRARI

SEQ ID NO: 115636 - protein, 88 aa, Glycine max
  Coding DNA Sequence Number=SeqID_23951
MGVQIAPRPTWALWNIPPEGGEEVKKEGVQPLRHFLSFEFAWKIVSVKKSKPSASERFRNVFREEFRKGFDRSSTFFICSSSSSIFNG

SEQ ID NO: 115637 - protein, 114 aa, Glycine max
  Coding DNA Sequence Number=SeqID_23952
MILKFPTVRMFKIGLRTWYSNFTTSNGERVRDRCFSEIGLVGCEKKKEMNDIGIEKEERERERRRQFKVKMSLEEAHHHRRSWIRAWRKKEMNEGRGREEHEILCSKRALKSEI

SEQ ID NO: 115638 - protein, 179 aa, Glycine max
  Coding DNA Sequence Number=SeqID_23953
MEGLVDLAVIDAFLAFHHGKESPVIAILAMYDTFDRGCEKSGARIVCCALALYVWLVSHLFLQQGRPVYPLQRHRSRIKQGKANWDQLLASMEGRLGCINYNPGLAIRQHGYPMRGVPSDESITPLIIRGFSDYNAKVLQGVRKAWDAAAAIVSSSSEEVKGIITGQRHDLEGRAKGLP

SEQ ID NO: 115639 - protein, 70 aa, Glycine max
  Coding DNA Sequence Number=SeqID_23954
  Gene Ontology: Biological process=transposition, DNA-mediated
  Homolog annotation: Hit_ID=Q1J7G7; Match level="QueryCoverage=42%, HitCoverage=42%, E-value=2e-10, Identity=100%"; Hit description =Transposase
LAQGFPGINKGHQDLFILRSDLPSQWLLFLSAVPPVQLLTGWCVTAKAPPDISAGKCSGHAARNHHTRRA

SEQ ID NO: 115640 - protein, 137 aa, Glycine max
  Coding DNA Sequence Number=SeqID_23955
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MVIDYSFVNQFEKNVGYCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115641 - protein, 73 aa, Glycine max
  Coding DNA Sequence Number=SeqID_23956
HPLQASYPRLILGGEAPSSKAYSLVDGASPLLFLLCLPLHLHGGKSPLKDLIKAQRSSLHRSPTRKLPSLKLS

SEQ ID NO: 115642 - protein, 98 aa, Glycine max
  Coding DNA Sequence Number=SeqID_23957
MHDTFDQRCEKSGARIVCCTPALYVWLVLHLFLQEGRPVYPLQGHRSCIEKRKTNWDQLLASIEGRCRNLPFGGRATCDSRDACSTKGIRAESPPTFI

SEQ ID NO: 115643 - protein, 95 aa, Glycine max
  Coding DNA Sequence Number=SeqID_23958
MSSGSPPLDDKGVQNDHNLSLRAIGHDRRTERSQNDHNMSLSAIGHDRLWNCGEKGADDSNLSLLSSSMGLIDLLDEAVETNSSCFLHAKIEHAW

SEQ ID NO: 115644 - protein, 113 aa, Glycine max
  Coding DNA Sequence Number=SeqID_23959
MVIIVNAEARGYMSMNYYQYIDVVYTNEHILKAYSAQWWPLGNEAVIPPSDDAWTLIPDPTTIRAKDVVYKDTTDAIVLYNLTREIVNIEFLQPGGSTSSRAAATAVELQFAL

SEQ ID NO: 115645 - protein, 222 aa, Glycine max
  Coding DNA Sequence Number=SeqID_23960
MASGNRLPMLCNRLPGLEMGSGTFYVLKLCNSSLVSGNRLPMLCNRLLEEKSLEAHLLIACSGYETLCVAIVARSLVKESTPIFSSLQIMMAAQFIHDRVEMECLEGVWETLKGNARCRFRDTIRLMATSLRTVEWILPTPTPYLLVEPVQVIDVTSSEEDHEEEPEELLPEPVVDALDFLEGDEDPLPEVDSPEDVMSVSKADSTEESGPGGIATSGGSSS

SEQ ID NO: 115646 - protein, 272 aa, Glycine max
  Coding DNA Sequence Number=SeqID_23961
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDQGHTMLNGIPQDSSMIGTCAYHGGVMGHSIEHCRTLKHKLQGLIDTGWLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 115647 - protein, 64 aa, Glycine max
  Coding DNA Sequence Number=SeqID_23962
  Subcellular localization annotation: CTP_CleavageSite=25; ConfidenceScore=5.22e-01
MDSGRFQVSVPGPYNVPQWNAPGASSMTSTYCCMNQESYYTRSLKWRLRTLAGVMATNCLNPIE

SEQ ID NO: 115648 - protein, 64 aa, Glycine max
  Coding DNA Sequence Number=SeqID_23963
MRVPVSLTRSGYPRIIPSHHRRMILKKDEKADMLSLCSLDKTYTPGTNKGYGLNQPGKPCRHTH

SEQ ID NO: 115649 - protein, 112 aa, Glycine max
  Coding DNA Sequence Number=SeqID_23964
  Pfam annotation: Domain name=Transposase_23; Domain location=46-112; Score=-9.3; E_value=0.012; Accession=PF03017.5; Description =TNP1ENSPM transposase
PDVVPVAITDPITETSLPPEPEVGPSAARVSTKGSCVDPSSTVLETGDSNKCGLYIEDNPSRLVTLGRVYEGSTAVHNIPLLHGQVKVGVEEVKDAEAPVPIPTHEVILVGQ

SEQ ID NO: 115650 - protein, 269 aa, Glycine max
  Coding DNA Sequence Number=SeqID_23965
  Homolog annotation: Hit_ID=Q84VH5; Match level="QueryCoverage=100%, HitCoverage=48%, E-value=1e-109, Identity=67%"; Hit description =Envelope-like protein
SGRIKTMAQKKSTPITPTTSRRSKVAIPSKKRKEISSSDSDDDVELDVPDIKRTKTSGKKVPGNVPDAPLDNISFHSIGNAERWKFVYQRRLALERELGRAALDCKEIMDLIKAAGLLKTVTKGKCVRFSPAVINKYLGRPTEGVVDIAVSEHQIAKEITAKQVQHWPKKWKLSAGKLSVKYAILHRIGAANWVPTNHTSTVATESFAVKLPIAFPTVLCGIMLSQHPNILNNIDSVMKRESALSLHYKLFEGTHVPDIVSTSGKAAAS

SEQ ID NO: 115651 - protein, 75 aa, Glycine max
  Coding DNA Sequence Number=SeqID_23966
MGTNQIGKRFYKVKVKGLDTTSIKELGRLMEPLQMQAFRKIYGKILEDFQLVPTIEEFEEILGCPLGGRKPYLSS

SEQ ID NO: 115652 - protein, 100 aa, Glycine max
  Coding DNA Sequence Number=SeqID_23967
MASMIEPMLGMRQLIENNVATAAVVSSVAEADPTLPAIAHHPLPNAVGRERSTLGHISNPHLGYNRVAYPYGLPPNYTPPIKRDDAGHVPSPILEGEPPR

SEQ ID NO: 115653 - protein, 42 aa, Glycine max
  Coding DNA Sequence Number=SeqID_23968
MVGAGGSLNAFLFLLMELFHKDCHVQKEGCEYKPLWRAQYNG

SEQ ID NO: 115654 - protein, 177 aa, Glycine max
  Coding DNA Sequence Number=SeqID_23969
MWAFHTGRQIDWAHLVRYRMHKALRLNAPLPYPHLVTLFLQHFNIPLDSESYVPIKRSFLISAIVIASFGYRKEHDGSWVEKVLNPLMKKETYQLEKIALFFKGFWTGSMVFKPLLVKGLMLWNCKWTCDSMRWIQGSPRFVIIKNGEIVEASFMMMNQVDSSIFNDDKNDEKKPKE

SEQ ID NO: 115655 - protein, 76 aa, Glycine max
  Coding DNA Sequence Number=SeqID_23970
MALVRANIKEDSEDTMARFQNGLNPEIIDQIKRKSATRRNSPNTYNQNWANRSKKEGGNSFRPVATSRMESQQRPV

SEQ ID NO: 115656 - protein, 51 aa, Glycine max
  Coding DNA Sequence Number=SeqID_23971
MTIERQKGVRKENEGGACHPARPGELGCFPPSGELPGKPKWAWFLFTPPVY

SEQ ID NO: 115657 - protein, 42 aa, Glycine max
  Coding DNA Sequence Number=SeqID_23972
MDKSLKVGEDEWREWGRRSTKFCASNEPNNLKSSSRFSTKCA

SEQ ID NO: 115658 - protein, 131 aa, Glycine max
  Coding DNA Sequence Number=SeqID_23973
  Gene Ontology: Biological process=transposition, DNA-mediated
  Homolog annotation: Hit_ID=Q1J7G7; Match level="QueryCoverage=30%, HitCoverage=70%, E-value=9e-12, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPEFDMDYTDADKVMQSYPVRALDRRFQVDWAFFNSFDPIFLESSIQCPWG

SEQ ID NO: 115659 - protein, 133 aa, Glycine max
  Coding DNA Sequence Number=SeqID_23974
  Pfam annotation: Domain name=G-patch; Domain location=2-43; Score =15.4; E_value=0.0026; Accession=PF01585.14; Description=G-patch domain
MMVAWVMLGYGYEPRMGLGKNNGGRTSLVSTKGNHGKFGLGYKPMQAYIRKSISERKNRRLGSWLGQQAEGALPCHISRSFITADLRHKDQVAAICEDDSLRRSDLVRPCPPGFRLGNWRVEERPDVYATSIM

SEQ ID NO: 115660 - protein, 198 aa, Glycine max
  Coding DNA Sequence Number=SeqID_23975
MVLGVLRQFGMQQPIPESPSQPLNIHGITLKGKHDENWGQLFAPMIDQWNNCHAFRVDAYPRQEDLLIFNSDYMAEVAETLQYMVSPQGRNTWTVDDLVPYVEKIMILFEEQERITEPVPHGPASKCQFPAQAFHILQSIVETQGIGRRREAVEAKEYSQQMTERAMEYAYESGFFPPSCLFRGYRLGLMGYWLGLRA

SEQ ID NO: 115661 - protein, 111 aa, Glycine max
  Coding DNA Sequence Number=SeqID_23976
MASPMTCGGTVCLCAPFVNQGQTRPLTRRDLRHLLHILSSRDGKSDDMRAYGYPHCFSSRDGESDDMWGYRMVIRTFRQPGADMPVDAQRRTSSFAPFVNQGQASLLTRRD

SEQ ID NO: 115662 - protein, 355 aa, Glycine max
  Coding DNA Sequence Number=SeqID_23977
  Pfam annotation: Domain name=RRM_1; Domain location=57-127; Score =23.5; E_value=0.00079; Accession=PF00076.13; Description=RNA recognition motif. (a.k.a. RRM, RB
DNDYAEEENWTKVVSRRSMKVMQKSSLAGRQSQNLEIGDNNKHYRLNWRNNADITSFYFTHFPDEANEELLWRHFKNWGDVREVYIAKRLNKDGRRYGFMRFKGVSDAKGLEVRLDNIFINDCKLFVNLPRGGCQGDKRADEAQTPTILINPDEGGEYWCNETWVGMLKKVMEVETLEDRITWELGYNVRTKFLGDDMVLLPGMVVWLQLWGFLIQVWEMKNLRRAVAAIGDVIESDDDTEDRRRLDRARVLVRTPLPPLIRSEVIVRVGELEYRVWIVEETGFEGGSNRKGSSPSDGWSEMITSDDEGEVGDVLDDTNTNFSFSPELPNQKLSPSRTQRAEGGTDVRCCDLRPL

SEQ ID NO: 115663 - protein, 135 aa, Glycine max
  Coding DNA Sequence Number=SeqID_23978
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=3e-24, Identity=69%"; Hit description=LacZ protein
IDSFTRVLHGLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 115664 - protein, 335 aa, Glycine max
  Coding DNA Sequence Number=SeqID_23979
  Homolog annotation: Hit_ID=Q84VH5; Match level="QueryCoverage=100%, HitCoverage=55%, E-value=1e-131, Identity=68%"; Hit description =Envelope-like protein
RQQGVKIAENPSPATSPREVDTEMDKKIRGIVSSILKDASVPDAEKDVPTSSTPDVSVPDVNKDVPTSSAPNAEALPSPSEEESTEEEDQASEETPAPRAPGACSRLAPGIAERLQNRKRKTPLKRSGRIKTMAQKKSTPVTPATSRRSKGPEIWKKGAWKCPDAPLDNISFTPLAMLKSGNMCINRRLAVERELGRDALDCKETMDLIKAAGLLKTVTKLGDCYESLVREFIVNIPSDITNRKSDDYQKVFVRGKCVRFSPAVINKYLGRPTDGVVDITVSEHQIAKEITAKQIQHWPKKGKLSAGKLSVKYAILHRIGAANWVPTNHTSTVAT

SEQ ID NO: 115665 - protein, 58 aa, Glycine max
  Coding DNA Sequence Number=SeqID_23980
MRNSAVFYTCETRKSLRQKMPTSEKGADDHIGLCLSSGPTLEVRITVRYLRGLPALGH

SEQ ID NO: 115666 - protein, 104 aa, Glycine max
  Coding DNA Sequence Number=SeqID_23981
  Subcellular localization annotation: CTP_CleavageSite=92; ConfidenceScore=5.05e-01
DLRTYPLSSGSRVPSYPISCNSYTKKLQPLQRSDRTPNTTVVELDLRIGELELLGAAAGMVAFVLVANFCLPIPAHPRLFNSTVASSDAHARAQAVLNQVGRVE

SEQ ID NO: 115667 - protein, 218 aa, Glycine max
  Coding DNA Sequence Number=SeqID_23982
MGEVEEIQEKMKADIEAIKEKMATMMEAMMSVKKIMEANAVAIAATSVVAKVNLMSPSGINQMNHPTSDMSVPRTQYHHPPKFKVLDLDKYKGTTCPKNHLKDVLSEDGYQCNFDMVLDRMQLQNICKKGDGSFKEHAQKVEGSGGPGGTPNDGKGDDDRDGKFDHPTRTTEKTGANEEGEKEGETHAVTAIPIRPSFPPTQQYLYSANNKPSPYPPP

SEQ ID NO: 115668 - protein, 59 aa, Glycine max
  Coding DNA Sequence Number=SeqID_23983
MTKSKCKDPLEGLGGPMTRARARKAKEALQQVLSILFEYKPKFQGEKSKVLVRKLTKRS

SEQ ID NO: 115669 - protein, 45 aa, Glycine max
  Coding DNA Sequence Number=SeqID_23984
MSERGRGFGVIAAVLLLLLSHQRSSIGDGHTERGVREKVVTLASS

SEQ ID NO: 115670 - protein, 186 aa, Glycine max
  Coding DNA Sequence Number=SeqID_23985
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MWLQVGTNYLPPSWICWPSFGCKYWKFEKKREREKKEKSNSCSPGDPLVLERPPPGWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPTPSVAEQGGTADRNRSPLEHLKNTIIH

SEQ ID NO: 115671 - protein, 150 aa, Glycine max
  Coding DNA Sequence Number=SeqID_23986
MPPFSKYMPSTTVEEQEDDVYANRTNHDKGLWENIRTVMATPPMSPSQLENPPEVTLKRTRQSTRLRSLTSRRIDGPQAVVNINPATSRGSEPHKEIFHSYLGVVAREKIPIVHVNWNVVPNDLKTLIWKDILHKFDIPEGENAKKRRCQ

SEQ ID NO: 115672 - protein, 239 aa, Glycine max
  Coding DNA Sequence Number=SeqID_23987
RHRSHLRPHSHIRENERKPQEANIKLPYFHGKDNVEAYLDWEIRIEQKLKRKSTLKYYGSHSYPKKDQGLGILGAAPSKPKYDKGKTIEKQPPKASMQEKTSSINQDKATTSPSSSESEKAKGEEFSEEIYPLEEGQPLVVKEKCKEVSVSSKRLAKKETHFTIKTNIKETFPLDNLHISLCKKALASIATPLGLEFILNDRGVPMNPKRIKVIPEWPTPPSIRKIWSFHDLTNFYKRC

SEQ ID NO: 115673 - protein, 214 aa, Glycine max
  Coding DNA Sequence Number=SeqID_23988
  Homolog annotation: Hit_ID=A5AIE9; Match level="QueryCoverage=78%, HitCoverage=36%, E-value=4e-08, Identity=28%"; Hit description =Putative uncharacterized protein
  Subcellular localization annotation: CTP_CleavageSite=32; ConfidenceScore=5.21e-01
MAEPSKKQKGTSSRSQRHSRSQETPIPPSIPSGSLFSSEEQRIRYTNLFSSRSIIDPKFIDMEFFSNENFECFQAFENSNLIPFMSLKLPVYSELVKAFYSNLEIHEGILMSKIYGIKMVIRQSLFYDLTKLPSEGVPFEGALIDDWKFDFSVHDARRLVCTNQADMTGRLLAGSLAFESRILHYLIVRILLPKSLNLAQVSEEDLIVMWAFHK

SEQ ID NO: 115674 - protein, 62 aa, Glycine max
  Coding DNA Sequence Number=SeqID_23989
  Subcellular localization annotation: CTP_CleavageSite=43; ConfidenceScore=5.09e-01
MGVQIATRSTWAFQDVPPEGGCFRRKQPSSPGRDGKSWQRRFRIVSVGDFAKIFNRSSFFGG

SEQ ID NO: 115675 - protein, 90 aa, Glycine max
  Coding DNA Sequence Number=SeqID_23990
SIQSGAFAPTTLLGEITQTYVVLLMRESSDSFYCEGFSSKVRYDFEIPNGGNVPNWVANVILKFDDDPTVNDSEIVVFRRYVWWAAGKRK

SEQ ID NO: 115676 - protein, 275 aa, Glycine max
  Coding DNA Sequence Number=SeqID_23991
GYTPSPWVLVALTVERTTRPRLERTTRPHHQRVARPHLQRTTCPRLERATRPHLGGLHALTLKGLHVLASRGLHALTSRGLHLLALRGLHALTFRGLRVLIFSVLDIHTLKEFKGQLCEHNQRGKAITQLLCILRQDFTRAAAKRRRPQCQSPPAEVSVGLCRPDMGIAPTRHPVDPEKSNRALGFPALVTGLYQSYRVPVPPGKGSRLQDTQWTRRSPTGSWSCQALITGLYQFYGVPVTSSKGIRPPTDRAFIKKYCVPRQAQGETPQQHWDG

SEQ ID NO: 115677 - protein, 85 aa, Glycine max
  Coding DNA Sequence Number=SeqID_23992
MVAGNTTTKKPRENWSEEERRRVQYNLKAKNIITSTLGMDDYFRVSNCKNAKDMWDTLQNEYKCVEASFMMMNLVVLMMTKSPKE

SEQ ID NO: 115678 - protein, 86 aa, Glycine max
  Coding DNA Sequence Number=SeqID_23993
MQMKFIRMIHTDEVHPIMVRTRGLGRALSRVIGRALGREDHHDSDDVPQQQRPTTSARRQQEATPVVHDALDMTENVPAHGALAID

SEQ ID NO: 115679 - protein, 383 aa, Glycine max
  Coding DNA Sequence Number=SeqID_23994
  Gene Ontology: Mol. function=unfolded protein binding; Cellular component=plasma membrane; Biological process=response to stress
  Homolog annotation: Hit_ID=Q9ZFC6; Match level="QueryCoverage=96%, HitCoverage=57%, E-value=0.0, Identity=92%"; Hit description =Chaperone protein dnaK
  Pfam annotation: Domain name=HSP70; Domain location=4-383; Score =565.0; E_value=7.7e-167; Accession=PF00012.11; Description=Hsp70 protein
  Pfam annotation: Domain name=MreB_Mbl; Domain location=2-379; Score= -227.9; E_value=2.7e-05; Accession=PF06723.4; Description=MreBMbl protein
  Pfam module annotation: Pfam domain module=HSP70::MreB_Mbl; Domain location=4-383::2-379
MAKIIGIDLGTTNSCVAVMEGGKPRVIENAEGARTTPSIIAYQEDGEILVGAPAKRQAVTNPKNTLFAVKRLIGRRFDEKEVQKDIDLMPYTITKADNGDAWVEVRDKKQAPPQISAEVLRKMKKTAEDYLGEEVTEAVITVPAYFNDSQRQATKDAGRIAGLEVKRIINEPTAAALAFGLDKQEGDRKIAVYDLGGGTFDISIIEITEIDGEHQFEVLSTNGDTFLGGEDFDNRIIDFLADEFKKENGLDLRNDLLAKQRLKEAAEKAKIELSGAQQTEVNLPYITADATGPKHLVVKITRAKLESLVEDLIERTIAPCKTALKDAGVSPSDIADVILVGGQSRMPKVQEKVKEIFGKEPRKDVNPDEAVAVGAAIQGGVLK

SEQ ID NO: 115680 - protein, 252 aa, Glycine max
  Coding DNA Sequence Number=SeqID_23995
  Gene Ontology: Mol. function=carboxylesterase activity; Cellular component=cytoplasm; Biological process=biotin biosynthetic process
  Homolog annotation: Hit_ID=Q1GZA8; Match level="QueryCoverage=95%, HitCoverage=92%, E-value=1e-66, Identity=49%"; Hit description=BioH protein
  Pfam annotation: Domain name=Abhydrolase_1; Domain location=31-243; Score=83.5; E_value=6.7e-22; Accession=PF00561.11; Description =alphabeta hydrolase fold
  Pfam annotation: Domain name=Thioesterase; Domain location=5-245; Score=-17.8; E_value=0.00085; Accession=PF00975.11; Description =Thioesterase domain
  Pfam module annotation: Pfam domain module=Abhydrolase_1::Thioesterase ; Domain location=31-243::5-245
MGQGKPLVLLHGWGMNSAVWERITKRLSDNYRLFLVDLPGMGQSRPVYPYHLHSLAEAVAEEIPGVSSILGWSLGGLVAQQIALNQPDRVEKLILVGTNPCFVSKPDWSHGIDARHFEQFNERFAKDFNATLLNFLTLQCMHAKDARSTVRQLRIAFGAKPTPTQDSLNQALDILLQTDLREEVGRLFQPTLIIHGDRDTLAPVSAAHWLAMHLQRARLRVIAGAAHAPFLSHADAFCETVEAFMADESAEN

SEQ ID NO: 115681 - protein, 69 aa, Glycine max
  Coding DNA Sequence Number=SeqID_23996
MVILIFRQQGANEPVDAQRLTSSSARFVIQGQGVRWQAEIPYGRLHLSSTKANEFDGLLLSSSGDIQAR

SEQ ID NO: 115682 - protein, 67 aa, Glycine max
  Coding DNA Sequence Number=SeqID_23997
MLSIEEFLSQVAWPGVQPSPLGGGEVMEACLWNFYGGWIFEPQRGPSMVIFHHGDAAEGKREEERGD

SEQ ID NO: 115683 - protein, 89 aa, Glycine max
  Coding DNA Sequence Number=SeqID_23998
MSPVRKEAAYVCFFLSSKMSSVEKLTQQDPRNQIRIFFSLFRWGKAKREDFRKKASSADDLEVGRQDRYPMVWLVSMPASLRSIKGTVQ

SEQ ID NO: 115684 - protein, 116 aa, Glycine max
  Coding DNA Sequence Number=SeqID_23999
MVAGPRPTFSSQGRCRSHSPEPFVIREEAEETQVRQVAAATPERSIEATLEPFAQGEDIPSPQSAANPSTPLLEMPEDLATLVLAMDTSPPATPVLHLTDEEDVQTQDTYDQSQEL

SEQ ID NO: 115685 - protein, 157 aa, Glycine max
  Coding DNA Sequence Number=SeqID_24000
MIGERVCFYVGPILLKRQSFSVYQMLDLVFKGQEFFGGVVRGFPMVRASCVMIIPFWERMLVDLPGSYYGHLVGDEGRQEVFVHHWDRGEFWNWPWGKFLIALEPAPKWALPARRVVVGVGAWGASLWMGVGALGCAGAGLEEFPARAKKLGCCCAY

SEQ ID NO: 115686 - protein, 84 aa, Glycine max
  Coding DNA Sequence Number=SeqID_24001
MNIEESIHVTFDESNAILSRKNMLDDIAESLEQIHIHGQDSKGKGKGSNEDPPEEAKSNNELPKEWKASKDHPLTALLVISQKG

SEQ ID NO: 115687 - protein, 284 aa, Glycine max
  Coding DNA Sequence Number=SeqID_24002
  Homolog annotation: Hit_ID=A5ASR8; Match level="QueryCoverage=96%, HitCoverage=66%, E-value=2e-11, Identity=23%"; Hit description =Putative uncharacterized protein
MSLKLPHYPELVKVFYCNLKIQDDIISFEVHGIPMIIDQSLFFSLTHLPNQGAPFEGTIVDVWKFDYSSHDARRMVCNDQAEMTGRLLAGSLTFDNRIMHYIIVRILLPRSSNLAQASEEDLILMWAFLTGRQIDWAHLVRYRMHKALRANAPLPYPQLITLFLRHFQIPLDDEPFVQVKRSFAIGAGAVTSFGYRKDRNGQWLKKDALPPQDERTPSPPPQQDDSALMTEVLSELGGLRSYVGEHFDSLDTRFARMDIRLTQLEEDVGYIRQSFDLPPPPPPS

SEQ ID NO: 115688 - protein, 67 aa, Glycine max
  Coding DNA Sequence Number=SeqID_24003
MEGKGNSYKCFTQFGVLLIPIALKVVGPLLLDSNSSRYGTNPPSQFPIWQLISKETKRQAITKDQKK

SEQ ID NO: 115689 - protein, 438 aa, Glycine max
  Coding DNA Sequence Number=SeqID_24004
  Homolog annotation: Hit_ID=Q8FCR0; Match level="QueryCoverage=27%, HitCoverage=58%, E-value=6e-22, Identity=45%"; Hit description =Putative uncharacterized protein
GQQLRAVRRRRAVPGAAGDPAGGRAVDSGGADAAVAPVSASAAPSGGGAVDRLGPLCGHFADVEPVPAPAGQQRRQRAGTVDGADSGDAVDPDVPGRRERVSDHAVQRLVDVDRLHIRLLLARLFQRGELRNQHLRFEEVALALFQALLNHRLVPFQVEEMQVAIAFAQAVTIAFFQRRTHQQRHRIGALHGEDGVVQGRQPRGAIVVVQRVPGGHFVDVGARMQVIAVQHGGIGLAGDGAGYGGFAAAGYAHQDKYAAHQAAHRDDGFQHRPGFDGFHDAQVEVLLEQPEARIINVREDNAAGTDRNHHQLRADAGGGDQRGDDAAGGDRRHGGGTQRQTQRGGDRPGHQNRRNVAAFHQAGDVLLDAAVHQHLLEGAAAADDQQHHGDDFNRIGDGAHHFIHGAAAVQAEGEDSDQHGDQGRHHRVAEELGEAQQA

SEQ ID NO: 115690 - protein, 70 aa, Glycine max
  Coding DNA Sequence Number=SeqID_24005
MAYTHIPVKVENPDLAPYTSEPYNAQWNAPGLLRDKHTLRSSRILGEMETDFVVDLGMAFVDNWVVGKEE

SEQ ID NO: 115691 - protein, 132 aa, Glycine max
  Coding DNA Sequence Number=SeqID_24006
VTWHGVKVCLNQITAQFKRVHYAGKNPSRCGCVMRTTHGLPWLSEPQVTITKEIETISKRFEERDVCGKVILKSKLWEIAYLNVNSMCPLLEKVNTKGAKKKPMTKHQRSTKRDLSYWEYVDVEAKLHGESK

SEQ ID NO: 115692 - protein, 135 aa, Glycine max
  Coding DNA Sequence Number=SeqID_24007
  Gene Ontology: Mol. function=cytochrome-c oxidase activity; Cellular component=plasma membrane respiratory chain complex IV; Biological process=aerobic respiration
  Homolog annotation: Hit_ID=A8Z605; Match level="QueryCoverage=96%, HitCoverage=17%, E-value=1e-61, Identity=80%"; Hit description =Bifunctional; cytochrome c oxidase, cbb3-type, ccoN subunit/ccoO subunit
MLHIFNNLEVPLSFTGWKSYSAYAGVKDAIVQWWYGHNAVAFVLTTPVLGLMYYFLPKAADRPVFSYKLSIIHFWSLIFVYIWAGPHHLQYTALPAWAQAVGTGFSIMLIAPSWGGMLNGLLTLRGAWDKDLLKV

SEQ ID NO: 115693 - protein, 191 aa, Glycine max
  Coding DNA Sequence Number=SeqID_24008
MDLIENMVASDIAILRDRAHVPTKKSLLEFTSQDALLAYNKLLFKQLEALTETLRCAICGGAHNYGCCIPNEEPTHEVNYMGNQPRQNFNVCMSNHKSTESAIKNLEVQVGQLAKRLVDRPSSSFRANTEKNPKEECKAIMTMSRMAILVDEGRAKEKVEGYKQQSTAELALELVFDFVELEEVLEDEDDQ

SEQ ID NO: 115694 - protein, 73 aa, Glycine max
  Coding DNA Sequence Number=SeqID_24009
MVPSKENVKEGGIGAVCRNVPFCGRAKARLTGALSKGGKMRGVATNVYLWKTSGKPKETGQNENSKFGSCIYA

SEQ ID NO: 115695 - protein, 94 aa, Glycine max
  Coding DNA Sequence Number=SeqID_24010
  Gene Ontology: Mol. function=helicase activity; Biological process =viral genome replication
  Homolog annotation: Hit_ID=Q9C8B0; Match level="QueryCoverage=91%, HitCoverage=5%, E-value=3e-21, Identity=56%"; Hit description =Putative uncharacterized protein F10O5.11
MPADADSIRDIIVKTQNGELQRIHELHSSYLGLQYPLLFPYGEDGYRPDILHRSTSGSKKRKRNRLTMRDWFAYRLQSRSNEAQTLLHSRKLFQ

SEQ ID NO: 115696 - protein, 260 aa, Glycine max
  Coding DNA Sequence Number=SeqID_24011
  Homolog annotation: Hit_ID=UPI00016621D1; Match level="QueryCoverage =92%, HitCoverage=42%, E-value=2e-11, Identity=31%"; Hit description =UPI00016621D1 related cluster
HVLAFRGLHALTFRGLHVLTFRGLHALTFRGLHALAFVGLHVLGFRGLHVLTFRGLHVLTFRGLTLSSPSEGMSSPYRTPRPRLEGYVLTLEGYTPCLRRATLPSPLKTRLPSEGYMSSPSEGYTSSEGRTNRNVLPKEDYCALTFRGLHVLAFRRLHVLTFRGLHVLPFRGLHALAFIGLHALTFRGLHVLAFRGLHALTFRGLHVLTFRGLHALTFRGLHALAFVGLHVLGFRGLHILTFRWTTRLHLQRLHVLAFGG

SEQ ID NO: 115697 - protein, 224 aa, Glycine max
  Coding DNA Sequence Number=SeqID_24012
MLVGTLLCGFSYAMLAFDYTMLTLLISMTMLCVGEIWTLPFMSTITALRSGSNNKGAYMGLNGISFSIAFIVTPYVGTLIAEKLGFKVLWLGTGTLAALIAVAFYFIVPWISFFSSQIRDSAELISEVKIDAYKKPSSYLRSTKSVAVITQDLLSQNTPERLLESVNQIAGARMEERSPGSYRISVRGSWRSTKDRRVEIMVQLQEEPFFLKRDLRKIHQQIFQ

SEQ ID NO: 115698 - protein, 204 aa, Glycine max
  Coding DNA Sequence Number=SeqID_24013
MERSMIDAASGGALGDMTPAEARNLIEKMASNSQQFSARNDAIILRGVHEVAMDSSSSAKNKKLEGKLDALVNLVTQLAMNHKSAPVARQSGVNEQPEAYVANIYNRPPQQQNQQQQNNYDLSSNRYNPSWRSHSNLRWASPPQQQQSVPPFQNVAGPSKPYVPPPIQQQKLQQSQQRQQATEAHPQPSLEELVRQMTIQNMQF

SEQ ID NO: 115699 - protein, 65 aa, Glycine max
  Coding DNA Sequence Number=SeqID_24014
ASGGRTRRILLGKDRLEWIASRGAAQSAAAGMDHRIRCDLWCLHHNAQKPVVMLEKAILVTFNAG

SEQ ID NO: 115700 - protein, 50 aa, Glycine max
  Coding DNA Sequence Number=SeqID_24015
MGCPYQSTHVLSSRSNHLTGRDFYLGSKQRALSSRIVMCPAYTPLIRQIV

SEQ ID NO: 115701 - protein, 124 aa, Glycine max
  Coding DNA Sequence Number=SeqID_24016
MEVCGGYWWLWVMEKELGMLEVVLEERRIRNDVFPKLHEKQRLKHSSVYARGKGSIVDKCPVKRQTKFQEDPMVNEGWALFLPRQLHVDSLRNFIKRLPRGFFEKLFSRGFFEKLDPYLPIPLY

SEQ ID NO: 115702 - protein, 130 aa, Glycine max
  Coding DNA Sequence Number=SeqID_24017
  Homolog annotation: Hit_ID=Q5NRP4; Match level="QueryCoverage=61%, HitCoverage=5%, E-value=3e-07, Identity=31%"; Hit description =Putative gag-pol polyprotein, identical
  Pfam annotation: Domain name=zf-CCHC; Domain location=106-123; Score =22.6; E_value=0.00058; Accession=PF00098.14; Description=Zinc knuckle
MSHHSSSVNGEGRHRSHLRPHSHRREKERKPQEANIKLSYFHGKDNVEANLDWEIRVEQQLKKKSTSTSYGSHSYLKKDQGQGILGVTPSKPKDDKASMQEKSSSIKCFKCLGRGHITSQCPTTKTMIMR

SEQ ID NO: 115703 - protein, 80 aa, Glycine max
  Coding DNA Sequence Number=SeqID_24018
VMHTRRRCTGDILGISMRISQVQLNGLINYPNKIRYNPSMRGNETYFKSAQLFSIKGRQTQAMINSGSQYSEVLSDAMNS

SEQ ID NO: 115704 - protein, 132 aa, Glycine max
  Coding DNA Sequence Number=SeqID_24019
  Pfam annotation: Domain name=zf-CCHC; Domain location=43-60; Score =24.5; E_value=0.0003; Accession=PF00098.14; Description=Zinc knuckle
MDEYFRVSNCKSAKDMWDTLQVQQISKKQRKSKKRAEDSSSLPKCYECNQPRHLRVDCPSFKKRIERSEKKSFNDKKAKKPYITWEDNDMDSSKDSENEVVNLSLMAKNYESNEEVIDYRISVIHYRFNNLN

SEQ ID NO: 115705 - protein, 96 aa, Glycine max
  Coding DNA Sequence Number=SeqID_24020
  Subcellular localization annotation: CTP_CleavageSite=56; ConfidenceScore=5.15e-01
MVVELLLDSSLLEVASPLSLPSPFRFHSSFKKQRNPLMKKILGLQALMELTSFDFRALLSTKFRALLSLSLHSSPSSPSSIHGSYGGGASSRLISP

SEQ ID NO: 115706 - protein, 139 aa, Glycine max
  Coding DNA Sequence Number=SeqID_24021
  Homolog annotation: Hit_ID=A0ST23; Match level="QueryCoverage=28%, HitCoverage=95%, E-value=5e-12, Identity=76%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPECTNREVTCFNCQVGKPVVPAALMNRPTRGERRFAYWALFRFLAH

SEQ ID NO: 115707 - protein, 183 aa, Glycine max
  Coding DNA Sequence Number=SeqID_24022
  Gene Ontology: Mol. function=DNA helicase activity; Cellular component=alpha DNA polymerase:primase complex; Biological process =DNA replication
  Homolog annotation: Hit_ID=Q8FB22; Match level="QueryCoverage=100%, HitCoverage=38%, E-value=1e-95, Identity=98%"; Hit description =Replicative DNA helicase
  Pfam annotation: Domain name=DnaB_C; Domain location=8-183; Score =354.5; E_value=1.8e-103; Accession=PF03796.6; Description=DnaB-like helicase C terminal domain
LFQQPHDGVTGVNTGYDDLNKKTAGLQPSDLIIVAARPSMGKTTFAMNLVENAAMLQDKPVLIFSLEMPSEQIMMRSLASLSRVDQTRIRTGQLDDEDWARISGTMGILLEKRNIYIDDSSGLTPTEVRSRARRIAREHGGIGLIMIDYLQLMRVPSLSDNRTLEIAEISRSLKALAKELHVP

SEQ ID NO: 115708 - protein, 244 aa, Glycine max
  Coding DNA Sequence Number=SeqID_24023
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=34%, E-value=5e-66, Identity=75%"; Hit description=DNA -directed RNA polymerase subunit beta
  Pfam annotation: Domain name=RNA_pol_Rpb2_6; Domain location=1-185; Score=-24.4; E_value=2.3e-12; Accession=PF00562.19; Description=RNA polymerase Rpb2, domain 6
  Pfam annotation: Domain name=RNA_pol_Rpb2_7; Domain location=155-232; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-185::155-232
MTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGVEHYALVYTTTHLEERAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 115709 - protein, 70 aa, Glycine max
  Coding DNA Sequence Number=SeqID_24024
MAAQLIRDRVEMECLEGAWETLEGNTRCRFRGTIRFTATSLVHPDEPARTLQRTVTSSEEDPEEDLAGIL

SEQ ID NO: 115710 - protein, 257 aa, Glycine max
  Coding DNA Sequence Number=SeqID_24025
  Gene Ontology: Mol. function=ribonuclease P activity; Biological process=tRNA 5'-leader removal
  Homolog annotation: Hit_ID=A7PJ62; Match level="QueryCoverage=61%, HitCoverage=19%, E-value=2e-33, Identity=50%"; Hit description =Chromosome chr12 scaffold_18, whole genome shotgun sequence
MAYFSSWHYNILENYWQLKKHVPIEEEFVSQIRNSSILRNEDYFSSCAMLSLNVKDPRELPWKKTVVLVESISTKTPSDAEEKKYKEVAELGGILEENRDLSSLSRGLRPLVEDSYLSKEKHHERMVNFCLDDIHSGEANSSTKVQCSRCCPILLLKNDMKELTIGWSVILPLSWVKAFWIPLISNGGLGDGGFRIWGAFLSSLMGVGGAFLSSLMGVGGLGLGVAGWGWGDGDWGLGYRDWGLGIRVWGLGFVGVY

SEQ ID NO: 115711 - protein, 264 aa, Glycine max
  Coding DNA Sequence Number=SeqID_24026
  Homolog annotation: Hit_ID=A2Q5K6; Match level="QueryCoverage=62%, HitCoverage=24%, E-value=8e-15, Identity=29%"; Hit description =Ankyrin
MAEAHSISSPMVSNYKLSKHGADVFHDPSLYSTYLTCKCLLISLKAKEIDRSVTMMNDKSESKTEEMKGWRKVIENVGNWLANKNKDEWLKDMRGNPSLAATLISTLTFQTAINPPGGVRPAKESGHVLCPRSEDMLDGKNPCPGEAILAVVFPDKYFKFLLWNTICFVSSLAVCLLLVSGFPLNHRFFTWLLSIGMCLTITSLTLTYMVGAEMVTPYLIWSTTNTMFSKVIYIWITLLGLVTLVLFLRLFVWILIKCSDKRKR

SEQ ID NO: 115712 - protein, 630 aa, Glycine max
  Coding DNA Sequence Number=SeqID_24027
  Gene Ontology: Mol. function=protein binding; Cellular component =barrier septum; Biological process=positive regulation of translation
  Homolog annotation: Hit_ID=A7P6L1; Match level="QueryCoverage=92%, HitCoverage=99%, E-value=1e-152, Identity=51%"; Hit description =Chromosome chr9 scaffold_7, whole genome shotgun sequence
  Pfam annotation: Domain name=LsmAD; Domain location=260-329; Score =129.9; E_value=7.6e-36; Accession=PF06741.4; Description=LsmAD domain
  Pfam annotation: Domain name=PAM2; Domain location=520-537; Score =24.0; E_value=0.00055; Accession=PF07145.6; Description=Ataxin-2 C -terminal region
  Pfam module annotation: Pfam domain module=LsmAD::PAM2; Domain location=260-329::520-537
SFAALKDFGDVGSVAYEDGAAEFDVADRKRRMRAEQQVLGRLWVRMNLQQIGQPKSSNGYGHQKSEKEGATKSDNKLPSVKSNSSSRLAGVVTGNKGGGYGSPSHDRLVYLTTCLIGQHVEVQNLTFFTAYVIITVLLGIILKMARLTKAASLQGQGSGVEFVSEAPSKTLIIPANDLAQVIAKDVAVSRDGLPSESHYDMHHEIMVDSVISQSCHVETGRELQRWVPDEDDQQCPELENIFDGPWNRGWDQFETNEMLFGVKSTFNEDFYTTKLEIGPQTRELEKQALRIAREIEGEETQDLHLAEERGLYHNFDIDEETRFSSVYRGKGVDDSGYDENEDRLLDSHNSETFDNIYGLVNKSPGEASGRKGSNGAQTWSNFSSVNHSELSQSSSGVDLCRSGSKDHAKQLSSELPALSCSFSDGESSADLQSSLKLKKDGSDEGGLSTNVALCAPSTRILSKTPKETGSVGESKSVISRGRLGRSLGSDYVAATSGPGLSPSSSVGSLSSEKSTLNPNAKEFRLNPNAKSFIPSQSHARPRSPMSDGSFYFPATVSTIPNMPAMSMGIGVGTTFAGPQPVVYNPQAAQMPSQPYFHPNGPQYGQLLGHPRQVLYMPSYLPEMPYKGRDH

SEQ ID NO: 115713 - protein, 431 aa, Glycine max
  Coding DNA Sequence Number=SeqID_24028
  Homolog annotation: Hit_ID=A5AXI3; Match level="QueryCoverage=100%, HitCoverage=100%, E-value=1e-82, Identity=46%"; Hit description =Putative uncharacterized protein
MDKWDNKPSRKQHHRENPSFSSTLLDVIYRSIDEDPTEEKEEAQLIFYRETMRKQKQGNCFREEKPEAEKHNSRRARKVENWMEKRASEKVLMGRNSLTEFERRTRSNSISNTLSMYSSSTSSESSSVGGFSSSESESFYYGVQRPKPIKTSVSDKTKTKTNFDASLHSHNFRSHSSQSQKPKHENGFGKTKSKALKILYGELKKAKQPISPGAKLASFLNSLFTSTGNAKKAKVSTTTTSTYRPVLIPIATDRVADTKSVSAAQQQPGSTCSSASSFSRSCLSKTPSSRSGAKRSVRFCPVSVIVDEDCRPCGHKNLHEGEESLVDSRGKNRSEELRLHVMQESRRVEELARDLLKNYQKKSEVEFDDVMHYEDEEEEEDDDDVASCASSDLFELDNLSAIGIERYREELPVYETTHFNTNRAIANGFIL

SEQ ID NO: 115714 - protein, 144 aa, Glycine max
  Coding DNA Sequence Number=SeqID_24029
MEVVSELMGDAIDDALEYDEETEELVNRFLMRLELTSTQSAAQWASKMRGKPLINARGVEDVPASVKLPYTVLFFKTCQADNTFSLRSRVIGNAPSELGESEKCERNYQCSSYEKPRPCHDMVGDNYEHNNNHFGLNNAGGWSI

SEQ ID NO: 115715 - protein, 150 aa, Glycine max
  Coding DNA Sequence Number=SeqID_24030
  Homolog annotation: Hit_ID=A7P4R2; Match level="QueryCoverage=58%, HitCoverage=19%, E-value=5e-09, Identity=39%"; Hit description =Chromosome chr4 scaffold_6, whole genome shotgun sequence
MNVESERKDEQEVKGWRKALKSVGNWLAHKDKDEWLKDMRGMLSLVSTVIATMTFQSALNPPGGVRPGNESGVVQCPVNKADNNPCPGESILAVVYPDEYEKFLIWNTTCFISSLAVDVHHHLQPHSYLHVWCGNGHPGYPLEINRIILV

SEQ ID NO: 115716 - protein, 151 aa, Glycine max
  Coding DNA Sequence Number=SeqID_24031
  Homolog annotation: Hit_ID=A2Q455; Match level="QueryCoverage=29%, HitCoverage=10%, E-value=6e-08, Identity=56%"; Hit description =Peptidase aspartic, active site
MIHHLPTTFLNQFKPYSTNSAYYSKTPHHLPPSRDTDHHIHLLPNTAPVNVKPYRYPHYQKREIKTQMWKRRYNKQKGAEIKEKKKKKIRKRPKPKFAPINKRVSLGKRTHFLGAQFSDLWHSVLSFSFSYIPISFFHPSSHCKALMTMSG

SEQ ID NO: 115717 - protein, 341 aa, Glycine max
  Coding DNA Sequence Number=SeqID_24032
  Homolog annotation: Hit_ID=A7NV10; Match level="QueryCoverage=75%, HitCoverage=72%, E-value=5e-50, Identity=42%"; Hit description =Chromosome chr18 scaffold_1, whole genome shotgun sequence
MAHLNVIMVTDLLLSQSGFANHYFREYYMSKFFRLLRIIIQKSFEVLSPDLLLVLGDVSAGGSELTRSKWVSVLRRFYKVLGPFVGDRDVGECGDIEGNRVGWIANKLPGLDSAGFAALEIGNVSFVRPNAVALLCGNGGCLRFEVEKVIERESVGTRMNGSDEDVLYGLGPVVLLHLPLDQTRDEHYAGVGHFKRSSNSFMDELNVVPESREVIGGGLYKLHHTLPLNASEYILQALKPRTELARLPYQQCHGMQEMTLDLCLPLLKRQEEQIAAGKIILPKRTNKQKRTVGKLPEKKNRIVFGKAEFHNIVDPTNFQIEEMFCRDKPGSISRCTESVSR

SEQ ID NO: 115718 - protein, 571 aa, Glycine max
  Coding DNA Sequence Number=SeqID_24033
  Gene Ontology: Mol. function=transcription factor activity; Cellular component=nucleus; Biological process=regulation of transcription, DNA-dependent
  Homolog annotation: Hit_ID=A7P6J7; Match level="QueryCoverage=87%, HitCoverage=100%, E-value=1e-145, Identity=54%"; Hit description =Chromosome chr9 scaffold_7, whole genome shotgun sequence
  Pfam annotation: Domain name=AP2; Domain location=244-301; Score =45.9; E_value=1.4e-10; Accession=PF00847.11; Description=AP2 domain
  Pfam annotation: Domain name=AP2; Domain location=343-395; Score =60.9; E_value=4.4e-15; Accession=PF00847.11; Description=AP2 domain
  Pfam module annotation: Pfam domain module=AP2::AP2; Domain location =244-301::343-395
MSNWLGFSLTPHLRIDEEFERENQERGGGYHHPSPSCHPHLSVMPLRSDGSLCVADSFSHSAASQEWRYDSAIGGGNSNEEGPKLEDFLGCYSNSPAKVFCQDSQPDQNQSQNNVSKINVNVAPSFCTNNSEIETGDNLTNPSSLLHSFHAYNDNSHALIPTNGMYKSWLAQTQFSSDGKPSNEANGCNFQSLSLTMSPSVQNGVGAISSVQVNEDSRKRVMAKSHAREPVPRKSIDTFGQRTSQYRGVTRHRWTGRYEAHLWDNSCRKEGQTRKGRQGGYDKEEKAAKAYDLAALKYWGPTTHINFPLSTYEKELEEMKHMTRQEFVANLRRKSSGFSRGASVYRGVTRHHQHGRWQARIGRVAGNKDLYLGTFSTQEEAAEAYDIAAIKFRGTSAVTNFDISRYDVKRICSSSTLIAGDLAKRSPKESPAPVPASDFNSCGSSPMPLVSQPPPLAITDGEHSDELSNMMWNANNSDEQAQNESGGAEFNNNVTESSSSQQVSPSSNKDALNPQSPNEFGVSGADYGHGYFTLDGPKYDDGNNENDHMSTNRLGNLGLVNQVPMFALWNE

SEQ ID NO: 115719 - protein, 247 aa, Glycine max
  Coding DNA Sequence Number=SeqID_24034
  Gene Ontology: Mol. function=metal ion binding
  Homolog annotation: Hit_ID=Q4VYC9; Match level="QueryCoverage=80%, HitCoverage=51%, E-value=4e-87, Identity=76%"; Hit description=C3HC4 zinc finger containing protein
MSYPTGRDHVPFVLIDVGRRPNAEYVVVNMDGSRHPLPLTTVYHKLQPINASPYTFLQALFGHEYPVGLLDEEKILPLGKDITAVGHCSLKNGIAEIKSCKDIPYFLSDLSKDQMIVDLSIKAKILFWGGISLGSMSVGVLGYAVLRNWIKWKRWKVQRQLQQQRQAVSDAEPQVDDEIEDVPDGQLCVICLMRRRRSVFIPCGHLLHPNVLFVVRRFEIQCGLMNLEQTQTDFSVHSAAGNFYDCY

SEQ ID NO: 115720 - protein, 650 aa, Glycine max
  Coding DNA Sequence Number=SeqID_24035
  Gene Ontology: Mol. function=triacylglycerol lipase activity; Cellular component=integral to membrane; Biological process=lipid metabolic process
  Homolog annotation: Hit_ID=A7P6G7; Match level="QueryCoverage=95%, HitCoverage=94%, E-value=0.0, Identity=63%"; Hit description =Chromosome chr9 scaffold_7, whole genome shotgun sequence
  Pfam annotation: Domain name=Lipase3_N; Domain location=46-133; Score= 76.4; E_value=9.6e-20; Accession=PF03893.7; Description=Lipase 3 N -terminal region
  Pfam annotation: Domain name=Lipase_3; Domain location=186-326; Score= 112.4; E_value=1.4e-30; Accession=PF01764.16; Description=Lipase (class 3)
  Pfam module annotation: Pfam domain module=Lipase3_N::Lipase_3; Domain location=46-133::186-326
MATAAGAAALLYYTLNRKLQTHDAIDEDGEENGSDTPTDTPLGIGRVSHRLIQAPATWLETISTLSETLRFTYSETLGKWPIGDLAFGISFLLKRQESNMAKGDYHVDSEFCGTDSVQLKGSEITAELKYLLNLLTLCWHFSKKPFPLFLEETGYSEENVLLREAKAGILKPAFTIIADHEMKCLLLLIRGTHSIKDTLTAVTGNVVPFHHTVVNQGGVSDLVLGYAHCGMVAAARWIAKLATPCLLEALGHYPDYNVKIVGHSLGGGTAAILTYVLRERKELSVATCVTFAPAACMTWELAESGDSFITSIINGADLVTASAWINDLRNQIEQTRILSTVYRSASALGSRLPSIATARAKVAGAGAILQPVSNGTQVVMKRAKSMAQAAWARPNLNLSSWSCMGPRRRVMSAHYSRDGGSSPTSSSSTNIESSDPLLGSPTKAINAKNMNLPVSSSIEEWSSEIECGNGSSSDTEVDVDHDDSLNMMDRDRYEDQMSEVELWHQLEHELYDRPEGEETDVAKEIRKEEAAIAEEVGQIQSSAPEIKEIHRFFPPGKIMHIVTLHSDTAEQESDGSRTSASSDSSELNETEIGIFLTSRSLYSKLRLSQRMISDHFMPVYRRQIERLIKELEEESNEGHNTRGSAIVKDR

SEQ ID NO: 115721 - protein, 63 aa, Glycine max
  Coding DNA Sequence Number=SeqID_24036
MGNYTAKSAYIQDNFDEADAKRTHVRTRVSPVQKVALITVIGCTATMDLPLWDKNLSNIPNFQ

SEQ ID NO: 115722 - protein, 915 aa, Glycine max
  Coding DNA Sequence Number=SeqID_24037
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q93YA9; Match level="QueryCoverage=100%, HitCoverage=99%, E-value=0.0, Identity=85%"; Hit description =Lipoxygenase
  Pfam annotation: Domain name=Lipoxygenase; Domain location=227-899; Score=1137.9; E_value=0; Accession=PF00305.10; Description =Lipoxygenase
  Pfam annotation: Domain name=PLAT; Domain location=114-215; Score =97.7; E_value=3.6e-26; Accession=PF01477.14; Description=PLATLH2 domain
  Pfam module annotation: Pfam domain module=Lipoxygenase::PLAT; Domain location=227-899::114-215
  Subcellular localization annotation: CTP_CleavageSite=37; ConfidenceScore=5.75e-01
MGSSLLERSMFVPSSSSPSSFFNSTRFLVPLENKRVVRMKRAAKFPVAAISEDLMKGSSSSPSSSSSSSSVSTEKPVKFKVRAVITVRNKIKEDFKETIVKHIDALTDRIGRNVVLELVSTEIDPKTKSAKKSNEAVLKDWSKKSNLKAERVNYTAEFIVDSSFGEPGAITVTNKHQKEFFLESITIEGFASGPVHFPCNSWVQSRKDLPGKRIFFSNKPYLPGDTPAGLRLLREKELRNLRGDGKGVRNLSDRIYDYDIYNDLGNPDKGIELARPNLGGSDMYPYPRRCRTGREPSDTDMYAESRVEKPLPMYVPRDERFEESKQNTFTVKRLKAVLHNLIPGLKASLSSSNQDFNEFSDVDGLYSEGLLIKLGWGLQDDVLKKIPFVSKIQESSQGLLKYDTPKIISKDKFAWLRDDEFARQAIAGVNPVNIERLQVFPPVSKLDPEIYGPQESALKEEHILNQLNGMTVQEAINENKLFMIDYHDIYLPFLEGINALDGRKSYATRTIFFLTPRSTLKPVAIELSLPHAGPNSRSKRVVTPPVDATTNWMWQLAKAHVCSNDAGVHQLVNHWLRTHANLEPFILAAHRQLSAMHPIFKLLDPHMRYTLEINTLARQSLIHADGIIENCFTPGRYAMEISSAAYKNFWRFDMDSLPADLIRRGMAVADPTQPHGLKLILEDYPYAADGILIWSAIEDWVRTYVNHYYPHSSLICNDKELQSWYSESINVGHADLRHENWWPTLNNSEDLVSILSTLIWNASAQHAALNFGQYPYGGYVPNRPPLMRRLIPEEGDPEYASFIADPQKYFLNALPSLLQATKFMAVVDTLSTHSPDEEYLGERQQPSIWSGDAEIVEAFYDFSAKVQQIEKVIDGRNLDRTLRNRCGAGVLPYELLAPSSEPGVTCRGVPNSVST

SEQ ID NO: 115723 - protein, 108 aa, Glycine max
  Coding DNA Sequence Number=SeqID_24038
MRIPSIVYEIVPISRMCMRFYHRSTFLVQDILTWIKSQDSGAWGTCIASMWWIWKWRNNRIFNDDKWNLQHVLREWITGFFYFDGSGDSTEAEILALIHGLKGLHPLC

SEQ ID NO: 115724 - protein, 29 aa, Glycine max
  Coding DNA Sequence Number=SeqID_24039
MNEKAEAPGGDFKKFTRRKSSTVESADNT

SEQ ID NO: 115725 - protein, 190 aa, Glycine max
  Coding DNA Sequence Number=SeqID_24040
  Homolog annotation: Hit_ID=A7P6D9; Match level="QueryCoverage=46%, HitCoverage=67%, E-value=6e-14, Identity=49%"; Hit description=Acyl carrier protein
MAPQNNFPLESSILTHKLLAGSSMFGELKFVNKVQLKRETKTSFALSGGIDTIISCSTAELETLKIVQSTIAKQLFIDEATVEIMMALEEKFEISIGEGGAENISTVQDAADLIEKGERGVVDPEGEEEAEVVVLPKPDWDRTMVMLRLIGTASATVDRTEIPPENELYFRSFPRPVSGAGPASVSSQSL

SEQ ID NO: 115726 - protein, 204 aa, Glycine max
  Coding DNA Sequence Number=SeqID_24041
  Homolog annotation: Hit_ID=A7P6D0; Match level="QueryCoverage=54%, HitCoverage=13%, E-value=1e-16, Identity=46%"; Hit description =Chromosome chr9 scaffold_7, whole genome shotgun sequence
MVISKKQLTFIVVFDFVWIRLLRHFQPQQGKPALWELDSDQHYTVKKHGLYLADDSIRLSRLTLYFGRSTIKRSLSDGNILSESDTTIRNLNVTNGQNSSEKPDKRFLSGSTPDIFTCGSDICHCRQSGVMSRSSRRNHAINWDMHCMALRPVKEGGFGQWNLVSKNIYGWKGGKGEVSSKPHQCLDFFNEGLLCSAAPGNPLF

SEQ ID NO: 115727 - protein, 321 aa, Glycine max
  Coding DNA Sequence Number=SeqID_24042
  Gene Ontology: Mol. function=hydrolase activity, acting on ester bonds; Biological process=lipid metabolic process
  Homolog annotation: Hit_ID=A7P6C6; Match level="QueryCoverage=74%, HitCoverage=71%, E-value=9e-59, Identity=43%"; Hit description =Chromosome chr9 scaffold_7, whole genome shotgun sequence
  Pfam annotation: Domain name=Lipase_GDSL; Domain location=44-298; Score=40.5; E_value=6.1e-09; Accession=PF00657.13; Description=GDSL -like LipaseAcylhydrolase
MAKNSTTLSACLEGEASAISRLNNNAFPKMLHELEKQLKGFKYSITELYGALTELKYESAAEHFAKLMWSGNRDVTVTEYAELPLIPPYLHPGYHDHQYIYGVNFASSGAGDLPETNPGLVIDLKTQALYFAQVGKLLRKILGEEKAKKLLSTAVYIFSVGTNDYAVPFYTNSNGTVVLPYPQQIFIDLVICNITTAIKGIYNEGGRKFGFVNVAPLNRSPFLRTFVNGTTIDACLKEQGSKEGNVACCGGGPYMGDYSCGGKREIEEYELCNNVDEYVFFDSPHPTESTAEHFAQLMWNGNKDVIDFYNLKQLFHVESIS

SEQ ID NO: 115728 - protein, 47 aa, Glycine max
  Coding DNA Sequence Number=SeqID_24043
MASFHKYISMQDVASIARKGGGRDFISFKSKIIHTVSWRRVFFVVES

SEQ ID NO: 115729 - protein, 103 aa, Glycine max
  Coding DNA Sequence Number=SeqID_24044
  Gene Ontology: Mol. function=nucleotide binding
  Homolog annotation: Hit_ID=Q1SL19; Match level="QueryCoverage=71%, HitCoverage=14%, E-value=6e-31, Identity=83%"; Hit description =Nonsense-mediated decay UPF3
IILYVAQRGSHADLKHDTPNARSGEVKSLGSVRTSHSSENGFNKHFGRRGPSHGVKDVDGYSVSSEGKHPRRSSTSAYGSNEVPKFDFSMAVHGIFFSGSIID

SEQ ID NO: 115730 - protein, 159 aa, Glycine max
  Coding DNA Sequence Number=SeqID_24045
  Gene Ontology: Cellular component=endoplasmic reticulum membrane
  Homolog annotation: Hit_ID=A7QCI0; Match level="QueryCoverage=94%, HitCoverage=29%, E-value=2e-56, Identity=76%"; Hit description =Chromosome chr12 scaffold_78, whole genome shotgun sequence
  Pfam annotation: Domain name=DUF1682; Domain location=1-153; Score= -97.6; E_value=6.6e-06; Accession=PF07946.5; Description=Protein of unknown function (DUF1682)
MAIIDILQVFGEKAFEKFGKGLISLHFSDQHPGIHKKILLFKFVLPAAKDMADMTRLVALVPYYIDLIGRYKLSSQVGKSCYQARSKTEAARQKAALEAQKELRNAQQEAMQRRKAERKKMVEEAEAKLSAEAVRKKEAKERARQMKKAMPRMKMSRGA

SEQ ID NO: 115731 - protein, 445 aa, Glycine max
  Coding DNA Sequence Number=SeqID_24046
  Gene Ontology: Mol. function=dihydrolipoyllysine-residue acetyltransferase activity; Cellular component=pyruvate dehydrogenase complex; Biological process=pyruvate metabolic process
  Homolog annotation: Hit_ID=A9PGQ6; Match level="QueryCoverage=100%, HitCoverage=77%, E-value=1e-166, Identity=69%"; Hit description =Putative uncharacterized protein
  Pfam annotation: Domain name=2-oxoacid_dh; Domain location=186-445; Score=343.4; E_value=4e-100; Accession=PF00198.14; Description=2 -oxoacid dehydrogenases acyltransferase (catalytic domain)
  Pfam annotation: Domain name=Biotin_lipoyl; Domain location=1-64; Score=41.8; E_value=2.4e-09; Accession=PF00364.13; Description =Biotin-requiring enzyme
  Pfam annotation: Domain name=E3_binding; Domain location=126-164; Score=69.3; E_value=1.3e-17; Accession=PF02817.8; Description=e3 binding domain
  Pfam module annotation: Pfam domain module=2-oxoacid_dh::Biotin _lipoyl::E3_binding; Domain location=186-445::1-64::126-164
MTEGNIARWLKKEGDRISPGEVLCEVETDKATVEMECMEEGFLAKIIRGDGAKEIKVGEVIAVTVEDEGDIAKFKDYQPSASEPSEPPAKETSAPPPPKKEEVVEEPAREPEPKVSKPSAPPSSGDRTFASPLARKLAEEKNVPLSSIKGTGPEGLIVKADIDDYLASGAKEVSASSKAKVAADAALDYTDIPVSQIRKVTASRLLLSKQTIPHYYLTVDTCVDKLMSLRTQLNSLQEASGGSRISVNDLVIKNFMNLSLKRFKEHYSNMCPHCERKSQAAALALRKVPQCNSSWANDYIRQYHNVNINVAVQTDNGLFVPVVRDADKKGLSKIGEEVKQLAKKAKENSLKPQEYEGGTFTVTNLGGPFGVKQFCAIINPPQAGILAVGSAERRVVPGSGAEEFKFASFMSVTLSCDHRVIDGAIGAEWLKAFKGYIENPETMLL

SEQ ID NO: 115732 - protein, 82 aa, Glycine max
  Coding DNA Sequence Number=SeqID_24047
  Gene Ontology: Mol. function=nucleoside-triphosphatase activity; Cellular component=intracellular; Biological process=regulation of transcription, DNA-dependent
  Homolog annotation: Hit_ID=A7P6L7; Match level="QueryCoverage=90%, HitCoverage=3%, E-value=6e-27, Identity=72%"; Hit description =Chromosome chr9 scaffold_7, whole genome shotgun sequence
MDDQIDGRTLVGAYVSADRPGEFRWQPGSLTQAVQNGLWIVFEDINKAPSDLHSILMPLLEGAVSFATGHGEVVTLLCNRHG

SEQ ID NO: 115733 - protein, 141 aa, Glycine max
  Coding DNA Sequence Number=SeqID_24048
  Homolog annotation: Hit_ID=A5YPB7; Match level="QueryCoverage=29%, HitCoverage=22%, E-value=7e-09, Identity=60%"; Hit description =Putative gag protein
MLGGGEHQLDGAQRFLLDALNAQMQRLLRENNKVLYERIERLENRERHEEEREGGNGGGPRPNRIEGVKLNIPPFKGKSDPEAYLEWELKIEHIFSCNTYEEAQKLKLAAANSQIMLLCSGINCKGRELQMRSLWWKLVLT

SEQ ID NO: 115734 - protein, 159 aa, Glycine max
  Coding DNA Sequence Number=SeqID_24049
  Gene Ontology: Mol. function=amino acid transmembrane transporter activity; Cellular component=integral to membrane; Biological process=amino acid transport
  Homolog annotation: Hit_ID=A7P8G2; Match level="QueryCoverage=56%, HitCoverage=26%, E-value=5e-26, Identity=52%"; Hit description =Chromosome chr3 scaffold_8, whole genome shotgun sequence
MSSRQILTPPLENELTIRKDIYQQIEKHRICGHYKEVRASKLQGAQGGDFWSVGVRKVLRAPKISCCLVDLNYWDSISTLVGEVVLGYCFPLLVATSVVPLNRELWTDGWWLQATTVMSNMEMFIAEMSSDSFQLLGMVERGMLLEFFSKRSCYGTPYT

SEQ ID NO: 115735 - protein, 76 aa, Glycine max
  Coding DNA Sequence Number=SeqID_24050
  Gene Ontology: Mol. function=RNA-directed DNA polymerase activity; Biological process=RNA-dependent DNA replication
  Homolog annotation: Hit_ID=Q2HRM6; Match level="QueryCoverage=78%, HitCoverage=17%, E-value=2e-09, Identity=44%"; Hit description=RNA -directed DNA polymerase
MEPSNLLRGRPWQYDKDVVHNGVTNKFAFVHKRKKVTLTPMSPSEKRLRRLDFKEGSGSTTRNISFYDTMVLSGPP

SEQ ID NO: 115736 - protein, 137 aa, Glycine max
  Coding DNA Sequence Number=SeqID_24051
FPQWSPFIRYPYDQKNEERSPWSTETAESTIHSLSGLDTSVSLLTQAPLVDYRNLPRLALSATDRWPLSLKTHLIRTLFGKSVGDCLDAIFSRSMKYPFFAQFERRCTQDSALLGMPFLETMFVSPTRMWPLFIARQ

SEQ ID NO: 115737 - protein, 161 aa, Glycine max
  Coding DNA Sequence Number=SeqID_24052
MATLAQTWSVLSFSNLIPTSHTSDVTLDKAKLIYGIIMKIDMNLGYLISHQISLIAQHDTSRLGFPTLRVTFRGPRKARGKRSEAPSTSASEAPTPSSSTVPSSSSTQIPVIPPVPLQTPLPAPLSADAALHALEHAQGAVHHHAEPSGLGLALYYEHGGV

SEQ ID NO: 115738 - protein, 170 aa, Glycine max
  Coding DNA Sequence Number=SeqID_24053
MDKGQIEVCSARKGEGNLCMQSDDKNPSKPKPLVIHFTRDVATQKPRGFQPVTVKKPTPFPYKSDKADVGIRPPELPVWSKDPKGKAKVDVGESDKAGLTLDDEVPVGKITKEGSDFCKKGISAEEVTEFLRIIQHSEFKNESYESNDTEDPDVDFEQLINQVEKEEDED

SEQ ID NO: 115739 - protein, 137 aa, Glycine max
  Coding DNA Sequence Number=SeqID_24054
MTLLLSNIPPDDHNADLPPVEVSVGLCHRDIGIAPTRHPVDLEKSNRTLGFPALVSGLFHSYRVPVPLTRSCHRDIGIVPTRHPTDPEEPNRAQGFPALVTSLCQSYRVPVPPNKGSCPQDTQWTRRNPTGSSSCQL

SEQ ID NO: 115740 - protein, 122 aa, Glycine max
  Coding DNA Sequence Number=SeqID_24055
  Gene Ontology: Mol. function=transcription factor activity; Cellular component=nucleus; Biological process=regulation of transcription, DNA-dependent
  Homolog annotation: Hit_ID=Q9LU18; Match level="QueryCoverage=50%, HitCoverage=24%, E-value=3e-25, Identity=87%"; Hit description =Ethylene-responsive transcription factor ERF036
  Pfam annotation: Domain name=AP2; Domain location=41-92; Score=77.8; E_value=3.7e-20; Accession=PF00847.11; Description=AP2 domain
  Subcellular localization annotation: CTP_CleavageSite=59; ConfidenceScore=5.78e-01
MTMITNSSSVPLSPSPSPSSSSSKKRARDNNNSRNNSNKHSVYRGVRMRTWGKWVSEIREPRKKNRIWLGTFATAEMAARAHDVAALTIKGSSAILNFPERGSSRVDLQACKLGTGRRFTTS

SEQ ID NO: 115741 - protein, 125 aa, Glycine max
  Coding DNA Sequence Number=SeqID_24056
  Subcellular localization annotation: CTP_CleavageSite=43; ConfidenceScore=5.25e-01
MESSIRPMTNPIPTKPMPICRPDLKQSPSFIPSSFEKIMMTIGSMTVGPRSRIYRMISGFDTDARYKRHPMNHRNVTKRSVDFCRGADQVCTVHIGFNFGHPTLNQIQRYVVGFTQFFDLFSRHG

SEQ ID NO: 115742 - protein, 89 aa, Glycine max
  Coding DNA Sequence Number=SeqID_24057
  Subcellular localization annotation: CTP_CleavageSite=25; ConfidenceScore=5.03e-01
MYPLLFSVTTTQVDVPSTCTTKDVPSNMLRQSFQAVSPLKLCEGDTKDILGGYSFEIFCIREREESKEFSDCVILNSLKREKGDEKEFR

SEQ ID NO: 115743 - protein, 109 aa, Glycine max
  Coding DNA Sequence Number=SeqID_24058
DAGSRQARQGASAGVGGCRGWLNYAASEQIVLRVHHMRAIGAGLFAITPAGERGMCCKAIKLGNARVFPVDSRGSPHDTTVASTSGSDVYVWDTDSGTLVTIVVPSSNS

SEQ ID NO: 115744 - protein, 274 aa, Glycine max
  Coding DNA Sequence Number=SeqID_24059
  Homolog annotation: Hit_ID=Q6WAY4; Match level="QueryCoverage=79%, HitCoverage=48%, E-value=2e-14, Identity=28%"; Hit description =Putative uncharacterized protein
MGTNQNGKRFYQVEVKGLDVTSLKELGRLMGPLQRQAFRKVYGKILDLTTVKVFTEAVVSLAQYNDQPLRCFTFGDFQMVPTVEEFEEILGCPLGGRKPYLFFGFLPSLSKIAAVVGDSAKELDRMKQTRNGVVGLPWKYLEGKARGMASQEKWGPFADTLALLIFWGCPLSERGRTYLIPLTEGARKTVHGLSVAYPLSVCGSAINWFPRWKEGKEGVLFTCGDYPNVPLIGTRGFDAILPRKGPITRTMSKRLQEDWARAAEEGPRVLMNLR

SEQ ID NO: 115745 - protein, 285 aa, Glycine max
  Coding DNA Sequence Number=SeqID_24060
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAVLHPETGSGECSQAAGAPPPPHQAGPAGSFDMEQYLRHLVCQQAANHQAHVQTHDCLYQLSLSMQSQGFASFSCPTPDQFRAEVAWPGDWPEAQAGEAPPEAPGDGEEAHEDEEMADLLDFLGGSGAT

SEQ ID NO: 115746 - protein, 103 aa, Glycine max
  Coding DNA Sequence Number=SeqID_24061
MDFRLLLVTSLMPWNCKSTCGSMPWNQGSPKLKKMSPSSVLALIHHHRLHHHLSLRIVIIKKGEIVDKGSSRCFDDAKRSHASQRCIQDKAIKDIQIDDQDSL

SEQ ID NO: 115747 - protein, 184 aa, Glycine max
  Coding DNA Sequence Number=SeqID_24062
KLAATQTRKECAGLREENATTVRALEQETKRARKEEYGRNKFREALWGSNSELKLRREERDQSRAHSMVLKEELVAYSRSKRSLSQRLCETETNMLAIVAKYQEELSLATAHEHRVADEYAQVYAEKEARGRVIDSLHQEATLWMDRFALTLNGSQELPRLLAKAKAMADTYSAPEEIHGLLGY

SEQ ID NO: 115748 - protein, 153 aa, Glycine max
  Coding DNA Sequence Number=SeqID_24063
MEAMKERMATMMAMMSMRKIMKANAVTIAATSTVAKTHEIPHHNLADFEPWLGYVTEGQAVGGIPLENTSEGPQYHPQLHLLHSPTSKNPHAMAEMGKLDHLEERLRAIEGGEDYAFANLEELFLVPNIITLPKFKVPDFDEYKGTTCPKNHL

SEQ ID NO: 115749 - protein, 252 aa, Glycine max
  Coding DNA Sequence Number=SeqID_24064
MSPFLVRDFGAQNSKTIQRIHKAWETPLRKDQELRGIRNGIIGGYHEWLKEKFKLVATHVRKECAGLREENAITARALEQETKRARKEEYGRNKFRGALWGSNSELKLRREERDQSRAHGMVLKEELVAYSRSKRSLSQRLCETETNMLAIIAKYQEELGLAAAHEHRIADEYAQVYAEKEARGRVIDSLHQEATTWMDRFALTLNGSQELPRLLAKAKAMADTYSAPEEIHGLLGYCQHMIDLMAHIIRNR

SEQ ID NO: 115750 - protein, 32 aa, Glycine max
  Coding DNA Sequence Number=SeqID_24065
AKVQKGLRLCLNGVLMEACLWGFYGGWIFELQ

SEQ ID NO: 115751 - protein, 147 aa, Glycine max
  Coding DNA Sequence Number=SeqID_24066
MWAFHKVLQIDWAHLVRYRMHKELRLNAPLPYPHLVTLFLQHFNIPLDSEPYVPIKRSFLIGASVIASFGARHVGEEGHDGEDSSLLSKILDRFDGLQTIVGERFDTLELQVNMCFNEMESRITKVEEDVSYIRSSFDLPPPPPPSS

SEQ ID NO: 115752 - protein, 147 aa, Glycine max
  Coding DNA Sequence Number=SeqID_24067
KERALWHPYRVRARARVMSEIEEVQERMKADMEAMKEQMATTMEAMMSMKKIMEVNATTVAATNIVAENKHAFLPYGLPPNYTPPNVVHTPNENVNNSTPILIESQQPQSNHAQVSQSMGETHEIPHHNLADFEPCLGYATEGQAVG

SEQ ID NO: 115753 - protein, 81 aa, Glycine max
  Coding DNA Sequence Number=SeqID_24068
PHQLDLAPYASEPYNAQWNAPGLLRDKHTLRSSRILGEMEVDEPWLGLWLPLNYQVDMGANFVVDLGMAFVDNWAVGKEKG

SEQ ID NO: 115754 - protein, 62 aa, Glycine max
  Coding DNA Sequence Number=SeqID_24069
MASYGGKLLLEVASPIIFLPSPFRCHDLQEAKESIDEDPRPTISTWSYIMWFYHFSVIIFLC

SEQ ID NO: 115755 - protein, 34 aa, Glycine max
  Coding DNA Sequence Number=SeqID_24070
MELRYVMNGSGMEKEEREETPLQEEDESRRSSPP

SEQ ID NO: 115756 - protein, 185 aa, Glycine max
  Coding DNA Sequence Number=SeqID_24071
  Homolog annotation: Hit_ID=Q6FYY6; Match level="QueryCoverage=31%, HitCoverage=7%, E-value=2e-07, Identity=38%"; Hit description =Putative uncharacterized protein
MRCEIPHRCVRRKYRIRRHSPFRLRNCWEGRSVRASSLLRQLAKGGCAARRLSWVTPGFSQSRRCKTTASAKLACLQVDSRGSPDRLQGGGLLDTNRDNVIAASEGVSLVQVTGSASADSFRLSNGYMAAGPWQYGLYSFAPGSSAGGNAWDYRLANNFICSDGSLCQPQAGSAVKAVRPAVTPQ

SEQ ID NO: 115757 - protein, 190 aa, Glycine max
  Coding DNA Sequence Number=SeqID_24072
RCINLSSPDGTIPMRPVPIMVDSPNVRTNPLASHGGSTVNAVEEWEPRGLKQMKDVSTSRRFILEALGKVGMIRLNGDKGDSYLMHPGESHDVETANLKFAVRRNGGGDVCMQSDDKNPSKPKPLVIHFTRNVATQKPQAPCVLTAIEESGRASISRPRAKRKISALSAAVVFGLAQCMTGAKLKSIYSR

SEQ ID NO: 115758 - protein, 51 aa, Glycine max
  Coding DNA Sequence Number=SeqID_24073
MDGPRPILDPIVDWHAMAPKKLLSKRARNDAAGEGSSVAPQADIELDGHHF

SEQ ID NO: 115759 - protein, 92 aa, Glycine max
  Coding DNA Sequence Number=SeqID_24074
MKPYMQHMADQQAANHRGQVQLNESFYQYTLHQQRQDPCPNSWPTPEQFRATVAWSGDRPSFQAGAGPVGPPGDEDEVEEDDDMADVMNFFL

SEQ ID NO: 115760 - protein, 214 aa, Glycine max
  Coding DNA Sequence Number=SeqID_24075
MERSMIDAASGGALGDMTPAEARNLIEKMASNSQQFSAGSDAIVIRGVHEVATNSSGETKKLEGKLDALVNLVTQLAMNKKFAPVARLCGLCSSADHHTDLCPSVQQSEAIEQPEAYAANIYNIPPQPQQQNQPQQNNYDLSSNRYNSTDGGIIPTLDGRILHNSSNNNNLIFKMLLAQADHTFLHQSSNNNNSNSPRNNKQLRPLCNLPLKNL

SEQ ID NO: 115761 - protein, 185 aa, Glycine max
  Coding DNA Sequence Number=SeqID_24076
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
RGAMRKRTLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPGMQAWHWPSFYNVVTGKTLALPNLIALQHIPLSPAGVIAKRPAPIALPNSCAA

SEQ ID NO: 115762 - protein, 163 aa, Glycine max
  Coding DNA Sequence Number=SeqID_24077
MVPTRHPLDPDKSNRALGFPALITGLFQSNGVPVTPSKVIRPPITRAFIEKYCTPRQVQGDAHQAAGAPPPPRQADPAGPLGVERYLQHLVHQQVANHHGQGQGSTPFICLTPKQFGAEVAWPGDWTDAQAGEEPAGSPGEADESRIDEDMTDLLDFSGGSEA

SEQ ID NO: 115763 - protein, 148 aa, Glycine max
  Coding DNA Sequence Number=SeqID_24078
  Pfam annotation: Domain name=zf-CCHC; Domain location=76-93; Score =19.9; E_value=0.0015; Accession=PF00098.14; Description=Zinc knuckle
MELQRLNQNEETEKRKRSIALKASSSMQEEEEEEFDDEEDFSLFMKKFHKFVKNRRMERSHNFNNGKRSQEVSPTLKFYKCNQPGHIKANCPSNESWPEKNEKKSYKERRSKKAYIAWDDNDSSDGSEKEINLLSKDYESDENISQEV

SEQ ID NO: 115764 - protein, 132 aa, Glycine max
  Coding DNA Sequence Number=SeqID_24079
MPGADKPVRRVSGCGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSRCTSRIPKTCTTKM

SEQ ID NO: 115765 - protein, 105 aa, Glycine max
  Coding DNA Sequence Number=SeqID_24080
  Homolog annotation: Hit_ID=B0HC01; Match level="QueryCoverage=40%, HitCoverage=87%, E-value=3e-09, Identity=79%"; Hit description =Putative uncharacterized protein
MENASNAAFYGSWPFAAFCSHVLLRYPLILWITVLPPLSELIPLAAAERPSAARNSYDHDYEFELGTLKEHRLLNDSAPETKRDSMCSQFSIGRLLRFGKGIPDF

SEQ ID NO: 115766 - protein, 240 aa, Glycine max
  Coding DNA Sequence Number=SeqID_24081
MERSMIDAASGGALGYMTPAETRNLNGKMASNSKQFSARNDVIVIRGVREVATNSAASSETKKLEGKLDALVNLVTQLALNQKSVPVARVCGLCSSADHHTDLCPSMQQPGAIEQPEAYAANIYNRPSQPQQQNQPQYNPGWRNHPNLIWSSPQQQQQQPAPSFQNAAGPSRPYIPPPIQQQQQPQKQPTVEAPPQPSLEELVRQMTMQNMQFQQETRASIQSLTNQMGQLATQLNQQQS

SEQ ID NO: 115767 - protein, 135 aa, Glycine max
  Coding DNA Sequence Number=SeqID_24082
  Gene Ontology: Mol. function=transporter activity; Cellular component= integral to membrane; Biological process=transport
  Homolog annotation: Hit_ID=Q6QIL3; Match level="QueryCoverage=57%, HitCoverage=24%, E-value=2e-18, Identity=57%"; Hit description=NIP3
  Subcellular localization annotation: CTP_CleavageSite=65; ConfidenceScore=5.41e-01
MNNEEVPSLPSTSATPGTPGAPLFGGLRFEKPNGSVVRKSSFLKSCKCFSVAEWTLEDGAMPRVSCSLPSPHIPLAKKSRPAGMQAWHWPSFYNVVTGKTLALPNLIALQHIPLSPAGVIAKRPAPIALPNSCAA

SEQ ID NO: 115768 - protein, 18 aa, Glycine max
  Coding DNA Sequence Number=SeqID_24083
GADNRKVSPRIIRPATSG

SEQ ID NO: 115769 - protein, 168 aa, Glycine max
  Coding DNA Sequence Number=SeqID_24084
  Homolog annotation: Hit_ID=A2Q5X7; Match level="QueryCoverage=88%, HitCoverage=18%, E-value=4e-12, Identity=28%"; Hit description =Ovarian tumour, otubain, putative
GLCETEVNIKEEIEIISKRFDELDVSGKVTLKSKLREIAYPDHNSMCPPPSKEYVDAFHSVQSSNSPVKRSASCSELPQPTRIIPMLDQFASFIQGFIRDVLDVKVDGNCGYWSIAALLGMGEDSWPLVRNELIKELDRWSHEYMNLFGGTERFEQLKLSLLVDGFSK

SEQ ID NO: 115770 - protein, 166 aa, Glycine max
  Coding DNA Sequence Number=SeqID_24085
MSASTQAATWSCQHRQQKQYGRTQYHRRSGRQRIVPGEQQADKGGDQRQQHGNRQHASKVTAPEARAGGGQHHQPNGHQRAEHLKTRHQIQHHQREENAVHQRCAPSPLRTQKIRIKGINDQRPEDHGQHQQGERGDAANQHNRAVIHRQQRAEQHVQQIDTGTAQ

SEQ ID NO: 115771 - protein, 106 aa, Glycine max
  Coding DNA Sequence Number=SeqID_24086
KAVILVGVLSRVFCLCPVLLGCDSLCCLNVVLLGCCGSLGGLMGTRGWWVYAHIVDVENLLCTIARPPPKWYLEICRGGQETLGTSGGVLLPKTKLDQSRPNPGIV

SEQ ID NO: 115772 - protein, 155 aa, Glycine max
  Coding DNA Sequence Number=SeqID_24087
MPISPCRCIGWDRAHKMPNGPEEVQQGPGVSSSGYGPLSVLQGARSPRQGHVIIGIAPARHPVDPKKSNRVLELSSSNYGSLKGIRPPTNRAFIKKYCVPRQAQGETPQQPGNGHQWATDAPPSPLEFTSAHPQKVRALPTTHGRAIGDQVQSQR

SEQ ID NO: 115773 - protein, 57 aa, Glycine max
  Coding DNA Sequence Number=SeqID_24088
MSSAKPSTRVLSESRESGRASATQACAYRDISSLSESSVAFQAQCKIGAKLKFTYSC

SEQ ID NO: 115774 - protein, 104 aa, Glycine max
  Coding DNA Sequence Number=SeqID_24089
MTRGNPSDLQSFDPEIDRTFHRLVRHHLVPFEHPEHSVIGDFEHYNFEHSENMAQPPPRERTLREMAAPDFTYESLCIQYPDEDVPYVLKNGLIHLLPKFHGLA

SEQ ID NO: 115775 - protein, 26 aa, Glycine max
  Coding DNA Sequence Number=SeqID_24090
MVLSLDQRDRLANADINKVKQDPTTG

SEQ ID NO: 115776 - protein, 165 aa, Glycine max
  Coding DNA Sequence Number=SeqID_24091
  Homolog annotation: Hit_ID=Q5W7C9; Match level="QueryCoverage=76%, HitCoverage=53%, E-value=3e-39, Identity=65%"; Hit description =Unknow protein
  Subcellular localization annotation: CTP_CleavageSite=37; ConfidenceScore=5.24e-01
GCARAGLNPTLTARADDSHAPPVSAFPKAPLSFKRIRGMSSPGGILNALATALHGSIRTAPSIHRLRLGLLGYLIPFAPLAFVSQCQCRPSRVLSPLVFFPISTHFTAPPEIPSAPTVLQLDALRPIIPDNACILCLTAAAGTELADAYSPDTVIASSPGKEVHD

SEQ ID NO: 115777 - protein, 209 aa, Glycine max
  Coding DNA Sequence Number=SeqID_24092
  Homolog annotation: Hit_ID=A6EIY0; Match level="QueryCoverage=42%, HitCoverage=11%, E-value=1e-18, Identity=42%"; Hit description =Putative outer membrane protein
VYPDSVGINDLGNPIRNTLANGGGVILPGVMQDPNNPGSYIPNTIRLDKSQSSQGMSVSLIGNNLWIMHKNLPYSDPEAGLSSGCTTGDDVNLDPHAAYNTTQESLVTFAQKELSDYMNTPSVNENNFRLTMQYWQETIYVNESNYDFTNRNVSNNVWTDNYVNVLKNLDQAEQIIKAYVPPPSELSTWPAKKTNQLAIVDMMKIYTYQ

SEQ ID NO: 115778 - protein, 163 aa, Glycine max
  Coding DNA Sequence Number=SeqID_24093
MVSPQERNTWTLDDLVSYVEKITILSKEQERITKPMSHGPATKHQFAAQEFNILPSSVETQGIARRRETVKAESYFIFSVSDIDMYQYPFEGHQSDTSASEHSLGGVAETYPNFSWPIMTPSQQHDAPILTHNSPLGTQWDVPEAMPDMDDVVVVDVCHHFSA

SEQ ID NO: 115779 - protein, 49 aa, Glycine max
  Coding DNA Sequence Number=SeqID_24094
MAEYPSPSNQSQKNDDLEPRSPLDRCEILVSCSQHNSEHSHRWEFRYHV

SEQ ID NO: 115780 - protein, 75 aa, Glycine max
  Coding DNA Sequence Number=SeqID_24095
MCHLTAYVCVYYDDQICNTNEGTTFVSNNIKTSMVNKTINMAQPLILRTYQMNMRLVGSKTMIVILTPLPGPGIL

SEQ ID NO: 115781 - protein, 81 aa, Glycine max
  Coding DNA Sequence Number=SeqID_24096
MKLASTDNTYTVTLTKLTFEVDLCLCFMLSISRLSFKRMDESTNRHNDNLGVNKMGKNIRKTKRDQPNYGKNNNSNMNGGR

SEQ ID NO: 115782 - protein, 199 aa, Glycine max
  Coding DNA Sequence Number=SeqID_24097
  Subcellular localization annotation: CTP_CleavageSite=43; ConfidenceScore=5.08e-01
MGWRAQLLKEAFSSLRIRTPQSLPFPLKFHASFSFKSPTSTFRAFFDAKEDEEDDEEEDQDPLNVSSECRGRFRQACRSTEGGGQDRCCASWPFNRFRCRQDMISKRSLRSNAEKFEFQAEVSWLAYGLCSAPKTLIKSPFRASRAIMGDSNYICRVSFSSSGCGKNLQMEEMKVASDLLVGDPASLEKKIDAIHFGGP

SEQ ID NO: 115783 - protein, 21 aa, Glycine max
  Coding DNA Sequence Number=SeqID_24098
MAPEDVEKTMFVTLWETFCYK

SEQ ID NO: 115784 - protein, 93 aa, Glycine max
  Coding DNA Sequence Number=SeqID_24099
MNEYNLIPYEDPLEGKSGASSAHGITPQDSDPIVLAFGIGVMINRDSRGHSYFIVRGEILGFMKAREQRVAKRLPVATCGIVSHGYAVNEMGG

SEQ ID NO: 115785 - protein, 215 aa, Glycine max
  Coding DNA Sequence Number=SeqID_24100
  Gene Ontology: Mol. function=4 iron, 4 sulfur cluster binding; Cellular component=mitochondrion; Biological process=metabolic process
  Homolog annotation: Hit_ID=A2XGJ4; Match level="QueryCoverage=100%, HitCoverage=9%, E-value=1e-120, Identity=98%"; Hit description =Ribosomal protein L18
  Pfam annotation: Domain name=Aconitase_C; Domain location=85-215; Score=233.4; E_value=5.1e-67; Accession=PF00694.10; Description =Aconitase C-terminal domain
MFHKEYGEVFDGDANWQAIQVTGSATYQWQEDSTYIRHPPFFSTMKVTPDPVQDIKDARILAILADSVTTDHISPAGNIKRDSPAGRYLSEHGVAPQDFNSYGSRRGNHEVMMRGTFANIRIRNEMVPGVEGGYTRHIPSQQQLSIYDAAMQYQQEKVPLAVIAGKEYGSGSSRDWAAKGPRLLGVRVVIAESFERIHRSNLIGMGILPLEFPQG

SEQ ID NO: 115786 - protein, 158 aa, Glycine max
  Coding DNA Sequence Number=SeqID_24101
MKFFSCDHHCVFDIHFIPPLERQTCGRQRHSSRKHIWTVRFTQEMLDAPEPLQFINFTFFYLQKLPRCTEVPLKACGHHMTVLRRSGPPLQWKVETLNPAIGGKGVVQPWYDFLEEMDFDDGDEISIYYRYYEKIWYIIIRRQEDWDDSDTIKLLSVV

SEQ ID NO: 115787 - protein, 183 aa, Glycine max
  Coding DNA Sequence Number=SeqID_24102
  Homolog annotation: Hit_ID=A7MHJ3; Match level="QueryCoverage=92%, HitCoverage=84%, E-value=4e-26, Identity=35%"; Hit description =Putative uncharacterized protein
MDTNDPQQLEKLKDRLKDRMGIPVGWHMSGIPLVGAMILSMFAFALAQPYLWLAVFELFGLPQYAVMAAIVPVSLIYSLIMVLTMYFVARGNFLALKLSLALMAFSGLVAIVYFLSVCLGALFGAGLKPGFLISAVLGLVFILGGIRCINSQTFYRANALYLHNRVWRKQLNIQRQTLRRASR

SEQ ID NO: 115788 - protein, 40 aa, Glycine max
  Coding DNA Sequence Number=SeqID_24103
MKAKKAYITWDDNDLESSDDSEKEMVNLCLMGKNYENDEE

SEQ ID NO: 115789 - protein, 151 aa, Glycine max
  Coding DNA Sequence Number=SeqID_24104
  Gene Ontology: Mol. function=DNA binding; Biological process=negative regulation of DNA replication initiation
  Homolog annotation: Hit_ID=A8GB54; Match level="QueryCoverage=100%, HitCoverage=84%, E-value=9e-57, Identity=74%"; Hit description=SeqA family protein
  Pfam annotation: Domain name=SeqA; Domain location=1-151; Score =300.3; E_value=3.6e-87; Accession=PF03925.4; Description=SeqA protein
MKTIEVDEELYRYIASHTQHIGESASDILRRMLKFTAGQSAPAASATSAAVKEAPAVRSEARPQDRVRAVRELLLSDEYAEQKKAVNRFMLILSTLYRLDPAAFADATASLQGRTRVYFAGDEHTLLQNGTHTKPKHVPGTPYWVITNTNT

SEQ ID NO: 115790 - protein, 571 aa, Glycine max
  Coding DNA Sequence Number=SeqID_24105
  Homolog annotation: Hit_ID=A8AJD8; Match level="QueryCoverage=71%, HitCoverage=68%, E-value=3e-54, Identity=33%"; Hit description =Putative uncharacterized protein
MIHKALKGNNRLLVVLKQKRQELLPAFSDDQNVLIFDFVQRRNACHHGTACQQIQTSKIIAVADHHRADHRTRIGVEEVQIHFEDRLTRRDGCALFHQTGKPFTFQRDGIETHVHDNLNAIFGFKAECMVGVEDFHHGARHRRDDGFIARFDRQTIAYRFAGEGFIRHVFQCYHFATDRCQQRCNYLFLAVAHGLGLSSSRRGGGCRSRCRCAGYRTFAQYGFHRGRNAFGLRTNNDLHALLVKADHARSTEAFSHAFIHLRRVFHIQTQTGNAGVDVGQVVRTAHRADVATCQRFGFALTVAAVINVDVVAVCLITGSQLATRRQQVEFLNGEAEHHIVDDEEHQTLRDQHPPVHSQRVTRRQHHVHQTGTETETGNPVHAGSDEDRIPVSTAWMTYSTVIDCQRRTRQTEHHDREEARLIATGDTRDAGTIGNRLRAAHEFWNIVDARRGGAGNTEFSAWCRPTGISRRLKKAYTPAPTEPSFWMCSPKLTRPPKMIGQTYIRIKATTIIRKETRIGTRRRPLKNDSALGSSTWLKRLYTSAERMPTRMPTNWLLILPKAAGTCSTGIF

SEQ ID NO: 115791 - protein, 73 aa, Glycine max
  Coding DNA Sequence Number=SeqID_24106
MSALLSDFPRASGSTAETAMGSLPQRGWSERSFENSREGVEEPHQSIPNLVVKLYCGDDTVGEVLRKNSSAPG

SEQ ID NO: 115792 - protein, 54 aa, Glycine max
  Coding DNA Sequence Number=SeqID_24107
DRTRKTPSEPGEVQQGPGISSSDYEPLLSSRSTAPPRQAQGETPQQPGDGGSGQ

SEQ ID NO: 115793 - protein, 141 aa, Glycine max
  Coding DNA Sequence Number=SeqID_24108
ANVFPLKKTLKKFTIWEINRDNDILKENFQASSRVLITNKDSGDRTLAINSTKTKVTMSNHKSTESALKDLEVKVRQLAMQIADKSSNSFVANTEKNPKEECKAVMTRNKRFVEKENENSVVSKKKAAEKKGIDDMKDDVR

SEQ ID NO: 115794 - protein, 169 aa, Glycine max
  Coding DNA Sequence Number=SeqID_24109
AKFEIPKASDSRTKKKILQTVDEQWRQFKSDLTRKWALTADKDGVDNTVCEKYGISQEKWAQFCQTRRDPSWEDVWKKAQAIQKQNTAPHVLSRGGYEYLEQKLMAEKTKKRLEEAAQSGSTEGIIDPPSPIRCHVKWKMARTKKTGQMTSEAAMEIAEKIDSLEEQAS

SEQ ID NO: 115795 - protein, 52 aa, Glycine max
  Coding DNA Sequence Number=SeqID_24110
MESSPGAQGRKEKEGYHTGVNLDHRDGKRKVPAGTPKKGITIGTGTATRLPL

SEQ ID NO: 115796 - protein, 72 aa, Glycine max
  Coding DNA Sequence Number=SeqID_24111
  Homolog annotation: Hit_ID=B0HC01; Match level="QueryCoverage=45%, HitCoverage=70%, E-value=3e-11, Identity=100%"; Hit description =Putative uncharacterized protein
MENASNAAFYGSWPFAGLLLTCSFLRYPLILWITVLPPLSELIPLAAAERPSAARNSYDHDYEFELGTRNGN

SEQ ID NO: 115797 - protein, 58 aa, Glycine max
  Coding DNA Sequence Number=SeqID_24112
MTLKKACKKLYGKNTHAHSDRFDYLPVYYFNKNHFFEYVVMIDVHGVSIPRNSTAKVF

SEQ ID NO: 115798 - protein, 140 aa, Glycine max
  Coding DNA Sequence Number=SeqID_24113
MRATLLLPSMKKDPPQQPDEVHKDPQDYARRDVEFYPPIPEGPAPGTLPQPNLAASPIVLSMEGPPPATEERRKLDLLEERLRAVEGFGDYPFADMTDLCLVPDVVIPARKFKGAGHFEQVCGRVCFPKIRTSKRVLEEG

SEQ ID NO: 115799 - protein, 95 aa, Glycine max
  Coding DNA Sequence Number=SeqID_24114
MTLASIATPLGLEFIPQVKKLLDEGLVRKSLNPCALLVPKIGIINIKIQKKMSVKGVFTPYPTLTYPEYEEPRDLRSNPFQGGGDDAILPPKGIG

SEQ ID NO: 115800 - protein, 95 aa, Glycine max
  Coding DNA Sequence Number=SeqID_24115
  Homolog annotation: Hit_ID=Q8H1A2; Match level="QueryCoverage=36%, HitCoverage=4%, E-value=5e-09, Identity=85%"; Hit description=Mini -chromosome maintenance protein MCM3
MLHKKKNGSENGNNKENEDTTITDVLKVEVHYEGCAPKTTLLILASLEIEWQLWGYIRLFEGKGSVNGVFRTVLIANNVSLLNKEDNAPIYSVED

SEQ ID NO: 115801 - protein, 263 aa, Glycine max
  Coding DNA Sequence Number=SeqID_24116
MGWQRLEDEHAKVSALQIEREARERMIESLHVEAMKWMDRFALTLNGSHELPRLLARAKTMANTRCQKVNIITKKNEHTLRHPYQTRAKAKIMSEIEEVQEQMKADMEAMKDQMTSMMEDNAAAVATTSATAEVDTTHISGINQISCPIPDVVGQGRKVLGSTCGPHVLQSKNSFPPYGLPPNYTPPKAVFQRFRKKCEKYQKGGQKGHFGVFSHHWLAQASPCLAWAIKKLRVEVNSSSGRARLLLEEATNLLGRAELAWAS

SEQ ID NO: 115802 - protein, 134 aa, Glycine max
  Coding DNA Sequence Number=SeqID_24117
MTYEDLLPSLIANHLAVVTPGRVLDPLSRSGMTLSNCKYQGGMPDVVQFPRKFRSAGFDSITVDDLGPKPSQNDLVRDGRTHSKEKSEIIQVLKYGNPDRNDSTARSGIKGKGRPLKIYAQRSEGAARSSSSHG

SEQ ID NO: 115803 - protein, 115 aa, Glycine max
  Coding DNA Sequence Number=SeqID_24118
MRAFAKRNTQWLSARKNPEEDELSGSLSAPLQVIKCTASAHSLNERSALSHNPLMRAKRSRFVLKASACTRFWPWLEAFACLGSSRERKVQVPKSCERFCCVKICRDESSKRKPF

SEQ ID NO: 115804 - protein, 269 aa, Glycine max
  Coding DNA Sequence Number=SeqID_24119
GQWIPFDADAIGQLLGYPLVLEEGQECEYGQRRNRSDGFDEEAIAQLLCIPGQDFSRTAAGRRVRIMRTNMTTLTQIWMTLLLSNILPSDHNSDLPLPKCQLVYAILTRMSVHVAQLIADAIYIFAGMAPTRHPLDPDKSNRALGFPSLITGLCQSFGVPARHHHLIRLAGWAFDMSSIYGIWFAAGANHRAHVRTMILYQMSLSMQSQGFASFSCPTPDQFRAEVAWPGDWPEAQAGEAPPEAPGDGEEAYEDEEMADLLDFLGGSGD

SEQ ID NO: 115805 - protein, 214 aa, Glycine max
  Coding DNA Sequence Number=SeqID_24120
MAQPPPRERILREMATPDFTYESLCIQYPNEDVPYVLKTGLIHLLPKFHGLAVIRGVHEVATNSSASSETKKLEGKLDALVNLVTLLALNKKSAPVARVCGLCSSAAHHIDLCPSMQQPRAIEQPEAYAANIYNRPPQPQQQNQSQQNNYDLSSNRYNPGWRNHPNLRWSSPQQQQQQPAPSFQNAAGPSRPYIRSPIQQQQQPQKQQTVKAPP

SEQ ID NO: 115806 - protein, 229 aa, Glycine max
  Coding DNA Sequence Number=SeqID_24121
CLALKSKVQGLIESGWLTFQEDGPNIKTNPLANHGGGAVNAIEVSRSHGPKLLKDVTTSRRFIYKALQKAGVIPRGEHKEDSCLMHPDGEEEQHICMQSADKEGPKRPKPLVIHFTRDTIPQRPQHPSAVSGVRPILFPYKNIHAVLWRYAPPGGSKEEATDVGSLSAKVTNITGLSGITRSGHVFTPPSLPTQPTNAKGKTKVTEEQKVKVIPAPDEEVSTEESAEGR

SEQ ID NO: 115807 - protein, 143 aa, Glycine max
  Coding DNA Sequence Number=SeqID_24122
  Subcellular localization annotation: CTP_CleavageSite=54; ConfidenceScore=5.51e-01
VRACSPTKVKAHDPLTARTCSPLKLKARTSSPLEVRACSPLMVRTCSPLKARITSTQGEGVSPLKVRTCSPLKARTCSPLNGEGRVVLSRRGRVVLSTVRPSGGEGRVVLSRRGRVVLSTVRACSPLMVRTCSPLKARITSTQ

SEQ ID NO: 115808 - protein, 318 aa, Glycine max
  Coding DNA Sequence Number=SeqID_24123
  Homolog annotation: Hit_ID=Q6WAY6; Match level="QueryCoverage=33%, HitCoverage=19%, E-value=2e-13, Identity=36%"; Hit description =Putative uncharacterized protein
IPRWKEGKEGVLFSCGGYPNIPLVGTRGCINYNPTLAIRQLGYPMRGAPTEESMSPFLVRDLGAQSSKTIQRIHKAWETPLRKDQELRGIRNGIIGGYHEWLKAHIRGLDWLAKLKVVSEESFEAPEEDEEVQALKSELGKAKLAKEKFKWPLHTFGRSVPETKRARKEEYGRNKFRGALWGSNSELKLRREERDQSRAHSMVLKEELIACSRSKRSLSQRLCETETNMLAIIAKYQEELGLATAHEHRIADEYAQVYAEKEARGRVIDSLHQEATMWMDRFALTLNGSQELPRLLAKAKAMADTYSTPEEIHGLLGY

SEQ ID NO: 115809 - protein, 176 aa, Glycine max
  Coding DNA Sequence Number=SeqID_24124
  Pfam annotation: Domain name=G-patch; Domain location=80-118; Score =8.8; E_value=0.016; Accession=PF01585.14; Description=G-patch domain
TPVDPLDGKSFPLHSPKTEVRSGGAFGHCIGGGRRLGKLPVLYAISGSRGGVIGTTFQSFEVVSIASIDSLSGQPCLSDTAMMVARVMLGYGYEPEMGLGKNNEAKVRGWDDKSKGPPCHISRSFISAGLRHEGQVIAICEDDSPSRSDLVRPCPPGFRLGNWRVEEHLDIYATSI

SEQ ID NO: 115810 - protein, 78 aa, Glycine max
  Coding DNA Sequence Number=SeqID_24125
  Gene Ontology: Mol. function=structural constituent of ribosome; Cellular component=ribonucleoprotein complex; Biological process =translation
  Homolog annotation: Hit_ID=A9QC54; Match level="QueryCoverage=100%, HitCoverage=33%, E-value=5e-33, Identity=77%"; Hit description =Ribosomal protein L2
  Pfam annotation: Domain name=Ribosomal_L2; Domain location=22-78; Score=72.4; E_value=1.5e-18; Accession=PF00181.14; Description =Ribosomal Proteins L2, RNA binding domain
MAIHLYKTSTPSTRNGARRQSSRNARGIITAGHRGGGHKRLYRKIDFRRNEKNIYGRIVTIEYDPNRNAYICLIHYGD

SEQ ID NO: 115811 - protein, 98 aa, Glycine max
  Coding DNA Sequence Number=SeqID_24126
QQVTLRAESQHFASVNDANPCVASIPYFGFIDEIWELNYVKFTGKTIGVNVEDDDSYMDTYVSPLTAQITPNVVREEEADDVHANRNDHNEGELINIV

SEQ ID NO: 115812 - protein, 74 aa, Glycine max
  Coding DNA Sequence Number=SeqID_24127
  Homolog annotation: Hit_ID=A2I5F8; Match level="QueryCoverage=83%, HitCoverage=4%, E-value=5e-12, Identity=53%"; Hit description =Integrase
MWDTLRLTHEGTTDVKRSRINALTHEYELFRMNANENIESMQKRFTHIVNHLAALGKEFQNEGTRDGTIEIAPQ

SEQ ID NO: 115813 - protein, 83 aa, Glycine max
  Coding DNA Sequence Number=SeqID_24128
MSGLTHDSPQISASSHQLDFAPYTSRSYSAQWNAMGLLHDKHMLCSSHILGEMEVEEPWLGLWLPLNYRVDMGASQHRTLELG

SEQ ID NO: 115814 - protein, 174 aa, Glycine max
  Coding DNA Sequence Number=SeqID_24129
MSHHSSSVNGKGTSHKDPLSRILDELSSLKLWKEKQERKEKGKKRVEEISQDQRKKIREEERRKIMKEMKREKHASYSSHNSCKSLSEELRDYYEGRHRSHLRPHSHRREKERKPQEANIKLSYFQGKDNVEANIDWEIRVEQQLKKKSTSKILWPSLLSKERPRSRHLKGDTF

SEQ ID NO: 115815 - protein, 221 aa, Glycine max
  Coding DNA Sequence Number=SeqID_24130
  Gene Ontology: Mol. function=cobyrinic acid a,c-diamide synthase activity; Cellular component=plasma membrane; Biological process =selection of site for barrier septum formation
  Homolog annotation: Hit_ID=P0AEZ5; Match level="QueryCoverage=100%, HitCoverage=81%, E-value=1e-112, Identity=93%"; Hit description =Septum site-determining protein minD
  Pfam annotation: Domain name=CbiA; Domain location=11-170; Score= -0.5; E_value=4.3e-05; Accession=PF01656.14; Description=Cobyrinic acid a,c-diamide synthase
MGCERRVVYDFVNVIQGDATLNQALIRDKRTEQLYILPASQTRDKDALTREGVEKVLNDLAAMDFDFIVCDSPAGIETGALMALYFADEAIITTNPEVSSVRDSDRILGIISSKSRRAENSEEPVKEHLLLTRYNPGRVTRGDMLSMEDVLEILRIPLVGVIPEDQSVLRASNQGEPVILDANSDAGKAYADTVDRLLGEERPFRFIEEEKKGFLKRLFGG

SEQ ID NO: 115816 - protein, 45 aa, Glycine max
  Coding DNA Sequence Number=SeqID_24131
MTEGDWKHGRKIPRKAQHRKFSGTRENFRVQRKMRRIPEKEIEKL

SEQ ID NO: 115817 - protein, 118 aa, Glycine max
  Coding DNA Sequence Number=SeqID_24132
MRILLIGQGSKNYKVVSQWGLLSWEPDLDIWRKTNLGVKVSVSGRTSILFHKARVTMMIWKQRAKLVMATARWALKHPIYGIVILRSGIYTKQTQRFPIIFFHQFNEFIHSYLGYSRK

SEQ ID NO: 115818 - protein, 77 aa, Glycine max
  Coding DNA Sequence Number=SeqID_24133
MSLHVLYLYAFSGISPRDFLSVVSLVTIFQRNERGFEAFSPHGQDHLELPSGVETKHERQKPIKVLKDGCKWGWGHD

SEQ ID NO: 115819 - protein, 91 aa, Glycine max
  Coding DNA Sequence Number=SeqID_24134
MFAHSIKGCRPLGRTCGVLIPSPKWPRGNLPQRDPGRIKRPKELVPLPSMIVTALGALNTSSASRPSRDGHFSGSDASSSGTMSIPISRRR

SEQ ID NO: 115820 - protein, 65 aa, Glycine max
  Coding DNA Sequence Number=SeqID_24135
VVVIIKKGENVNHEDFDDVKKIKPWIMVVIIKKGENVNHAYLDDVEKKSLDCHHQKGGECECMYT

SEQ ID NO: 115821 - protein, 151 aa, Glycine max
  Coding DNA Sequence Number=SeqID_24136
  Gene Ontology: Mol. function=NADH dehydrogenase (ubiquinone) activity; Cellular component=integral to membrane; Biological process=electron transport
  Homolog annotation: Hit_ID=Q5MA12; Match level="QueryCoverage=82%, HitCoverage=87%, E-value=1e-63, Identity=97%"; Hit description=NADH -ubiquinone oxidoreductase chain 1
  Pfam annotation: Domain name=NADHdh; Domain location=1-131; Score= -155.4; E_value=0.00032; Accession=PF00146.12; Description=NADH dehydrogenase
MLSHRQRLGKRGRATCRETCTCGSGRGPRYTVLICVGPRNSSEIVMAQKQIWSGIPLFPVLVMFFISRLAETNRAPFDLPEAEAESVAGYNVEYARDAILNSPLLAEANVPGSRGLILTETRGGVFTNLKIEDFRASGISPSPSKRMRALT

SEQ ID NO: 115822 - protein, 22 aa, Glycine max
  Coding DNA Sequence Number=SeqID_24137
MSMMKEATESTFWDYKSSKLKK

SEQ ID NO: 115823 - protein, 78 aa, Glycine max
  Coding DNA Sequence Number=SeqID_24138
MSKCPMCGTSRYKVKDEEETNYDEKSKKGPPAKILWYLPIIPRVQIATKPTWAFQDVPPEGGCFWRKQPGLPRRAELA

SEQ ID NO: 115824 - protein, 154 aa, Glycine max
  Coding DNA Sequence Number=SeqID_24139
  Gene Ontology: Mol. function=zinc ion binding
  Homolog annotation: Hit_ID=A3J2Y0; Match level="QueryCoverage=60%, HitCoverage=73%, E-value=7e-27, Identity=63%"; Hit description =Putative regulatory protein
MSDERVRYNDSDLQEFKAIIKEKIEKAEKDLQLIRESFINDQNNGTDDTSPTFKAFEEGAETLSKEQNSILAGRQEKFVRDLKNALIRIENKTERIKNKFFPDQHKNYTIDDQFNSDKREREKEIDKLLGKMGKNGINDLSPKDRKRLDELSKK

SEQ ID NO: 115825 - protein, 186 aa, Glycine max
  Coding DNA Sequence Number=SeqID_24140
MGVLLRSSVNQGIRCCPSRSSYRSSVGAIVSNDLPRESVSTNQLPLYESDHYTPRDIGEGSHFDPFGEIIYCHENEAMTVQSLRFDGPYDVYPPHGKRLRGGHDIQRMWWRIDIVRKRLTFMAFPYMDAAITFHGEPVITRSQDLPGHSMPIGVCSKRTLVDFLDHVVRLFGIHASQESHVMVSFI

SEQ ID NO: 115826 - protein, 66 aa, Glycine max
  Coding DNA Sequence Number=SeqID_24141
PEIYPKAHQNPRAFSCISGSIFLESSIQCPCGGTSTWFFKENKGGTSLVDLWPAKDFARLKEISRT

SEQ ID NO: 115827 - protein, 33 aa, Glycine max
  Coding DNA Sequence Number=SeqID_24142
MAPKKLPAKRARKDAAGEGSSMAPQVDVKFDGH

SEQ ID NO: 115828 - protein, 163 aa, Glycine max
  Coding DNA Sequence Number=SeqID_24143
MATMMEAMMSMKKIMEANVVTIVATSTVAKVNPMPPSGLNQMNHPTSAMVGKDLGSTGGPHDVQIQNEHAFLPYGLPLNYTQPNVAYTPNKNVNNSTPIPIESQQPQTDHAHGKQLVVYPYKTLWRALSIIPSYTSCIPQQVKTLMLWQNGKVGSSRGKAQGH

SEQ ID NO: 115829 - protein, 154 aa, Glycine max
  Coding DNA Sequence Number=SeqID_24144
  Gene Ontology: Mol. function=alkanesulfonate monooxygenase activity
  Homolog annotation: Hit_ID=A1VJN9; Match level="QueryCoverage=98%, HitCoverage=44%, E-value=4e-66, Identity=79%"; Hit description =Luciferase family protein
NAAAVSDWYFTNGNTVEGIQAQVDDIRAKAAANKHHVKIGVNAFVIARDTEEEAKAVLKEIIDKANPEAVNAFGHEVKNAGAASPEREGNWAKSSFEDLVQYNDGFKTNLIGTPQQIAERIVALKAVGEEVAYFGEKVLPLVRELEAKTLAKAA

SEQ ID NO: 115830 - protein, 256 aa, Glycine max
  Coding DNA Sequence Number=SeqID_24145
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-26, Identity=29%"; Hit description= UPI00006A17C9 related cluster
  Subcellular localization annotation: CTP_CleavageSite=97; ConfidenceScore=5.25e-01
MARTCSPLKMSAWSRLMARTCNPLKVREYSPLMARTYSPLMARTCSPLKVRACNPLIVKTCSPLKVGACRPLMARTCSPIKARMSSPLKSSEGDACSPMMAKACSPLKVRTCSPLMPRTCSPLKVRACSPLMARTCGPLIARSCGLLKARMSSPLKVRACSPLMARTCSPLKVRACNPLIVKTCSPLKVRACRPLMARTCSPIKARMSSPLKKVTACSPMMARTCSPLKVGVCSHLMARKSSPPKVRACNPLMART

SEQ ID NO: 115831 - protein, 96 aa, Glycine max
  Coding DNA Sequence Number=SeqID_24146
MGERKRRRKEGKKAPDQGSKENRRNVQRGLWTGRYLNNTELSPNEQKGRKGNHDLNACLHFSGENTETFSSLTGYPELRRSEFLIGGYVGARGGIL

SEQ ID NO: 115832 - protein, 266 aa, Glycine max
  Coding DNA Sequence Number=SeqID_24147
MHKSVTLNVCMSSAPDYDNHLFRSAEHQQRFEAIKGWSFLRERRVQLRDDEYTDFQEEIVRRRWALLVTPMAKFDPDIVLEFYANAWPTEEGVRDMRSWVKGQWIPFDADALSQFLGYPLVLEEGQECEYGQRRNQADGFDEEAIAQLLCIPGQDFARTAAGRRVRIMRTNMTTLTQIWMTLLLSNIQPSDHNSDLPLPKCQLVYIVLTRRSIHVAQLIADAIYLFAGMALTRHPLDPDKSNRALGFPALITGLCQLFGVPVAPSK

SEQ ID NO: 115833 - protein, 260 aa, Glycine max
  Coding DNA Sequence Number=SeqID_24148
LSEELRDYYEGRHRSHLRPHSHRREKERKPQEANIKLSYFHGKDNVEANLDWEIRVEQQLKNKSTSKSYSSHFYPKKDQGQGILGVTPSKPDDMGEDIYRKVQALRLDTLLLNAPPQENHDYEGQDIYSSQDEATTSPSSSKSEEAKGEESSEEIYPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIINMKIQKK

SEQ ID NO: 115834 - protein, 220 aa, Glycine max
  Coding DNA Sequence Number=SeqID_24149
MKEMKREKHVSYSSHNSCKSLSEELCDYYEGRHRSHLRPHSHRRENERKPQEVNIKLPYFHGKDNVEANLDWEIRVEQQLKRKSTSKSCGSHSYPKKDQEDTLLLNAPPQKPMIMRGQDFYSSQDKATTSPSSSESEKAKGEESSEEIYPQEEGQPLVVKEKCKELSVSSKRLAKKETHFTIKTNIKETFPLRQPPHFLFCKKTLASIATSLRLEFIPQV

SEQ ID NO: 115835 - protein, 322 aa, Glycine max
  Coding DNA Sequence Number=SeqID_24150
  Gene Ontology: Mol. function=RNA-directed DNA polymerase activity; Cellular component=mitochondrion; Biological process=RNA-dependent DNA replication
  Homolog annotation: Hit_ID=A7QD21; Match level="QueryCoverage=71%, HitCoverage=44%, E-value=1e-105, Identity=83%"; Hit description =Chromosome undetermined scaffold_79, whole genome shotgun sequence
  Pfam annotation: Domain name=Intron_maturas2; Domain location=166 -307; Score=145.9; E_value=1.1e-40; Accession=PF01348.12; Description= Type II intron maturase
MRDLIKYCKRKGLLIELGGEARLVIRINNNSCTEYGRIPRYGHSGSPSEDDSHTILARAGEASTADEGDERNRESTGRVPLAETLGTAGVRSPQVSVLWGTVQHIWQGSRGISLLHSSGRSNAPSDVQEAVARSGMSVRKLSLYTPAGRKAAGEGGGHWAGSISSEFPIQIEAPIKKILRRLRDRGIISRRRPWPIHVACLTNVSDGDIVNWSAGIAISPLSYYRCRDNLYQVRTIVDHQIRWSAIFTLAHKHKSSARHIIPKYSKDSNIVNQEGGKTLAEFPNSIELGKLGPGQDPNNKEHSTTSLVVFFLLVAMRTGVYL

SEQ ID NO: 115836 - protein, 195 aa, Glycine max
  Coding DNA Sequence Number=SeqID_24151
MTQDLVARGDTLRLSAPLCHPEAAGPMTRGDTLWLSAPLCHPEAAGPMTRGDTLRLSAPFCHPEAAGPMTRGDTLRLFAPLCHPEAAGPMTCGDTLRLSAPFCHPEATGSMTRRDKIWSFCTLVSSRGGGPDDTWRYLTVIRTLVSSRGGGPDDTRRYLTVIRTLLSSRGGGPDDTQRQNLVILHPCVIQRRQAR

SEQ ID NO: 115837 - protein, 150 aa, Glycine max
  Coding DNA Sequence Number=SeqID_24152
MIRGDTLRLFAPFCHPEAAGPMTSRDQVWSFCTLVSSRGGGPDDTRRYLTVIRTLLSSRGGGPDDKQRPSLVILHPRGGGPDDTRRYLTVIRTPFVIQTQSCPMAQQRPSLVILPTHDTRRYLMVIRTLLSSRGGGPDDKQRPSLVILHP

SEQ ID NO: 115838 - protein, 87 aa, Glycine max
  Coding DNA Sequence Number=SeqID_24153
MSRGRCLKCSTPQSRTVAVTGVGSVELGGLEGNALHHLQLVSGQACVFERWPQVSQFAHAQVLENLGASAHFGVDLRLASLEWLDRL

SEQ ID NO: 115839 - protein, 256 aa, Glycine max
  Coding DNA Sequence Number=SeqID_24154
MAGTKVFWAKTNRKPKTANAVLADGAKRYYIQQVDPETTYYIWVESATGNSLAKGKAYTNKNWQLDGAELDEVKKNPSSRAVPLGMEVYWQDEFNDQFLNRNKWTTNYFSSLNYLNAKSKDEMLHDRLSQPAYTLNGSAINLFVNDTIPKRIFTEGGNQKISSIQTYDWKSNENLLDNSRGGYFEVKVRRNRQGNPKGTNTAFWFDSPGPDIRYYLQEGGEADGIKGIRPKGQLFEIDVFEYITAQFVIHGHVDSK

SEQ ID NO: 115840 - protein, 77 aa, Glycine max
  Coding DNA Sequence Number=SeqID_24155
MKSGQGVPTDPKRIKVIPDWPTPPSVEGRSPEYDRTSDLRSNPSKVEGMMQSYPPRVLDRRLKEDRLELLKKALGFS

SEQ ID NO: 115841 - protein, 68 aa, Glycine max
  Coding DNA Sequence Number=SeqID_24156
MRSFNGDFPPWRCSGRKRRRGERRRHPLGNKPWKKELHHQDEPWIRSLDRMLQWRKRKRLGSFLEKLS

SEQ ID NO: 115842 - protein, 127 aa, Glycine max
  Coding DNA Sequence Number=SeqID_24157
  Gene Ontology: Mol. function=RNA-directed DNA polymerase activity; Biological process=RNA-dependent DNA replication
  Homolog annotation: Hit_ID=A5AKY2; Match level="QueryCoverage=96%, HitCoverage=24%, E-value=8e-10, Identity=26%"; Hit description =Putative uncharacterized protein
MYYIPKESNTRADLLSKLANTKKVGHLKTIIQEMLQTLTIDAKEIMAREEEEPNWVTPYKNFLIWGVLPPNKDESRRLKQKGMDILGPLPKALREIKYLLVANDYFTKWIEARPLQEITTSEMEKFT

SEQ ID NO: 115843 - protein, 160 aa, Glycine max
  Coding DNA Sequence Number=SeqID_24158
  Gene Ontology: Mol. function=RNA-directed DNA polymerase activity; Biological process=RNA-dependent DNA replication
  Homolog annotation: Hit_ID=Q0ZCD0; Match level="QueryCoverage=60%, HitCoverage=8%, E-value=2e-10, Identity=34%"; Hit description =Integrase
MERSMIDVASGGALADMTPVEARNLIEKMTSNSQQFSARNVAIVLRGLAMNKKSTPVARVCGLCSSADHHSDLCPSLLQSGVNEQPEAYAANIYNRPPQQQNQQQQNNYDLSSNRYNPGWRNHPNLRWTSLPQQQQSIPPFQNAAGPSKPYVPPPMQQQQ

SEQ ID NO: 115844 - protein, 113 aa, Glycine max
  Coding DNA Sequence Number=SeqID_24159
  Pfam annotation: Domain name=zf-CCHC; Domain location=27-44; Score =26.7; E_value=8.8e-05; Accession=PF00098.14; Description=Zinc knuckle
MHIYCYFREILNVGPKRGSPENSSSTLKCFECNQPGHLRVDCPIFKKKMEKSEKKNHSEKKLKKAYITWDENDLESSDDSENEEINLCGLMAKSYESDEEAFASVKDQLNLQN

SEQ ID NO: 115845 - protein, 347 aa, Glycine max
  Coding DNA Sequence Number=SeqID_24160
  Gene Ontology: Mol. function=hydrolase activity, hydrolyzing O -glycosyl compounds; Cellular component=extracellular region; Biological process=carbohydrate metabolic process
  Homolog annotation: Hit_ID=A3IKY8; Match level="QueryCoverage=96%, HitCoverage=90%, E-value=1e-56, Identity=37%"; Hit description =Glycosyl hydrolase, family 10
  Pfam annotation: Domain name=Glyco_hydro_10; Domain location=9-340; Score=196.2; E_value=8e-56; Accession=PF00331.11; Description =Glycosyl hydrolase family 10
VAGGDRKSGLNDIARRKGLFFGSAVNVSELTNDAQAKAIIDDCGIITAQRAQKWPIMWQYQDHETPEEADLVAQFSFQHGLLLRGHALIYDAFMPDWVKALDKTAMRRAFDRRISYAASRWKGKVHSWDVVNEAIEPNDHLANGLRNSLFMKALGPSYISDAFFRAKECDPSALLCYNDYNLDSTASFADRRRRTVLKLLESLKKRGAPVEALGVQSHLKSQLKYDDRIWRDFLKEVADLGLKIIVSELDVNDRYFSEDIARRDAQVASMTSRYLNVTLDEPKVIGIVSWGLNDGQSWMAARQRKGDPGFIRADGAVPRPHPLSSSLEKKPMWYAIADALRAAPDRS

SEQ ID NO: 115846 - protein, 61 aa, Glycine max
  Coding DNA Sequence Number=SeqID_24161
MAPTRYPLDPDKSNRALGFPAPITGLCQSYRVPVTPSKAHCHHLGRPIQLGHWEWSAIYNI

SEQ ID NO: 115847 - protein, 56 aa, Glycine max
  Coding DNA Sequence Number=SeqID_24162
MCRLAPRSEFDVRQIPVWGKLKHGCQGGQCISHLVLFPRAMMSSSGNLLDKWPQIS

SEQ ID NO: 115848 - protein, 110 aa, Glycine max
  Coding DNA Sequence Number=SeqID_24163
MAPKKLSAKRSRRDTAAEGTSAATEFDSHHFRSAEHPQCFEAIKGWSFHRERRVQLRDDEYTDFQEEIAHRHWMSLVTPMAKFDPDIVLEFYANAWPTEEGVRDMRSWVR

SEQ ID NO: 115849 - protein, 202 aa, Glycine max
  Coding DNA Sequence Number=SeqID_24164
  Homolog annotation: Hit_ID=UPI00006A2D9E; Match level="QueryCoverage =52%, HitCoverage=65%, E-value=5e-08, Identity=17%"; Hit description =UPI00006A2D9E related cluster
VDSRGSHCQKSKGSIVAQSVKFRNISEAKEGMIMIFQQKAVPSGGSNLTRLGELRSPGRAGLPSLVTDAWGANTFPVRKYNSRTFHLKFVDHVFFGLHVLAVRGLHVLTFRGLHIQTFKGLQALAFIGLHAPTFRGLHALTFSGLHVLAFRRLHVLTIEGLHILPFRGQQALAFKGLHALTFRGLHVLAFRGLHALAFRGLH

SEQ ID NO: 115850 - protein, 201 aa, Glycine max
  Coding DNA Sequence Number=SeqID_24165
MGDQEETQEQMKADMSALKEQMASMMEAMLGIRQLMEKNVATAAAVSSAAEADPTLLATAHHPPSNIVGRGRDTLGHDGNPHLGYNRAAYPYGLPPNYSPPVLQDDAGHIASPVLEREPPQQPDEVHKDPQDYARRDVEFYPPIPEGPAPSTLPQPNITTQPIVLSTEGPSPATEERRKLDLLEERLRAVERIWGTIRSQT

SEQ ID NO: 115851 - protein, 74 aa, Glycine max
  Coding DNA Sequence Number=SeqID_24166
MVAVTLAKVHQPPFIREYDSNATCACHGEAPGRSIEHGRALKRKDFQVQAIGQFAQATCAPEFGLPTPFNRGIL

SEQ ID NO: 115852 - protein, 40 aa, Glycine max
  Coding DNA Sequence Number=SeqID_24167
MSARKDDRSRLKAQVEKDKGLSGEGQSPRVEKDEGPSGEG

SEQ ID NO: 115853 - protein, 143 aa, Glycine max
  Coding DNA Sequence Number=SeqID_24168
MAAQLIHDRVVMECLEGVWETLEGNERCRFRGTVRLTATSLVHPEQPARPLQQPVEWIIPMPTPYPLVELVQLIEVSSSEEDLEEDPKELPPEPAMDAPDLPEDDEEPLPDVDSSEDIMPASEADSTEESGLGGTTSSDDSSS

SEQ ID NO: 115854 - protein, 158 aa, Glycine max
  Coding DNA Sequence Number=SeqID_24169
  Pfam annotation: Domain name=G-patch; Domain location=30-80; Score =6.4; E_value=0.032; Accession=PF01585.14; Description=G-patch domain
LTLFFFTPPPIYSKIGEELATQLAQASKVASSRSNSLLEEGSGWPKHGYEPRMGLGKDSHGNADVVNIRGNPYKYRLGYEPGKPGRRNAPSRLLADRAWPGHVSQCFTCAGIMFEEEVAAIGEEAPQDPPSFVRPCHPNYQVGNWRVMSQSEVYTTDS

SEQ ID NO: 115855 - protein, 118 aa, Glycine max
  Coding DNA Sequence Number=SeqID_24170
  Gene Ontology: Mol. function=phosphoprotein phosphatase activity
  Homolog annotation: Hit_ID=A5AWR0; Match level="QueryCoverage=84%, HitCoverage=9%, E-value=3e-13, Identity=41%"; Hit description =Putative uncharacterized protein
  Pfam annotation: Domain name=DUF1723; Domain location=82-118; Score =37.5; E_value=4.9e-08; Accession=PF08330.1; Description=Protein of unknown function (DUF1723)
MAPSSSSSSSIHIKSSPIDGDVLRMQAKHVSEHVWNGEPDRKLHIRRVVPIYQGLEEIPEEIIPLLRRQFGFYWIMKMGYLKLNLSLITALIERWRPETYTFHLRCGEATITLQDVSV

SEQ ID NO: 115856 - protein, 64 aa, Glycine max
  Coding DNA Sequence Number=SeqID_24171
MTKVNKEPFSRLGRVDGDPVLRETRIWATWEYVSSVGGGQQGMVGLCAICECGKLVVHHRSTAT

SEQ ID NO: 115857 - protein, 85 aa, Glycine max
  Coding DNA Sequence Number=SeqID_24172
MNNGSSREIQMVITLNTEVRSKIIIVATYPSAGGRRETRGMRVPRKEYARSRHQRLFEENVGKTGKDAICELFSERFGSCIYARE

SEQ ID NO: 115858 - protein, 78 aa, Glycine max
  Coding DNA Sequence Number=SeqID_24173
MDGRFTDECQRSDALVVALFLQTMVQSPKTIVERHCAAFLYAKLYITKLVASHDFFSVFGFKLDFCHRSVASSTEGRP

SEQ ID NO: 115859 - protein, 106 aa, Glycine max
  Coding DNA Sequence Number=SeqID_24174
RTVEWILPTPTPYRLVEPVQVIEVTSSEEDPEEDLAELPPEPAVDALDFLEGDEDPLLEVDSPEEVMSASEADSTEDSGPGEMAEFDDCIHVAEATTMDTFALDDT

SEQ ID NO: 115860 - protein, 133 aa, Glycine max
  Coding DNA Sequence Number=SeqID_24175
MGLLEVRSRRERVGVSNGSYGGRELTEFNQFIEDIELLDISLIGRSFTCYRANGRAKSLTISGSQLLVPRQEILQGGGGGIEGFEYGGNAPTIWDQHRLKGALKLGVFTPKAYTPKSPSGPLLTNSGPIQKTF

SEQ ID NO: 115861 - protein, 88 aa, Glycine max
  Coding DNA Sequence Number=SeqID_24176
MTIEESIHVTFDETNITSPRKEIVDDIADTLEDTQNEERNLKRKRDDEDKDDQDDTTQENDNLPKEWKTSRNHPLDDIIGDILNRGNN

SEQ ID NO: 115862 - protein, 199 aa, Glycine max
  Coding DNA Sequence Number=SeqID_24177
MERSMIDATSGGALGDMTPAEARNLIEKMASNSQQISARNDAIVIRGVHEVATNSSSLAETKKLEDSVVYAPLPTTTQTFALLCNNLKQLNSLKLMLQTYIIDLLNLSSKISHNRTIRKVEKLKGSERISMGRNVSALIGKSVPQIPEKCKDPANRSVAYPAGFLKDVLVRVGELIFPVDFYILNMEERFSQGSVPIIL

SEQ ID NO: 115863 - protein, 81 aa, Glycine max
  Coding DNA Sequence Number=SeqID_24178
  Homolog annotation: Hit_ID=A2Q1A3; Match level="QueryCoverage=72%, HitCoverage=15%, E-value=1e-08, Identity=47%"; Hit description=RNA -directed DNA polymerase
MSTKMNISTHEKVAIAYGEDTGKILKCILKSFELVSGLKINYNKSKFGCLGKSEDWCREAASSLNCSQMDIPFSYLGIPVG

SEQ ID NO: 115864 - protein, 101 aa, Glycine max
  Coding DNA Sequence Number=SeqID_24179
  Subcellular localization annotation: CTP_CleavageSite=40; ConfidenceScore=5.23e-01
MTSSWIMVTKSGAVDKSEALAPTYPPMRNSDLRSSGKLVRLEKVSVFFSTKMQTCFSKETNIPTDLEQHMLFLSEKTMRPPGEGESADKISHNHKMRFLDV

SEQ ID NO: 115865 - protein, 45 aa, Glycine max
  Coding DNA Sequence Number=SeqID_24180
MATISLLSRYENVQQAGSVADLGVAFVDDWVFLANRMMGSEKGWY

SEQ ID NO: 115866 - protein, 73 aa, Glycine max
  Coding DNA Sequence Number=SeqID_24181
MTATATKSISLKPLGRDGTVRRHLVEEIPIVVPRYVIKPLATVAEGAVGNGHVDDKLSVAEGGEEGAEAGSGN

SEQ ID NO: 115867 - protein, 106 aa, Glycine max
  Coding DNA Sequence Number=SeqID_24182
MRKRQIDINDSVCPFCSIKEETASHLLHNNGMKGGKKYNRWKCWWVALNWSIWQHRNKIIFTNAPFNGSNLLEDALFLAWKWFRTMEKNFTMHFNYWSSNLPAGFL

SEQ ID NO: 115868 - protein, 35 aa, Glycine max
  Coding DNA Sequence Number=SeqID_24183
MPGADHKQPNHKGGETSSSTESKNLEILGVKILCQ

SEQ ID NO: 115869 - protein, 35 aa, Glycine max
  Coding DNA Sequence Number=SeqID_24184
MGRSRRCGCSNLERAKHGSDSVSLQCGDWARRCCF

SEQ ID NO: 115870 - protein, 259 aa, Glycine max
  Coding DNA Sequence Number=SeqID_24185
  Gene Ontology: Cellular component=cytoplasm
  Homolog annotation: Hit_ID=Q5PKF1; Match level="QueryCoverage=100%, HitCoverage=83%, E-value=1e-95, Identity=66%"; Hit description =Protein fdhE
  Pfam annotation: Domain name=FdhE; Domain location=6-259; Score =425.9; E_value=5.6e-125; Accession=PF04216.3; Description=Protein involved in formate dehydrogenase formation
MSIRIIPQEQLEKSEKNTAEQVPPLLFPRLKNLYSRRAARLRDLAAKNPLGDYLRFAAVIAQAQEIVLYDHPLQIDLHQRLAESAQQGKPPLDIHTYPRDVHWQRLLHSLIAELKPEMSGQALAVLENLEKASSTELETLASALLEGEFAQVSSDKAPFIWAALSIYWAQMAAMIPGKARAEYGEHRQFCPVCASVPVASVVHMDVGQQGLRYLHCNLCESEWYVVRSKCSNCEQTRDLHYWSLDSEQAAVKAESCGDC

SEQ ID NO: 115871 - protein, 191 aa, Glycine max
  Coding DNA Sequence Number=SeqID_24186
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=69%, E-value=3e-33, Identity=95%"; Hit description=LacZ protein
  Pfam annotation: Domain name=DUF827; Domain location=38-172; Score= -109.2; E_value=0.027; Accession=PF05701.2; Description=Plant protein of unknown function (DUF827)
MFFLRYPLILWITVLPPLSELIPLAAAERPSAASHWHDRFPDWKAGSERNAINRRTLVEQELEKAQEEIPEYKKQAETAEQEKGQVLKELDSTKRGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 115872 - protein, 85 aa, Glycine max
  Coding DNA Sequence Number=SeqID_24187
MTIEESIHVSFDETNMTSPTKEFLDDIADSLEDMHNQERNLKQKRNEENKDVQDDIAHENDDLPKEWKTSRHHPLDNVIEDISKG

SEQ ID NO: 115873 - protein, 239 aa, Glycine max
  Coding DNA Sequence Number=SeqID_24188
  Gene Ontology: Mol. function=oxidoreductase activity; Cellular component=integral to membrane; Biological process=electron transport
  Homolog annotation: Hit_ID=A4WFT1; Match level="QueryCoverage=56%, HitCoverage=33%, E-value=1e-57, Identity=82%"; Hit description =HI0933 family protein precursor
  Pfam annotation: Domain name=DAO; Domain location=12-220; Score= -33.4; E_value=0.0017; Accession=PF01266.15; Description=FAD dependent oxidoreductase
  Pfam annotation: Domain name=HI0933_like; Domain location=11-236; Score=36.8; E_value=1.7e-19; Accession=PF03486.5; Description=HI0933- like protein
  Pfam module annotation: Pfam domain module=DAO::HI0933_like; Domain location=12-220::11-236
MTMITNSSSVPDAVVIGAGAAGMFCAAMAGQAGRRVLLLDNGKKPGRKILMSGGGRCNFTNLYVEPAAYLSQNRHFCKSALARYTQWDFIDLVGKHGIAWHEKTLGQLFCDDSAQQIVDMLVAECEKGGVVMRLRTEVLEVAREDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 115874 - protein, 263 aa, Glycine max
  Coding DNA Sequence Number=SeqID_24189
  Gene Ontology: Mol. function=nucleoside-triphosphatase activity; Cellular component=cytoplasm; Biological process=proteolysis
  Homolog annotation: Hit_ID=A8GLK5; Match level="QueryCoverage=95%, HitCoverage=47%, E-value=1e-110, Identity=78%"; Hit description =ATPase associated with various cellular activities AAA_5
VDSRGSQIWKAGPAILNTLLTAINERRFRNGNSEEPIPLRLLVTASNELPEADNSLEALYDRMLIRLWLDKVQDKQNFRSLLVNRQSESQNPVPATLSVSDEEFLQWQPQIDKVALPEACFELIFQLRQRLDALEQAPYVSDRRWKKALRLLQACAFFSGRDAIAPLDLMLLKDCLWHDLTSLKLLQQQIDQLLTESAYQQHSMLIQLQQIHTRWLQDQQQQSDRQAISLVKKGGMFSRKPQYAPATPFAGGTLTLLGYRARS

SEQ ID NO: 115875 - protein, 253 aa, Glycine max
  Coding DNA Sequence Number=SeqID_24190
  Gene Ontology: Mol. function=lyase activity; Biological process =phosphonate transport
  Homolog annotation: Hit_ID=A9CKL9; Match level="QueryCoverage=97%, HitCoverage=66%, E-value=1e-129, Identity=92%"; Hit description =Putative uncharacterized protein phnI
  Pfam annotation: Domain name=PhnI; Domain location=1-253; Score =426.6; E_value=3.6e-125; Accession=PF05861.3; Description=Bacterial phosphonate metabolism protein (PhnI)
MTVKRRVSATYKDLPGGQLLGPTFDYTHRLLDPSLLEDQTVEAATQRDSEPEHVMRVSDILAQEGLIESDGELPDDHIAGDLTREPMEFPMSRDLRLQSLARGDEGFLLALAYSTQRGYGRTHPFVGEIRIGDVEIQLDVPELGFAVSLGDIQVTECQMVNQFKGSSKAPPQFTRGYGLVFGQSERKAMAMSLVDRALRAGEFGEDVVAPAQDEEFVISHADNVQATGFVEHLKLPHYVDFQAELGPRPKNAC

SEQ ID NO: 115876 - protein, 82 aa, Glycine max
  Coding DNA Sequence Number=SeqID_24191
  Homolog annotation: Hit_ID=A5AV98; Match level="QueryCoverage=47%, HitCoverage=5%, E-value=2e-07, Identity=61%"; Hit description =Putative uncharacterized protein
MAVNENFFVQFILNSLPSEYDSFQMSYNTLKHKWNMHELHNGLMQSYPAGALDRRLQVDWVRDAREGPRVLMSLRIDFGLMD

SEQ ID NO: 115877 - protein, 200 aa, Glycine max
  Coding DNA Sequence Number=SeqID_24192
  Pfam annotation: Domain name=Transposase_23; Domain location=135-200; Score=-13.8; E_value=0.039; Accession=PF03017.5; Description =TNP1ENSPM transposase
IRLRSRATQGSSVPYGRQDVLAAAIGRPEHPGRVRAAGAGVTIKQYFGSAPRMSRSASSLPPDELQQLTQQIRDQLEESITEKVTRQVMTSFSQLQSQMQSQGLAVPPEPLVGPSGPRVSTKGSCADPLGNNPKTGDFDRCGLYIEADPARLVAMGRVYEGSTVVHNTPLLPSQVKVSVEEVKDADVPVPVPTDEVSLVG

SEQ ID NO: 115878 - protein, 95 aa, Glycine max
  Coding DNA Sequence Number=SeqID_24193
MIMRGQDIYSSQDEATTFPSSSESEEAKEEESSEEIYPQEEGQPLMVKEECKEASVSSKSDQGVPMNPKRIKVIPECPTPPSVEEKTQSFKNLGI

SEQ ID NO: 115879 - protein, 345 aa, Glycine max
  Coding DNA Sequence Number=SeqID_24194
  Homolog annotation: Hit_ID=Q6WAY4; Match level="QueryCoverage=87%, HitCoverage=59%, E-value=6e-12, Identity=25%"; Hit description =Putative uncharacterized protein
VDSRGSPLAYHHSKESLVVAILADLFDTFDRRCEKNSARIVCCLPALCVWLISYLFQQDTRHPCPLQSYRSCAEKGRVDWDQHLAGIGGSAINWFPRWKEGKEGVLFSCGDYPNVPLIGTRGCINYNPALAIRQLGIHKAWRSPLRKDKELRGIRNGVIGGYHGWLRIHTRGLDWLSKLKVINEENFEAPEEDEEGRALKLELWKARLAKEKFKSAATHIQKECTELQEENAATARALEQVTKRARKEEYGREKFRGALWGSNNELKLRREERDRSRVHGMILKEELVACARSKRSLAQHLEAAEQSMLAIIGQYKEELNQSVAHEQKLVEDFAQVYAEKEARGR

SEQ ID NO: 115880 - protein, 219 aa, Glycine max
  Coding DNA Sequence Number=SeqID_24195
MLAIINQYKEKLSLAATHEQRLEDEYAKVSVLQAEREAREGVIDSLHREAMIWMDRFAFTLNRSQELPRLLAKAKAMADVYSAPEEAVNTITKHALRHPYRTRSKTRVMGDIEEVQEQMKADMVALIDQMASMMEAMLTMKRMMKSNTATIVAASAATEVLGSISGPYIGYNRNAYPYGLPPNYTPPTMHMPHAKANHAILVEGQKQQPMGGTREEPRE

SEQ ID NO: 115881 - protein, 251 aa, Glycine max
  Coding DNA Sequence Number=SeqID_24196
MDQLQSQAFHKTYGKIWDLAMIEVSIEAIAALTQYYHQPPRCFTDLGMTARIEMARIAKVVKISVQELDRVKQNRDGVVRIPRKHLEKAKALADRGGWASFIDVLASGPSSDGCLPSLLITIERKVRSLLFWPMPMTHLIEDAKRAAQGSFVAHLLFMYGWSRTSFAMKVDLFVPCKEGRAGVLSSCEGFLNIPLIGMRGCINYNHVLAVATCLSRASEGEAHGCAFQRRKDARSRHQRLFVENIGKIKGN

SEQ ID NO: 115882 - protein, 77 aa, Glycine max
  Coding DNA Sequence Number=SeqID_24197
MLVFPSRILWDFTDYATMLFLTFGMLRNFMDCTTMLVLISGMSRNFTDYLTMGVKYLEAVKRRLHATKQWSLDEIKV

SEQ ID NO: 115883 - protein, 69 aa, Glycine max
  Coding DNA Sequence Number=SeqID_24198
MACLPTICHSNVAHTPDENVDNSAPMPIESQQLQSDHAHISQPIGETHEAPQDHNLVDFEPHLRYATEG

SEQ ID NO: 115884 - protein, 163 aa, Glycine max
  Coding DNA Sequence Number=SeqID_24199
MEAMKEQMATMMEAIISMKKIREVDMVAVAATNAVAKVNPMPPSGLNQMNHPTSNMVGKDLGSTDDPMMCKFKTSTPSRHMACLPNYTPLNVAYIPNEDVNNSTPILIKSQQPQSDHAHVSRPMEETHEIPHHNLADFEPCLGYAAEGQAVGGIPLQNILEGP

SEQ ID NO: 115885 - protein, 49 aa, Glycine max
  Coding DNA Sequence Number=SeqID_24200
MPKDRGRIVIIKKGEIVDKGSSRCFDDAKRSHATQSFIQDKAIKDIQDG

SEQ ID NO: 115886 - protein, 168 aa, Glycine max
  Coding DNA Sequence Number=SeqID_24201
MDNEEGVHEQMKADLSALKDQMASISEVMLKLQKTIEDKPRQSPPVQLGKQSRYSPQAYPYGLPPDFTPRATPEDLSQAPTFEGQLPPYDDYPGQDDEEGDTHLGPLLHLKDPSPHELPQPNIVRHIPASPTPVKEFVPFAEDKGKMEALEERLRAVEGLGNYPLGIL

SEQ ID NO: 115887 - protein, 335 aa, Glycine max
  Coding DNA Sequence Number=SeqID_24202
MATMMEAMMSMKKIMEANVVIVAATSAVAKVNPMLPSGLKQMNHPTSNKVGKDLGSTDDTMMCKIKTSTPSRHMACLPNYTPPNVAYISNEDVNNSTPILIKSQQPQSDHAYVSRPMEETHEIPHHDLANFEPCLGYAAEGQAVGGIPLQNTLEGPQYHPQPQPSRSTAVKTLMTMAGMGKLDHLEERLRAIEGGEDYAFANLKELFLEPNIITPPKFKVLTLTKDGGYAKDEELLIHSFQESLTGVVVTWYPNLESSRVPFLEGPNGCLCLGSISTILIWFRIGCNYRTFAKRGMDLSKNTPQKVEGSGGPGGTPNDGKGDDDRDGRHIIDTLL

SEQ ID NO: 115888 - protein, 92 aa, Glycine max
  Coding DNA Sequence Number=SeqID_24203
MAAQLIRDRMNLHGRFSALWSGYYPRLHISSSGARSSDQRVMRIHFLRWILPRKSCRHLRQTLRRIVARGGWRSAEALHPSGQLFGLVLYTF

SEQ ID NO: 115889 - protein, 140 aa, Glycine max
  Coding DNA Sequence Number=SeqID_24204
MTKLGLCCHRARRLWMTKGCRMTKLGLCLSSGPPPLDDKKVRITVRMTKLGLCLSSGPPPLDDKKGADNRKVSPRATSSCVMATKGGVVDKSEALAPTYPPMRNSDLRSSGQLVRLEKGSVFSPLKCKHALAKRQIFQLI

SEQ ID NO: 115890 - protein, 123 aa, Glycine max
  Coding DNA Sequence Number=SeqID_24205
MGAKHLTRTKEWSHVIKQRSPDENQCMTLISLLSVDESRGSPDENQCMTLMSLLSVDESRGVRYIGSRVHGCRMTKLGLCLSSGPPPLDDKKVRITVRMTKLGLCLSSGPPPLDDKKGADNRK

SEQ ID NO: 115891 - protein, 112 aa, Glycine max
  Coding DNA Sequence Number=SeqID_24206
ETKFGHSAPLYHPEAAGPMIRGDTLRLFAPFCHPEAAGPMTSRDQVWSFCTLVSSRGGGPDEADIVFYTFCSSGNNKSFTCGNFMVTRDSRQPRGAELVSYTDFRGPLLDDM

SEQ ID NO: 115892 - protein, 75 aa, Glycine max
  Coding DNA Sequence Number=SeqID_24207
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=66%, HitCoverage=4%, E-value=2e-16, Identity=86%"; Hit description =Phosphoenolpyruvate carboxylase
LKVIVEEFYSLKGVCCSSITKVCSVVTKDVSLLSRWMAIDLYIREVDGLRFELSMNQCSDKLSELAHEILKGLSV

SEQ ID NO: 115893 - protein, 118 aa, Glycine max
  Coding DNA Sequence Number=SeqID_24208
GAFEDGEEENTLSIVGQGHLMISSEPIVEAMSSKNSLSQYIGGYILCGTSRGYIYLGVAILRTREGTSLVDQFKWRVHPLGLFKENKGGYIPCGSLACKGFYKVERNLKNHRLLGDWM

SEQ ID NO: 115894 - protein, 109 aa, Glycine max
  Coding DNA Sequence Number=SeqID_24209
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=65%, E-value=2e-33, Identity=100%"; Hit description=LacZ protein
MKRLIIFRAAHGQGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 115895 - protein, 88 aa, Glycine max
  Coding DNA Sequence Number=SeqID_24210
MSCLPWSLPEWVSQTEQLNLNNVNTIITHIGLHCSTHWQMVIILPKENLVVRFCSLHNRLDNYLKGIINSALKGLDDTPQPKSKVGIR

SEQ ID NO: 115896 - protein, 82 aa, Glycine max
  Coding DNA Sequence Number=SeqID_24211
  Subcellular localization annotation: CTP_CleavageSite=44; ConfidenceScore=5.30e-01
MEELINKTQLSPQNNPNVITPAWRLLNRISSLHPTAVILLSRTRCNVVRTNNQIPGNSLSVSTRHSHLGNHAELIETTRLCT

SEQ ID NO: 115897 - protein, 117 aa, Glycine max
  Coding DNA Sequence Number=SeqID_24212
MYVQGNPRVNVEAKLHGESKVIQRCLMITMMITKEDDKGDDKKLKDQSKNNSSESKINQRTTQNQEEFKTQEESLESRIKIQGSRSQESRSRFKTQDSRIKRRLNQDNYEKFFSKIE

SEQ ID NO: 115898 - protein, 124 aa, Glycine max
  Coding DNA Sequence Number=SeqID_24213
MVGYTPSSFTDLVFASEKIEVGLKRGKFNHPALMNEKTRANEEGENEGETHVATAIPTWPNFPPIPQCHYSANNNPSPYPPPSYPQRPSQNQQQNPPTTQPMLNTTFSTNQNTNQEMNFAVKSL

SEQ ID NO: 115899 - protein, 79 aa, Glycine max
  Coding DNA Sequence Number=SeqID_24214
  Subcellular localization annotation: CTP_CleavageSite=55; ConfidenceScore=5.60e-01
MATPVASPPPPPPPADAATSPSTLKRTKNSQAVSPLNLCKGKQNISQAGEERHKRIQAVSPSFCWQREKRMKKMNSISF

SEQ ID NO: 115900 - protein, 95 aa, Glycine max
  Coding DNA Sequence Number=SeqID_24215
TSFGYRKDQNGQWLKKDALLPQDERTPSPPPQREDSALLNEVLTKLRGLRSYVGERFDSLDTRFSGMDIRLTLVKEDVSFIRTCFDPPPPPPSSS

SEQ ID NO: 115901 - protein, 84 aa, Glycine max
  Coding DNA Sequence Number=SeqID_24216
MLDKQGAVGPVKPADRSNHDIDDPLYLMTLTIPQFFLKSFQVVWDAIVFGVYNDNFPLYIKHEYLPEIAYSGQCFSISVIQLWI

SEQ ID NO: 115902 - protein, 105 aa, Glycine max
  Coding DNA Sequence Number=SeqID_24217
  Homolog annotation: Hit_ID=Q2N2B2; Match level="QueryCoverage=98%, HitCoverage=41%, E-value=2e-12, Identity=36%"; Hit description=RPGR ORF15 isoform
MQPSEVKDVSTFEGEGLQPSEGKDVQSSEGEGVQPSDGEGVQPSEGENVQSTEGEDVQSSEGEGVQPFEYEDVQFSKGESMQPSEGEDVQSSEGEDVQSPECEDV

SEQ ID NO: 115903 - protein, 61 aa, Glycine max
  Coding DNA Sequence Number=SeqID_24218
MSVKNLVERLGVHDKKNHTLASQVTLTSLKEHSNRVTPKAYTLKSPSGPLPPDSGPTQKTF

SEQ ID NO: 115904 - protein, 42 aa, Glycine max
  Coding DNA Sequence Number=SeqID_24219
MDKSLKVGEDEWRERERRGTKFCASNEPTNPRSSSRFSTECA

SEQ ID NO: 115905 - protein, 57 aa, Glycine max
  Coding DNA Sequence Number=SeqID_24220
MEVGSGSYWKLEVGNESYWKLKVENGSWKGKLLKVVVIIKKGENVNHEDFDDIKKNC

SEQ ID NO: 115906 - protein, 174 aa, Glycine max
  Coding DNA Sequence Number=SeqID_24221
  Subcellular localization annotation: CTP_CleavageSite=34; ConfidenceScore=5.32e-01
MASFSHMQSQLQSQMQSQGIVVPPDPLVGPSGPRVSTKGSCVDPSGNDPETGDSDRCGLYIEADPARLVAMERVYEGSTVVHNTPLLPWGGTSHLPCLADTFGQVFITTAVSPTKPPPKPDPEVDDPLYLMTLTIPELLLRPYQVRWDATVFGVFNPDFPLYIKHADLSEIAHG

SEQ ID NO: 115907 - protein, 194 aa, Glycine max
  Coding DNA Sequence Number=SeqID_24222
MKRDKVHETNGDHTGTYNELKNSVWGTYRLKTEGKRRTNNECRRTVENLHVITHGNVTEAPRLGFSSRKQFFSAISREYEQNRGGACHPARPGEPGCFLQKQPPSGGRIWKAQVGRPFGIMYLLFLAFEKVSNSRFVRYNNFLNGVLPSTLEAVKSKMPIKIVFPNEIRVRQSSLLPLIGDKRKASKDKSEIAE

SEQ ID NO: 115908 - protein, 37 aa, Glycine max
  Coding DNA Sequence Number=SeqID_24223
MPGRSSTRQFPSWKSGGHGRTKSNGGLPSPSCLNHEL

SEQ ID NO: 115909 - protein, 112 aa, Glycine max
  Coding DNA Sequence Number=SeqID_24224
  Homolog annotation: Hit_ID=UPI0000ECBAF8; Match level="QueryCoverage =36%, HitCoverage=48%, E-value=1e-16, Identity=100%"; Hit description= UPI0000ECBAF8 related cluster
AQYANRLSPRVGRFINAAGTTGFPTGKRAVSATQLIYDHDYEFELGTLTGNRLPKCNHSGMQAWHWPSFYNVVTGKTLALPNLIALQHIPLSPAGVIAKRPAPIALPNSCAA

SEQ ID NO: 115910 - protein, 62 aa, Glycine max
  Coding DNA Sequence Number=SeqID_24225
DMPHNGYVRSLSLSEIIGRPVRVTLFCENAPIMWDRHMLKGTLKPNDSQGLHSEESVRASPS

SEQ ID NO: 115911 - protein, 400 aa, Glycine max
  Coding DNA Sequence Number=SeqID_24226
  Homolog annotation: Hit_ID=Q6WAY6; Match level="QueryCoverage=69%, HitCoverage=47%, E-value=9e-25, Identity=32%"; Hit description =Putative uncharacterized protein
MGTNQNGKRFYQVKVKGLDVTSLKELGRLMGPLQRQAFRKVYGKILDLTVAEVFTEAVVSLAQYYDQPLRCFMFGDFQMVPTIEEFEEILGCPLGGRKPYLFSGFLPSLSKVAAVIGDSAKELDRIKQIRNGIVGLPRKYLEDKARDMASQEKWGAFADVLALLIFGVVLFPNVDGLVDLAAIDAFLAYHHTKESPVVAILADLFDTFDRRCEKNSARIVCCLPALCLGYPIRGAPTEEILSPFLVRDLGAQGLKVIQRIHKARRSPLRKDKELRGVRNGVIGGYHGWLRIHTRGLGWLSKLKVVDEEKLEAPEEDEEVRALKSELGKARLAKEKFKSAATHIRKECTELQEENAATARALEQETKRSRKEEHGREKFRGALWGSNNELKLRRDERDRSR

SEQ ID NO: 115912 - protein, 163 aa, Glycine max
  Coding DNA Sequence Number=SeqID_24227
MLHFADLVFAREKIEVGLKRGKFDYVSSTSTHAKRVAATGAKRKEGDTHAVTLVPTWVKPPQTSHGIHQYAQHHLSFSARAGNSSNSAPVQPKAPIQREAPQAPAPTTTRPAVNSNAMRNFPPKPIPEFTPLPMTYEDLLPSLIANQMTVITPGKIYQPPFPK

SEQ ID NO: 115913 - protein, 51 aa, Glycine max
  Coding DNA Sequence Number=SeqID_24228
MDGEELPSPVNFDVVEEPQYYALGMSNGHAMAEKSLGPDITGSLWKAIAPL

SEQ ID NO: 115914 - protein, 248 aa, Glycine max
  Coding DNA Sequence Number=SeqID_24229
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=95%, HitCoverage=31%, E-value=1e-124, Identity=89%"; Hit description =Photosystem I P700 chlorophyll a apoprotein A1
  Pfam annotation: Domain name=PsaA_PsaB; Domain location=1-248; Score=- 105.0; E_value=7.4e-05; Accession=PF00223.10; Description=Photosystem I psaApsaB protein
IYVESPFDRAPGVGISSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 115915 - protein, 79 aa, Glycine max
  Coding DNA Sequence Number=SeqID_24230
CYPPYFPPSIGILRAYQGRMLEEIIHRPTMEDFIFLNPGIKFPPQRHNFMAREKQMRGRFNFALAEGTKVIFNVDLPPR

SEQ ID NO: 115916 - protein, 71 aa, Glycine max
  Coding DNA Sequence Number=SeqID_24231
MSVKNLVGRLGVHDKINHTLASQVTLTRMLQPYGINIGLKEHSNLVTPKAYTPKSPSGSLPPDLGPTQKTF

SEQ ID NO: 115917 - protein, 93 aa, Glycine max
  Coding DNA Sequence Number=SeqID_24232
MANRVLELPALNTGLCHQVPPTNRAFIKKFCVSRQAQGETPQQPGDGRQRATDAPPSPLEFTSAHPQKGLSIAYTTWPTNRRPSPKPKVVKIP

SEQ ID NO: 115918 - protein, 77 aa, Glycine max
  Coding DNA Sequence Number=SeqID_24233
MGLNQARAFTKRARVMGKAEEVQEKMKADMEAMKEQVATMMEAMMSMRKIMEANAVTVVATSTVAKVNPMPPPDLNK

SEQ ID NO: 115919 - protein, 62 aa, Glycine max
  Coding DNA Sequence Number=SeqID_24234
MFLIFNTSALKGLDDTPQPKSKAAARWIVVKYFNEVRPLEAERFKALRIQWAQYYLKVRNQT

SEQ ID NO: 115920 - protein, 70 aa, Glycine max
  Coding DNA Sequence Number=SeqID_24235
MVGYMLFKLCRFSFRRRKDQSGKPRANGENKKEEETHVVVAVPTWPNFPLAQQYQYLANIIHSHYPLFEL

SEQ ID NO: 115921 - protein, 102 aa, Glycine max
  Coding DNA Sequence Number=SeqID_24236
  Subcellular localization annotation: CTP_CleavageSite=81; ConfidenceScore=5.02e-01
VDSRGSPQYFGSAPWTSRSASSLPPNELQQLTQQIRDQLEESITKKVTRQVMASFSQLQSQMQSQGLAVPPEPLVGPSGPRVSTKGSCVDPSGNDLETGVVF

SEQ ID NO: 115922 - protein, 65 aa, Glycine max
  Coding DNA Sequence Number=SeqID_24237
MEVLRTSFAATDHRNARRRYLHLHAGTLNAATHEQDAMPHEEEKTRESTTNKNGGMKRHCKEIGG

SEQ ID NO: 115923 - protein, 83 aa, Glycine max
  Coding DNA Sequence Number=SeqID_24238
  Homolog annotation: Hit_ID=Q9AY32; Match level="QueryCoverage=39%, HitCoverage=50%, E-value=6e-08, Identity=87%"; Hit description=RRNA intron-encoded homing endonuclease
MPTSGIRDVAFRTPLAPYEKSKSLGSGGSMVARLKLKGIDGRAPPGDGGDRLRIGSFDSREPEKRLPHPRKAAARKLPNPDTG

SEQ ID NO: 115924 - protein, 86 aa, Glycine max
  Coding DNA Sequence Number=SeqID_24239
MRRTGFGSILGRIDSLLRGNPSLALEVMDLFKSWRGSITMPIGEANTEEEEPTNLRSDPLQGGRADAIFPRKGPVTKAMSKRLQED

SEQ ID NO: 115925 - protein, 90 aa, Glycine max
  Coding DNA Sequence Number=SeqID_24240
MAAHLIHDRVVMEFLEGEPARTLQQAMEWILPTPTPYRLVEPIQVIEVSSSEEDLEEDLEELPPEPDMDALDLPKDDEDPLPDVDSPEDI

SEQ ID NO: 115926 - protein, 151 aa, Glycine max
  Coding DNA Sequence Number=SeqID_24241
  Homolog annotation: Hit_ID=A6FJQ2; Match level="QueryCoverage=25%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPIWEPIQSLCSDSQPLMIATDDLITASPKLSVLSSRRIPCLANSLEYPRVVVTETPCDERRDAFF

SEQ ID NO: 115927 - protein, 107 aa, Glycine max
  Coding DNA Sequence Number=SeqID_24242
SDDESLEGTNTRDPAIDFKQEAGQTESEEDKDVGLPPELERIVAHVDREMRPHQEETELVDLGTGSGKMKVKIGTGMTAPIREEFGPTKKLPRHLCLVIPRYARFEF

SEQ ID NO: 115928 - protein, 145 aa, Glycine max
  Coding DNA Sequence Number=SeqID_24243
MPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSAPSPESNPNSPSPVTPW

SEQ ID NO: 115929 - protein, 107 aa, Glycine max
  Coding DNA Sequence Number=SeqID_24244
MEVLSYSLYRLSSRVGDKRDSNPLTSATGILVVPEDPATGEPGTESFPRPPFFSARLFALKNTGFYGRSATPGCRRRPWGDLVVPTGEIVHQAVRKGQLDPLPQDPK

SEQ ID NO: 115930 - protein, 90 aa, Glycine max
  Coding DNA Sequence Number=SeqID_24245
MWAIIDQYREKLNLASTHEQRLKDEYTKVLVLQAEREAREKVHFHLEWKLRASQTASQSQDNGGRVLGSRGSSWAPQLLSAHDRFDDPHN

SEQ ID NO: 115931 - protein, 69 aa, Glycine max
  Coding DNA Sequence Number=SeqID_24246
GCVKIEESLEEFKTQEKVRVKGNQDSEDSDSQESRRYKIQGSRFKGIKGEGYINLGSLSYVKGFSQKVE

SEQ ID NO: 115932 - protein, 161 aa, Glycine max
  Coding DNA Sequence Number=SeqID_24247
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSRKLKMQVGSGSYWKLKLEVGSWGTELEFVIMVIAVSFGKPVVPAALMNRPTRGERRFAYWALFRFLAH

SEQ ID NO: 115933 - protein, 274 aa, Glycine max
  Coding DNA Sequence Number=SeqID_24248
  Homolog annotation: Hit_ID=UPI00006A17C9; Match level="QueryCoverage =47%, HitCoverage=56%, E-value=2e-07, Identity=30%"; Hit description =UPI00006A17C9 related cluster
VVAVCLLPTTGHPNADVVFRPVPATCLGAQYFLMKARLALPRTDRDPYLELATPRPCLAFFGSTRGNGRPVGRQRPVTRAGNPQGPVGLLSGPLGVFVGGRLALRSLGRMLLSSNVIYICVRVVMLVRMIHTRLFATARVKSCPGMHSSCVIASLSGCACTVGRPPILGGQRTLNYLKVWIWSPLKVRMRSPLKARACSPLKFRTCRLLKARECSPMMARTCNPLKVRACSPTKVKVYDPLKARTCSPLKVRACSPLLAWTCSPPKVRACSPMK

SEQ ID NO: 115934 - protein, 91 aa, Glycine max
  Coding DNA Sequence Number=SeqID_24249
MVSCCKRILNTKEGLSCVFRTCKRNLQDSGTLKRVAWGLDVGTRTSKALSPSPNSPFEIQISGLNRCPCLCSCAKRTFGPLIETVPESNNH

SEQ ID NO: 115935 - protein, 385 aa, Glycine max
  Coding DNA Sequence Number=SeqID_24250
  Gene Ontology: Mol. function=two-component sensor activity; Cellular component=integral to membrane; Biological process=two-component signal transduction system (phosphorelay)
  Homolog annotation: Hit_ID=A4WAU1; Match level="QueryCoverage=80%, HitCoverage=43%, E-value=1e-135, Identity=74%"; Hit description =Diguanylate cyclase/phosphodiesterase
  Pfam annotation: Domain name=EAL; Domain location=65-306; Score =375.3; E_value=9.9e-110; Accession=PF00563.11; Description=EAL domain
MRRPLSLCGHTLSTTISAGVSRYPQDGETLHELKLKADAALHHVKEEGRNDWAIYRTEMSTSVPAKPGFLQELSQALERDQFELWYQPTWHAEDKTIHGFEALLRWRHPEQGVLLPNLFIPTLEQTGLIIPVGNWAIEAACRQLHFWTEQGFSQWTLSLNLSPVQFEQQDIFPVVSSMLEKYNLSPSRLILEVTESTALKNLDRSIELLEAFNRAGITVSIDDFGTGYSNLLMLSVLPAKELKIDRSFVTSMLENEKSYKLVETIMSIARTMEMNVVAEGIETEAQQAELTRLGCDYLQGYLFSRPLPAEQAQCADKQETHMSQHCFDTLNVIKTPVWLISPVSEQIIFANVAALQVMSDKLSMRCVKAHIPQRRKASCRCMSLN

SEQ ID NO: 115936 - protein, 79 aa, Glycine max
  Coding DNA Sequence Number=SeqID_24251
MIYFREAKTIRVTLKISSLVIDYDAILPRKGLVTRTMSKRLQEDRARIAEECPRVLMNLRIDFIAHGPRWGPIIFVHID

SEQ ID NO: 115937 - protein, 87 aa, Glycine max
  Coding DNA Sequence Number=SeqID_24252
MSVTHPNGQSYHDPRGSIQPGGTHPATPDETSHARVRRNQILSISPRYWSQHRTLLGPEGQDQRTHISWVPSPICQETRQPPSRSKT

SEQ ID NO: 115938 - protein, 155 aa, Glycine max
  Coding DNA Sequence Number=SeqID_24253
  Subcellular localization annotation: CTP_CleavageSite=80; ConfidenceScore=5.34e-01
MARALASSGVFILIFPLTEVSRSYLEWGRKPSMKMFSCTSSLNPCVGVFRSNPWKRSSVSLSDSSGCWWKDEIFTLPSVVLGSGKYFFRNFFPTSFHVRRQFPLNEGSHLFASLAKEKENKLRQMASSGTPPIFTVLHISMYVARCAYRSSLGRP

SEQ ID NO: 115939 - protein, 264 aa, Glycine max
  Coding DNA Sequence Number=SeqID_24254
  Homolog annotation: Hit_ID=A2Q4S5; Match level="QueryCoverage=78%, HitCoverage=35%, E-value=4e-20, Identity=30%"; Hit description=IMP dehydrogenase/GMP reductase, putative
  Pfam annotation: Domain name=DUF1723; Domain location=125-174; Score =45.1; E_value=2.5e-10; Accession=PF08330.1; Description=Protein of unknown function (DUF1723)
MRQRPTTSARRQWGAVPIAEDDPVVVADEPMVAADVHDTGVDTSVDAGADDAEGFPGGPRDPFVLMEYADHIACLFLYTSIQDRPELKLSSHGRNVQKLGRPSPKIEGLVASTGLSHLIACSVDTGNRGLISSFVKRWHTETSSFHLPVGEFSITLDDVASFLHLRIVGAFHTFQPLHVNEAMLMLVELLEVSGEAARAETTYCHGPYVRLSWLPDIYQSRCQAGHWTAAARVYLLHLLGCTLFANKSATHVHVVFLDALDDLS

SEQ ID NO: 115940 - protein, 262 aa, Glycine max
  Coding DNA Sequence Number=SeqID_24255
MSLIGKHLQFLIDRESAEGRCLRDAVNYLNGYMVHYICHDKQVLRMFHAKEFITMAQELGAKIVAHKSSIENAKMIIAQPAPLVVLIEWIKKQKEDLRYEGTVNVVGTSGNSQRNFQMALADVTNTQPNSQHVPTRQRKTINNICRLHSNLYNDFVAASSTSTGLLNNEIHDHSFVPQHANDPLHHTNEASLDNNTENAETYDSVLDDENELSDYVDDSTHDISTGYVDLGDPYEACAYCQHGKDTTFFSQESSNAFATTTM

SEQ ID NO: 115941 - protein, 310 aa, Glycine max
  Coding DNA Sequence Number=SeqID_24256
NLNTFLETPVVLAEGETLPAYSRYCRPPWEDSQVWSVLSYSNLAPTSHTPDLTVDRARLIFGLVSHMDMNVEALISGQITSMTQSNSSRLGFPALITALCKSRGVASDSLVFERLSPVINLAYIRKNCWNPDDLTVTIRGARRVRTRPAKALSTSTAPPPARTLAVPSASAPMVAAPDSIPSVEQFNEWVAWPGTQSSLHRVDEGPTAQVPQQMEDESSETTTPKPLVRRKKAAQEAAATSEKSHEATSEPSEPVADTASIQQAADPSTPEDQTTPVLSPNTSPTTTHVLHLTDEEDVQTQDTQDRSQDF

SEQ ID NO: 115942 - protein, 212 aa, Glycine max
  Coding DNA Sequence Number=SeqID_24257
  Homolog annotation: Hit_ID=Q2HTA0; Match level="QueryCoverage=67%, HitCoverage=22%, E-value=1e-12, Identity=34%"; Hit description=IMP dehydrogenase/GMP reductase, related
  Pfam annotation: Domain name=DUF1723; Domain location=150-199; Score =47.0; E_value=6.6e-11; Accession=PF08330.1; Description=Protein of unknown function (DUF1723)
MVRTRGLRWALSRVIGKVLGTQVSGDVDEAPQCRRPTTSAHKQQAVAPVTKNVEHVVHVVDEIHDQPQERVTDDARADAQGFPDGSHDTSVLTEYVHHVTTTAWVEEEHPELTLSSHGRKVHKFERPSPKIEEIVAAIGLSHLISCFLDTGDKGRIFAFVERWHKETSSFHLSIGEVAITLDDVASLLHLAITGVFHTFDTLHVDQVANLLV

SEQ ID NO: 115943 - protein, 127 aa, Glycine max
  Coding DNA Sequence Number=SeqID_24258
  Gene Ontology: Mol. function=identical protein binding; Cellular component=extracellular region; Biological process=negative regulation of catalytic activity
  Homolog annotation: Hit_ID=Q2HV71; Match level="QueryCoverage=94%, HitCoverage=18%, E-value=2e-34, Identity=55%"; Hit description =Protease-associated PA; Proteinase inhibitor I9, subtilisin propeptide
MKRSFTNYHGVLKPDIMAPDPNVLADYVPTKLAAIIGTNVMLFSDYKLLLPQSSATVIRSTLVTTASHLNNTQNPIRGYGYHCQYASPLAIGVGQMDPNKALDPSLIYDATPQDYVNLLCALNYTQK

SEQ ID NO: 115944 - protein, 242 aa, Glycine max
  Coding DNA Sequence Number=SeqID_24259
MGTPPRSPPHSDGHSELTSRKSRQSTRLRRLTLRTLHQPRPIPIVHDNWKHVPESLKDLVWDDILVKFDIPETPNAKKKETLTENTPLIKDPPSPIERHVKWKLVRTKRYGQMTSQAAQEISDRIDCLQEETTQGTFVPHGRDDILSTVIGSSTSITQQQLADQQSVIIGTLKEEWRNKLEQENKRSIEKMKEELKELVGLGSSSSMDSFASWKINGSEMEKEEKEETPLHGEDESRRSSPP

SEQ ID NO: 115945 - protein, 175 aa, Glycine max
  Coding DNA Sequence Number=SeqID_24260
MIIVHTWWHWEKYMRGVLPYTAWLMQMMWKGQALHTFIAWPTNLVKIVSHEDSSITLKKVNEPVQRSNEESTNDLLCQLIRTLYDIYKKPVELLWDGKKFGLPNTNASFFLTYSDVNEIILGDKCLNIAILQLWMISSLGHASVYGFLEPQSIHNAKDRRAECQHYIETWVKESQ

SEQ ID NO: 115946 - protein, 112 aa, Glycine max
  Coding DNA Sequence Number=SeqID_24261
VLAAILRLQSDLLAKLEPIPQDCIDDKWKWMLSDAILPRKGPVTRAMSKRLQEDWTKVVEEGPRILMNLRVDFLVHGPRGVSSPSLASQGSFLPLASEGSYLPYFSRKLPMC

SEQ ID NO: 115947 - protein, 72 aa, Glycine max
  Coding DNA Sequence Number=SeqID_24262
  Gene Ontology: Mol. function=RNA-directed DNA polymerase activity; Biological process=RNA-dependent DNA replication
  Homolog annotation: Hit_ID=A5ALI1; Match level="QueryCoverage=70%, HitCoverage=3%, E-value=6e-10, Identity=52%"; Hit description =Putative uncharacterized protein
MEEFRRDLFQMHIDKSPDPDAIETIQHMKCKTNGKFGEFSLKIDISKVFEQAEWNYLFVLMLKLGFDAKWVG

SEQ ID NO: 115948 - protein, 182 aa, Glycine max
  Coding DNA Sequence Number=SeqID_24263
  Homolog annotation: Hit_ID=Q84VH5; Match level="QueryCoverage=62%, HitCoverage=16%, E-value=2e-45, Identity=83%"; Hit description =Envelope-like protein
MQFYTGLVLQTGYPPIILPLLPQHSESFAVKLPIAFPTVLCGIMLSQHPNMLNYTDSVMKRESPLSLHYKLFEGTHVPDIVSTSGKAAASGAVSKDALIAELKDTCKVLEATIKATTEKKMELERLITRLSESGIDDEEAAEEEEEAAEEDKEAAEEEEEAAEEEEDAAEETESDDDSEATP

SEQ ID NO: 115949 - protein, 452 aa, Glycine max
  Coding DNA Sequence Number=SeqID_24264
  Homolog annotation: Hit_ID=A7QRA0; Match level="QueryCoverage=35%, HitCoverage=47%, E-value=1e-15, Identity=33%"; Hit description =Chromosome chr13 scaffold_149, whole genome shotgun sequence
MKNLCSGKKFSGTKSLDANGKLLAVLIQGISMVVFLLERNSQSNHFEERSQMRRFIESMEDWGLGSFKATGRDGLQVCKTFIPLVIATFLIKLLPYYWQKGEDTDIGGSLYRSNLALYPTMRMLWNGEALSAFFSLQGPRPSYFMIVDDLILFVEDSLEQRLSQGRVCLLAITIECKVSTVSGLIVVTLSTRRVEIGSGHFNILHHPMLRERLLTLSLVQKNGIFICCNISQGAFGLHEVAIVNNLTATHHLDMEMMLQVYFSKIATSFREEWLVLATSAGLSPLELDLNHEPLHPTHASNDKFDSLLEELKSVHEHVQDHISLLEAVTSRARQRQRWPPVHSPIQIRNSAGETVVVANAQGREMKGVAKASEEVEAKVRGYGNMFDCNICLKMARNLVRSMKLTLFQFMTDASGNCDLESNVAGLKVPPRPVAPRIKSFRERLEAVETYVL

SEQ ID NO: 115950 - protein, 145 aa, Glycine max
  Coding DNA Sequence Number=SeqID_24265
  Gene Ontology: Cellular component=mitochondrion
  Homolog annotation: Hit_ID=A7QN13; Match level="QueryCoverage=37%, HitCoverage=14%, E-value=1e-17, Identity=78%"; Hit description =Chromosome undetermined scaffold_129, whole genome shotgun sequence
MEGEGARNLVPQKSPLIQDKVQDSPLSMLRWHEASHGPEICPKTLENPRAFSCISGPIYLESSIQCPCGVGLHHRCGDNLAILRAKLKSQEKHVRNLKKKSLWSKILEEVKEKLVDIIHFLYLEIHQAFGSSVMLSRIARIINYV

SEQ ID NO: 115951 - protein, 18 aa, Glycine max
  Coding DNA Sequence Number=SeqID_24266
MAMLARIVVLGTWWHSKA

SEQ ID NO: 115952 - protein, 199 aa, Glycine max
  Coding DNA Sequence Number=SeqID_24267
MSFLSGASTSHLPCLADTSGQVFITAVVSPPKPPPKLDPEVDDPLYLMTLTIPELFLRPCQVRWDVTVFGVVNPDFPLYIKHEDLSKIAHGGQCLNISVLQLLIIHLTETCMRVGNYVIHGFLESQPIQSAIKGLDDAPHPKSKASARWIVVKMSTIILGTFRNNWEAYFNDPRPLEPERLKALRIQWAQFYLRVRDQA

SEQ ID NO: 115953 - protein, 435 aa, Glycine max
  Coding DNA Sequence Number=SeqID_24268
  Gene Ontology: Mol. function=binding
  Homolog annotation: Hit_ID=A7QS38; Match level="QueryCoverage=93%, HitCoverage=78%, E-value=1e-127, Identity=57%"; Hit description =Chromosome undetermined scaffold_155, whole genome shotgun sequence
  Pfam annotation: Domain name=Nodulin-like; Domain location=11-258; Score=397.5; E_value=2e-116; Accession=PF06813.4; Description =Nodulin-like
MLRVKGGSRPPWVGLGAAVWVQIASGNTFTFPLYSHSLKSVLGFDQRHVTLLGVAVDIGENLGLLPGLACNKFPPWLLLAVGSLAAFLGYGLLFLAISETLHSLPYITLWFALVVAANSSAWLTTAVLVTNMRNFPASRGSVAGILKGYGGLSAAVFTEIYSIVLHNSSSKFLLFIAVGIPVVCFSMMFLVRPCTPATGDDPVEPYHFLFVQGSSVVLGVYLLATTVVGNIIPFSGAVSYVLVAVMILLLIAPLAVPLKMTLFPRNGSKSDSPEQQVGSSEGKDENAEPLLASSSAGALGSFDDQDDLSEVAELLALGEGAVKQKKRRPKRGEDFKFTEAIVKADFWLLFFVFFVGVGTGVTVLNNLAQIGIAQGEEDTTTLLSIFSFCNFVGRLGGGVVSEHFVRNIEALFLDERKGESDLFIDDFKKTMESDL

SEQ ID NO: 115954 - protein, 159 aa, Glycine max
  Coding DNA Sequence Number=SeqID_24269
MKRITIILMRYTDVLLSQATLKAGVGIIVRPTEGHGSVMLVGGGVATLYDKFTRSYELDVAPCGACRPWIFFINGGTSFVVLVEGTSFVVLVEGTSTWVVVTENKRGYISCGSVLVEGTFTRFFKENKGGYVPCGSLLVKDFTRLKRNLKDRRSLGDWM

SEQ ID NO: 115955 - protein, 747 aa, Glycine max
  Coding DNA Sequence Number=SeqID_24270
  Gene Ontology: Mol. function=molecular_function; Cellular component =nucleus; Biological process=protein modification process
  Homolog annotation: Hit_ID=A7QS43; Match level="QueryCoverage=100%, HitCoverage=100%, E-value=1e-78, Identity=53%"; Hit description =Chromosome undetermined scaffold_155, whole genome shotgun sequence
  Pfam annotation: Domain name=UBA; Domain location=477-513; Score =38.2; E_value=2.9e-08; Accession=PF00627.22; Description=UBATS-N domain
  Pfam annotation: Domain name=UBA; Domain location=549-585; Score =33.0; E_value=1.1e-06; Accession=PF00627.22; Description=UBATS-N domain
  Pfam annotation: Domain name=UBA; Domain location=609-644; Score =16.8; E_value=0.084; Accession=PF00627.22; Description=UBATS-N domain
  Pfam module annotation: Pfam domain module=UBA::UBA::UBA; Domain location=477-513::549-585::609-644
MARLKIGGTWAGVLEEVDLQAWTLATLRDLVAARSNSPSSDSINLICAGKILKDDAVPPQTLAQLGVKNNAKILATRTSTPQQGHSFLAQEERSSRLARIRLHHAPSHNFNLEIISVAIVFGVGRASVLLRVIKHVTQLSYYPKVRSAAVPRSTVLFERAAANAMADRHADGALPVEDFNIEVEDQSGQKVRLGSETDQRAVMMGLMLHAKGKRLIRQGNYKDALEVLSMGELIDNVPILQIDMVWCYFMIRDIRWLSDAGKRLEMAREGIERAHGKDSFRLRLLQVGRYPELALHLRLELLEGVVAYHIGQLEKSKKTLASARTKFIQVWVKSWGAVVQSIVVLPSSSDVCYSLLVSDAALELCGFALSVSVFGDEAVSDHDRSDGGNKTPSEQCNATTGNVTGGIWLSVTDLTAVKSFPTVGDLLRFHRLSGTATSSAILIWRIKVFTAICCKTLLITCQALTLSEPCFASQLQVPDEALSLVMSMGFVERDAKRALRMNNQDVGGAIDFLAEEKAKKLQKREEDIRRRNEIKEQKQYGMTPLKKAVDLERLKELVSIGFDKELAAEALRRNENDTQKALDDLTNPETNSALQVNIESRKRKRQKQARDSEIRNVVQMGFERSRVVAAFEAGGSLEEVLQRLTAQPGTDPTQPQENSASASHGGASSSAPLPDNVDSDIAMNEVEDPSITEQRDVEMEDELSADIAKADALADYDIEVNVEGEAITEYLSLVESAGSCGKTAPSQ

SEQ ID NO: 115956 - protein, 85 aa, Glycine max
  Coding DNA Sequence Number=SeqID_24271
  Subcellular localization annotation: CTP_CleavageSite=88; ConfidenceScore=5.42e-01
MGVATCTQQNCCGTQQTVNGQLCPSEKTIFGRLCFRKTSGTTFFQKKKEDFRKNSRKTSRRSVFRKISGKAVFRNTSFFFRKKVK

SEQ ID NO: 115957 - protein, 148 aa, Glycine max
  Coding DNA Sequence Number=SeqID_24272
NDFQDYFDDAKESRVKQVPKNQESKSFKNQVSKNQDSRTIKFQVSRFKNNQDQDSRLKIQEKLISRLKRRNQEATVKTAQEKGYIYLGCCTENKRGYISCGSVQVEGTSTWLFKENKGGYIPCGSLACKGFYKAERNLKNRWMLWDWM

SEQ ID NO: 115958 - protein, 352 aa, Glycine max
  Coding DNA Sequence Number=SeqID_24273
MSLEENMIFELHTKKGTWKIAVRITNMWHVNKHNGRQGAKIGATLRQELFREFEAMLHCGSAYVIQDIKVVENHSEYKVSTIPFLVYLVKTIVKEDEHPEIPTNVYVITSFADIIDGVAPRDTLVDVVGVVAEVIERKTVNPTYRVTVKLRDNIDRDMILTAWEEYALQLDDAIEKNHFDRKSMVVMLTLAKIKDSKVGRLSDQGSVSQSQYSQYSQGSSVDKFLHNAQMVTLGEISRLRQDYYCLTVGMVDEAMIDTPWSYDSCPYYTTTFDPLKFGFTYRSCQNEVANTVPRMGRRPTSISRMEHSSDDIKVFPSCVDKLLGKTWAVRFKYRVQMHQSSVLDVTHDEDLI

SEQ ID NO: 115959 - protein, 504 aa, Glycine max
  Coding DNA Sequence Number=SeqID_24274
  Gene Ontology: Mol. function=binding
  Homolog annotation: Hit_ID=A7QTK8; Match level="QueryCoverage=90%, HitCoverage=69%, E-value=1e-162, Identity=64%"; Hit description =Chromosome chr11 scaffold_170, whole genome shotgun sequence
  Pfam annotation: Domain name=PB1; Domain location=52-129; Score=57.5; E_value=4.7e-14; Accession=PF00564.15; Description=PB1 domain
DSIVIKKAGGSLKEKKANKSKKKAKERIDEKKDDVKEVIEEKSNGRSEDIPKKTAKLIFGEDIRWAELPLNCSLLQLREVICDRFPRLGAVLVKYRDQEGDLVTITSDEELRWAETGSQGSIRLYIVEANPDHDPLFEKFNVKNGEKVNTYSSPVNGSVVKAKDIISSSCIEDWIILFAQLFKNNVGFESDRYLDFHEFGMKLYSEAVEETITSDEAQGIFDIAGGKFQEMAALALFNWGNVHMSRARKKVYFTEDSSKEHMHEQIKSSYEWAQKEYAKAGEKYETAIDIKPDFYEGFLALGQQQFEQAKLSWDYALCSNVDLATWPSTEVLQLYNSAEENMEKGMLIWEESGGQQLSEIFDPKDIGLHLQNMGLDGLFKNMSSDEIAAQVENMKSQINLLWGTMLYELSIVEFKLGLPVWHESLEDAAEKFELAGASATDIAVMLKNHCSNNTDGLGFKIDEIVQAWNEMYEAKKWQKGVSSFRLEPLFRRRISKVYHAFELV

SEQ ID NO: 115960 - protein, 411 aa, Glycine max
  Coding DNA Sequence Number=SeqID_24275
  Gene Ontology: Mol. function=hydrolase activity; Cellular component =extracellular region; Biological process=proteoglycan metabolic process
  Homolog annotation: Hit_ID=A5C7G0; Match level="QueryCoverage=97%, HitCoverage=72%, E-value=1e-152, Identity=59%"; Hit description =Putative uncharacterized protein
  Pfam annotation: Domain name=Glyco_hydro_79n; Domain location=1-269; Score=246.5; E_value=5.8e-71; Accession=PF03662.5; Description =Glycosyl hydrolase family 79, N-terminal domain
MVASECAAAFSPLKLRLGGSLQDKLIYGTEDNHQPCTPFVKNPSEMFSFTQGCLPMDRWDELNYFFEKAGAKIIFGLNALAGKSIHGGSAKGPWNYTNAESFIRYTVRNGYTIYGWELGNELSGNGVGTSITAEQYALDVAALHDVVYNAYKKIEPKPLVIAPGGFYDANWFNKFISKSGKSIDVVTHHIYNLGPGVDEHLVERILDPSYLDKEVSTFSGLKNILAAAYDTKTYCRQTLIGGNYGLLNTTNFLPNPDYYSALLWHRLMGRHVLSTTFSGTNKIRAYAHCAKQSKGITVLLINLDSNTTVEAEVTFNNAAKSLRHRKMSTHSKVMELPLASETAREEYHLTPQDGDIHSQIMVLNGNPLSVSSDGDIPPLEPINVNSSEPIRVAPFSIVFAHLPDAVVSACG

SEQ ID NO: 115961 - protein, 214 aa, Glycine max
  Coding DNA Sequence Number=SeqID_24276
MVTLINGEFHPSKVAAKAVTLSIRQQFGQPWPTWGAIPKDHHKLFFQCFKSKELGRSVYVDAVFQQTHLRKITGQFVDDRSRRTNEEFESGLSQARFDGASSVGESQLTPSDPAEEQRLRSQCWVAAVGPKHKGHLYGTEDLTHTYKCGNDSFMQHTQGSFSRVEDVVEINRLREELRQSKEEMHVFHSVVLQFLPLEARNIIHQQHQPHQQDQ

SEQ ID NO: 115962 - protein, 109 aa, Glycine max
  Coding DNA Sequence Number=SeqID_24277
  Subcellular localization annotation: CTP_CleavageSite=31; ConfidenceScore=5.23e-01
MAEPSNKRKGSSSRSQRHSEAQDTPIPSSISSSSLFSSKEQRTRYTNLFSSHSIIDPKFIDMDFFSDKSFKCIHAFHNSNLIPFMSLKLSMYYELVKSFILTLNSRGIL

SEQ ID NO: 115963 - protein, 102 aa, Glycine max
  Coding DNA Sequence Number=SeqID_24278
MAFLRSTLATSMVLLAMLSVASATDYYGYGPTPKLENPKPKTDYKFDDKPHPTKPDYYAMPKSKGNDELHLLPTIIGVQGVVLRKTYSVRNGIHTDTSKPEI

SEQ ID NO: 115964 - protein, 84 aa, Glycine max
  Coding DNA Sequence Number=SeqID_24279
MKRVVEEKPVIEKKVPLKMACKTINEEEEPRRHGTESLCSFVFSCHVVWRRKENGFELPVSEPYWSRIEAMSSLRKPYLSRLPA

SEQ ID NO: 115965 - protein, 211 aa, Glycine max
  Coding DNA Sequence Number=SeqID_24280
  Gene Ontology: Mol. function=nucleotide binding; Cellular component =intrinsic to membrane; Biological process=defense response
  Homolog annotation: Hit_ID=Q93W58; Match level="QueryCoverage=83%, HitCoverage=16%, E-value=2e-58, Identity=65%"; Hit description=NBS -LRR resistance-like protein J71
  Pfam annotation: Domain name=NB-ARC; Domain location=59-210; Score= -94.4; E_value=0.0003; Accession=PF00931.13; Description=NB-ARC domain
MNSPNVKWKANLRPTLTRNAILTWKLKMMKQVLDDLEFLESQKGHLGLKECVGSGSGSKGSQKLPSTSLVVETDIYGRDDDKEIVSNWLASDTDTRNQLSILSIVGMGGECKTTLAQHAYNDPRIEGKFDIKVWVCVSDDFDAFNVTRTILEAITKSKDKSGNLEMVHERLKEILTGKKILLILDDLWNEDRKKWEVVHTPLNYGIERNGK

SEQ ID NO: 115966 - protein, 127 aa, Glycine max
  Coding DNA Sequence Number=SeqID_24281
MNLSNCSKLVASLKKTLGSNTFLDILRVGKLDVKSFPDEGIDSSRLIIKKRAFYIGSNGLSTSVMTRGGNPVSLNNDIGWRTIFERRSFYIDCVATTDVECEFSTSVLRMKPMLNGKASTSVISQPM

SEQ ID NO: 115967 - protein, 79 aa, Glycine max
  Coding DNA Sequence Number=SeqID_24282
  Gene Ontology: Biological process=multicellular organismal development
  Homolog annotation: Hit_ID=A9NZH9; Match level="QueryCoverage=81%, HitCoverage=33%, E-value=2e-29, Identity=90%"; Hit description =Putative uncharacterized protein
  Pfam annotation: Domain name=DUF667; Domain location=1-66; Score =19.3; E_value=3.6e-10; Accession=PF05018.4; Description=Protein of unknown function (DUF667)
MDEGWNQIQFNLVDFTKRAYGTNYVETLRVQVHANCRLRRIYFSDRLYSEEELPPEFKLYLPMQAFPSPRKNNVQKCGY

SEQ ID NO: 115968 - protein, 223 aa, Glycine max
  Coding DNA Sequence Number=SeqID_24283
MPITGCLSTKQDVPPASPVVEAPTAIFIDVVVTLVIPAHSPSLVADIVKEAASATAKVVVPATQAGFVMVLLSTVATPLLSVGVETTGASTMPPPLSTSVALSAIVLEFGHSGGEWTTTPRGGAKSASLEAVVTKWTATARTLWRVDRPKVATDKELEEELLLYKKEVVEHHKKDFQKAIGHAGLFAKDLNLGLFDPFKDVKDGVLLDKEEIATEEEEAVDEG

SEQ ID NO: 115969 - protein, 92 aa, Glycine max
  Coding DNA Sequence Number=SeqID_24284
  Subcellular localization annotation: CTP_CleavageSite=81; ConfidenceScore=5.21e-01
MIIKTPIPPARKAASLPLSCRTQWRDPLCPCPAAATGGTTLQHPLSPVPPAPRAGPPPLSLLSRQLQGRDTSLSPIPSHPASSNGGTPPPLS

SEQ ID NO: 115970 - protein, 247 aa, Glycine max
  Coding DNA Sequence Number=SeqID_24285
MPITGHIVDHTDTSYTKKEITGSLSPPWVANPLAIWIGYELITHFMIQGLDSNWEVLSKCGSKSSHQMVIIARNRVRIVGWHRCSSIIQAFLVEKRELGPFEDQAYSFGHIRVGTNMWLYLPKRVLRKFGYVQRIPLEPLEFPAAYEKCSEAWDEWEKHMDRFPIMQTTTTTNIDLSSKLEPVVAIDPRIRTMISLANVVFLGLNRRARISLGEHPTIAYNSIDPLELNSKKKKHIFPISLSSLSSI

SEQ ID NO: 115971 - protein, 157 aa, Glycine max
  Coding DNA Sequence Number=SeqID_24286
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=91%, HitCoverage=19%, E-value=2e-77, Identity=97%"; Hit description =Photosystem I P700 chlorophyll a apoprotein A2
MYRTNFGIGHSIKDLLEAHTPPGGRLGRGHKGLYDTINNSIHFQLGLALASLGVITSLVAQHMYSLPAYAFIAQDFTTQVALYTHHQYIAGFIMTGPFAHGAIFFIRDYNPEQNEDNVLARMLDHKEAIISHLSWASLFLGFHKRPKQHQIPRAFSK

SEQ ID NO: 115972 - protein, 383 aa, Glycine max
  Coding DNA Sequence Number=SeqID_24287
  Homolog annotation: Hit_ID=A5AWV0; Match level="QueryCoverage=95%, HitCoverage=25%, E-value=4e-09, Identity=23%"; Hit description =Putative uncharacterized protein
MGERWRQFKSNLTSKWAHVADKESVNYIVCEKYGISKEKMCEKRYRPSRSKTLSLTCCLMGKKLEEAALSESTDTVNYPPSLIRRHMKWKMVHTKKTGQMTSEAAKEIINKIDSQGSFIAHGHQDVLIAAIRRPEHPGRVRAVGAGVTIKQYFGPAPRTSHTSSSMAPKDLEELTQQIRDQLEESITKKGLALPPEPEVGLSTICVSTKKSCVDPSGNDPDTSDLDKCGLYIEENPPRLVALGRVYVGSTNIHNIPLLHDQVKVGVEEVRDAYAPIPVSTKEVKLVGQTLNTLFAWPTHLIKRLSEHVMWNATVFGVFNKEFSLYIEREDLSEIAHGGQCLGISFIQLWILHMTETSMRAGNIDVYGFLEPQSIQRFGQSQFE

SEQ ID NO: 115973 - protein, 304 aa, Glycine max
  Coding DNA Sequence Number=SeqID_24288
MSEEENSGERNSGWERVRNRRERRERTKARQREGTCLSIAGNRKGYQQSYMRENWRDHKDVTSFYFTWFPDDATEEDLWGGGQTPIREEVGLVFGGLKMYANLPKFGRVRDRKSHQDVEGRSYIKQGEKENRDAYLQMKQGVSLDMKRGSYADVILGINYEQNRGIQQTRKATGHNHRVEDDILWDFDDNKSPKYIEDDMILLLGLTDDKARQLMDDENEDGTTMFHTLEKWNPGMRPANEEDGAGIGDLVEVDDDMEEPRKLDIGDMKQMKKMVACIGDLVEVDDDVEELQKLDMARILLKTS

SEQ ID NO: 115974 - protein, 186 aa, Glycine max
  Coding DNA Sequence Number=SeqID_24289
MHPNCPLGFLREGGSRNIESLYSTKVLHGMPLIGMTKIFGQDKSTSINHGKAHFNMVVIREHLAIKDALVSQPTLRREGDARLAGCVFHERNTRGVATNVYLRKTSEKPEKTRSTNFLVKGSGVVFTHGEVSDSKTYPLKNEERMKNDEERTKTFTDLLTETSRKRYGSTSAWIFFTETIFFTQNS

SEQ ID NO: 115975 - protein, 102 aa, Glycine max
  Coding DNA Sequence Number=SeqID_24290
MEWSEIARITSKESHSSQKECQFLLLAILIARIASSNYVPNASAPPLKEAKKPVATPAPIISKNNTRNCRAKVSDRAESMGQLVERPKRKTTTPRHLKDYVH

SEQ ID NO: 115976 - protein, 102 aa, Glycine max
  Coding DNA Sequence Number=SeqID_24291
MWTTRGRSLPPSSPRRARLLPPEATTFWRKNLEGLTFEEVTKTHGLRKTPPFDFRHITEFSRIASIFTTSMRRINSNYNGANIMGKNILLHMLVPTLLRGIG

SEQ ID NO: 115977 - protein, 42 aa, Glycine max
  Coding DNA Sequence Number=SeqID_24292
MVLFVGEKMKNKKVAEAGVSLSEAYALSEQHPLSEALARLAS

SEQ ID NO: 115978 - protein, 146 aa, Glycine max
  Coding DNA Sequence Number=SeqID_24293
MHLLHSVIKQDQTDSSSMKWLHCIRRGSLQVEISKLCKDMAMEFMMVLLHPRSVSILLRKHCSEPGRHLLKLFMIGLMLKEKLKDGKSLGNSYFRILLKLQWTFSLITNLEMISFSYLKRKKQLPNKRGRRSKRNKRGRRNTLVES

SEQ ID NO: 115979 - protein, 262 aa, Glycine max
  Coding DNA Sequence Number=SeqID_24294
  Homolog annotation: Hit_ID=Q2HTA0; Match level="QueryCoverage=46%, HitCoverage=19%, E-value=1e-16, Identity=40%"; Hit description=IMP dehydrogenase/GMP reductase, related
  Pfam annotation: Domain name=DUF1723; Domain location=185-234; Score =46.7; E_value=8.4e-11; Accession=PF08330.1; Description=Protein of unknown function (DUF1723)
  Subcellular localization annotation: CTP_CleavageSite=66; ConfidenceScore=5.62e-01
MAQEGYQVLLSAPSIFVGTPSICARFLPSTLLLRLSLPLHLSSSSSSASSVGGCWLFLLLVLVGCSSSTVGACSSLSVTVGACSSSSSTMHLFVFHELIDDQPEAPVEEGVTDVEGFPGGPHDTSILTDFENHIALRVWNGEECPELKLSSHGRKMTKFERPAPEIEGLVATSGLSPLIACSLDTGNRGLMFAFVECWHKETSSFHLLVGEVTITLDDIASLLHLPVIGAFHNFELLHVNDVVEMLVELLEVSAAEARLETI

SEQ ID NO: 115980 - protein, 162 aa, Glycine max
  Coding DNA Sequence Number=SeqID_24295
MGFMPQTTGQGISNFLGEFLGYDEKNGNNFLRIRILIDVHKKQWSTMRLSLVARPSFPSPMAESSVVQGRHNCNKLDTINAINVKMAKNTKFLVELFKNPKSILSKAYAQSSVISDDNDKMISNNDGNDLVFKEKKQRIKGSHTQSLNKESIASIDPIPTVS

SEQ ID NO: 115981 - protein, 154 aa, Glycine max
  Coding DNA Sequence Number=SeqID_24296
  Pfam annotation: Domain name=zf-CCHC; Domain location=99-116; Score =30.1; E_value=8.1e-06; Accession=PF00098.14; Description=Zinc knuckle
MRDDKKRKVQDDQKAKNILTSGLSSDEFFRTARCKSSKEIWNMLEVTHEGTMDNLGTKDYNNQGIQESSYNDDGSSLWKSKDRKFYKSFKKIENKNNNFTCFKCGKQGHIKSECPIYLRKYVGEKKGKKAYIAWEDIAQQPPTLPVMKKLQTYA

SEQ ID NO: 115982 - protein, 379 aa, Glycine max
  Coding DNA Sequence Number=SeqID_24297
  Subcellular localization annotation: CTP_CleavageSite=28; ConfidenceScore=5.43e-01
MAMNALSVPCCANLLAKSFMSSSVVTLSASARAKRNLVSVVELLAKPILQKILICVNSLSTWLLGKGKPHLPGPSLTMILIDSPVRTPGTATLTMFFAGTSFRKGTTLTNLMEGSIDVALVKEFYANLYVLGDKPPKQVRVKGHLIKFDADSLNTFLETPVVLDPGETLLTYSRFCRLRPDPQEMVARLCIPGRGFVLNAEGLPWKLLRKGLTTLAQTWSVLSYFNLASTSHTSDLNLDRVRLVYGLEMKMDMNVGALISGQITLMAQSNSSRLEFPALITTLCMARGVISDSLTFESLNPTINLAYIKKNCWNLDDPTISFPGTRTRGSEGPSSAAPQTSIAPAPIPSAQVPATSNPSAQSTDLMMVMLQSIHQGQYL

SEQ ID NO: 115983 - protein, 162 aa, Glycine max
  Coding DNA Sequence Number=SeqID_24298
MVRTRGLGHALGAGRGRGISEDTHEADVPLRRRPTASARRQRVRLREDITERPEDVPQLHEDVPHVSDATPEITGTTDAVQTEGVATDGSLGSPAADEGFPGGPRDPSILTDFAEHVAHSIWSGQERPDLKLVSHDRKVDNIGRPAPEIEGLIAGTRLSPLI

SEQ ID NO: 115984 - protein, 200 aa, Glycine max
  Coding DNA Sequence Number=SeqID_24299
MEDANTCGGEEGNQISKRGRRSLLSDTQKMKEEDEPFWKEKNESTKEEACGEVAGCTGEEGKRGRKRYFWKFIQLLGAPSNTPKYPHQSIHFLLVWVTLTERTRATTLFGSRRHSLRRSMISHQRWFPTLSLRTMWKINRVREAREGLDGRERVMTTVACNLPLQFCYRIGCGSVRRLQWHTFSGYVWSERWWKMRDSAK

SEQ ID NO: 115985 - protein, 199 aa, Glycine max
  Coding DNA Sequence Number=SeqID_24300
DQGSLVSETFGCPDCDLCVLDALCEYRGVRAFDLILSYTGQLRWGQTVVYVRPERVLRQFGYLQTVPPPPICDSLTGDDIDDRWLHFSDHLVPSGELCVVPGQVVLDYMEWFFRISHPFVTQTEDTAASRHPPPPHHEEPPIPEVSVATDLPTHSVVHCEGCQGMAQDLGAIVEDLERVNNLRMVTPQMEVLGRARDAA

SEQ ID NO: 115986 - protein, 276 aa, Glycine max
  Coding DNA Sequence Number=SeqID_24301
  Subcellular localization annotation: CTP_CleavageSite=27; ConfidenceScore=5.07e-01
MGCSSPHVSAPLGGLYSFRQQEFNPCTCRALGGFQGPSPGRGIRLGSGDISPHVRASERRVAGLYTTVGRAGYTSTFLQCIHPSFMMLMMRGAHGPAGGLRYRGVRAFDLILSYTGQLRWGQTVVYVRPERVLRQFGYLQTVPPPPICDSLTGDDIDDRWLHFSDHLVPSGELCVVPGQVVLDYMEWFFRISHPFVTQTEDTAASRHPPPPHHEEPPIPEVSVATDLPTHSVVHCEGCQGMAQDLGAIVEDLERVNNLRMVIEGIDLHDIMTRCLS

SEQ ID NO: 115987 - protein, 55 aa, Glycine max
  Coding DNA Sequence Number=SeqID_24302
  Homolog annotation: Hit_ID=A9PIC9; Match level="QueryCoverage=83%, HitCoverage=11%, E-value=8e-08, Identity=58%"; Hit description =Putative uncharacterized protein
MMTSTNQEVEAADKEVGASGTIRSKGDIFLNGAQEGLMTKDVGSNMFHPTEHYPS

SEQ ID NO: 115988 - protein, 88 aa, Glycine max
  Coding DNA Sequence Number=SeqID_24303
MKISHVQTGNYECGYYVMHWIWCIVTGGLKDDWIHWFSDRSAGGGDKDYKEVPPPPLFEPAGGHINQAVTFNRSYYKVISSMEKWLSH

SEQ ID NO: 115989 - protein, 869 aa, Glycine max
  Coding DNA Sequence Number=SeqID_24304
  Gene Ontology: Mol. function=nucleic acid binding; Cellular component= nucleus; Biological process=meristem development
  Homolog annotation: Hit_ID=Q6J738; Match level="QueryCoverage=99%, HitCoverage=100%, E-value=0.0, Identity=78%"; Hit description=AML5 (RNA-binding region RNP-1 (RNA recognition motif); RNA recognition motif 2)
  Pfam annotation: Domain name=RRM_1; Domain location=203-269; Score =52.0; E_value=2.1e-12; Accession=PF00076.13; Description=RNA recognition motif. (a.k.a. RRM, RB
  Pfam annotation: Domain name=RRM_1; Domain location=288-354; Score =55.1; E_value=2.5e-13; Accession=PF00076.13; Description=RNA recognition motif. (a.k.a. RRM, RB
  Pfam annotation: Domain name=RRM_2; Domain location=703-799; Score =226.9; E_value=4.6e-65; Accession=PF04059.3; Description=RNA recognition motif 2
  Pfam module annotation: Pfam domain module=RRM_1::RRM_1::RRM_2; Domain location=203-269::288-354::703-799
MRQKGDAMRQSFDPSSLGPSKIPSIKIPGKAGNGAWEALSGSDSYHASSDASLFSSSLPVLPHEKLNLNETANAYQSIDDISSGFKKLHQDAEGNGSLEDGDTHAIGPALPDDEEELLAGIMDDFDLSGLPGSLEDLEEYDLFGCGGGMELETDPQESLTVGISKLSFADSTVGSVLPPYSFPNGVGAVAGEHPYGEHPSRTLFVRNINSNVEDSELRALFEQYGDIRTLYTACKHRGFVMISYYDIRAARTAMRSLQNKPLRRRKLDIHFSIPKDNPSDKDINQGTLVVFNLDPSVSNEDLRQIFGAYGEVKEIRETPHKRHHKFIEFYDVRAAEAALKSLNRSDIAGKRIKLEPSRPGGARRNLMLQLNQELDQEESRSFRYQVSSPVANSPPGNWLQFNSPVEQNSMQTINHSPGSRIISPTTGNHLPGLASILQPQVSNAVKAAAIGNDLGRSSQGEHIFSGMNSSHGATFQSHSLPEPKFSQYRGALSSIGPSTSNGSSVETLSGPQFLWGSPTLYSEHTKPSVWPRSSVGHPFAASNGKSHAFPYSTQNSSFVGSSQHHHHHHVGSAPSGLPFERHFGFHPESSETSFMNNVGYGGIGLGHNDGNYMVNAGGSVNPNTTIPRNISDNGSSNLRMRSSPRLSPVFLGNGPYPGLPPTTLESLADRARSRWIENNGSQVDSKKQFQLDLDKIRSGEDTRTTLMIKNIPNKYTSKMLLAAIDENHRGAYDFLYLPIDFKKKCNVGYAFINMLSPFLIIPFYETFNGKKWEKFNSEKVASLAYARIQGKSALVSHFQNSSLMNEDKRCRPILFHSEGSEVGDLIVQEHLSSNSNNLNIQAPRPSEFYSSDFAGSPPKAGPSASLDTN

SEQ ID NO: 115990 - protein, 114 aa, Glycine max
  Coding DNA Sequence Number=SeqID_24305
MSDGFCSTHLHIMVRTRGLGRVLGQVTGRGVGRGDRDDSDDAPQGRRPTASTRRQLVAVTADHVDEPVIPAPDVQDDPMEAPAAVEDIPADTGAEAAEDEHEGFPGGPSDPIRV

SEQ ID NO: 115991 - protein, 52 aa, Glycine max
  Coding DNA Sequence Number=SeqID_24306
  Subcellular localization annotation: CTP_CleavageSite=4; ConfidenceScore=5.30e-01
MVLTAGMGSVPSTARKVPRDSCSSLRSTNQLRPSAFSMFMTYYYIYVNVCTT

SEQ ID NO: 115992 - protein, 164 aa, Glycine max
  Coding DNA Sequence Number=SeqID_24307
  Gene Ontology: Mol. function=catalytic activity; Cellular component =membrane; Biological process=metabolic process
  Homolog annotation: Hit_ID=Q8L6W3; Match level="QueryCoverage=62%, HitCoverage=19%, E-value=4e-43, Identity=73%"; Hit description =Neutral invertase
  Pfam annotation: Domain name=Invertase_neut; Domain location=1-164; Score=-231.4; E_value=4.1e-05; Accession=PF04853.3; Description =Plant neutral invertase
MDCHNPRQGLMPTSFKVRTVPLDSDDSATKEVLDPNFGEASIGRVAPVDSIWERVDVQIGIKMMLKLCLADGFDMFPTLLVTNGSCMIDQRMGIHGHPLEIQEGGKGWFAAEGKEEGGELWRRGRGKEVVTEEEEEGCSGGEGGHDEGRRKKKEAAFEERGKRK

SEQ ID NO: 115993 - protein, 149 aa, Glycine max
  Coding DNA Sequence Number=SeqID_24308
  Homolog annotation: Hit_ID=UPI00006A2D9E; Match level="QueryCoverage =84%, HitCoverage=81%, E-value=3e-12, Identity=16%"; Hit description =UPI00006A2D9E related cluster
MRGTVHEPQANLGAGVDPWVLEPISFRGLHVLAFRGLHVLAFKGLHAFTFRGLHVLAFRGLHALTFRGLHILAFRGLHTLAFKGLHALAFRGLQVLAFRGLHVLTFRRLHALTFRGLHVLAFRGLHALAFRGLHALAFRGLHALAIRGL

SEQ ID NO: 115994 - protein, 417 aa, Glycine max
  Coding DNA Sequence Number=SeqID_24309
STLEDPHYLWLSEAESLSPAKRDSLAKLPTLNGIFEVLVPLSVTFKELGQLSGPCLTKWPMSSRKRKSISARPTAQYDTRRFHCFEAWTRYTDNVLGRHILVERKVGIYHMELDEFKAELERRNFHKCLTNLADNNIDLALVKEFYANLYSPEGPSPKQVRIRGHLIRIDADSLNTFLETPVFVLNAEGYPGKILRNDLTTLAQLDMNVGAFISGQITSMAQSNSSRLFPALIIALCRSRGVASDSLVFERLSPIINLAYIRKNYWNLDDLTAIIRGARRARARPAKAPSTSAPPLPARTSTAPSTPPSVDFQRLKAMLRSIHQGHIVAWPGIQPPIHREDEEAAATSEKSLEATPEPPAPVADTTSPQYATDPSTPEDQTTPVMSLNASPIATPVVHFTDEEDVQTQDTQDQSQDF

SEQ ID NO: 115995 - protein, 168 aa, Glycine max
  Coding DNA Sequence Number=SeqID_24310
  Homolog annotation: Hit_ID=A8GL57; Match level="QueryCoverage=83%, HitCoverage=72%, E-value=2e-30, Identity=50%"; Hit description =Putative uncharacterized protein
MARFRRCGCAARAAFPDAGPAASPPGVGNVMLLMVCLTLGLAGVMGLATDVAAAWSGKTSAAVLMGSGAIVAVWMTLILFQLVQGKNSGVVLLQYYLGMLGLFCLGAAAAWAAGMTGIATVAMLLGGGVGGALFSNRAAFYLYVAYFRTRRRVFIKRRWQREDLRNTR

SEQ ID NO: 115996 - protein, 83 aa, Glycine max
  Coding DNA Sequence Number=SeqID_24311
ESGVNEQPKAYAANIYNRPPQHQNQQQQNNYDLSSNRYNPGWRNHPNLRWTSPPQQQQPVPPFQNVVKILISILRSSILFVPP

SEQ ID NO: 115997 - protein, 225 aa, Glycine max
  Coding DNA Sequence Number=SeqID_24312
SEDYTSLPLETTRLASEAAHPRLRAAYARGLHVLAFRGLHAFTFRGLQVVAFIGVHAPFRGIHALRKSYTSSSRGLACPPFKRDTSPRLQRIHPSFRRLHALSFRALHVLTFRGLHAQPSQPSESTRPRLQRHSRPHLHGLHALTFAITGYTSSPSEDYSTLPLEGTCPHLQRMHVLALEDHTSFHLRGLHGSSPSEGTRLTIRGLHKSSPSQGYTLSPSEDYTS

SEQ ID NO: 115998 - protein, 242 aa, Glycine max
  Coding DNA Sequence Number=SeqID_24313
  Subcellular localization annotation: CTP_CleavageSite=32; ConfidenceScore=5.00e-01
DCMNMQCQLQSQMQSQGLVVPPDPLVGPFCPRVSTKGSCVDPSGNDPETSDSDRCDLYIEADPARLVAMGRVYEGSNVVHNTPLLLSQVKVSVEEVIEADTPVPVPTDEVAVSPAKPPPKPDLEVDNPLYLMTLTIPELFLRPYQVRWDATVFGVFNPDFPLYIKHEDLSEIAHGGQCLSISVLQLWIIHLTETCMRVGNSDIYGFLEPQSIQRSGQSQFESESYIKSWMQSSQAMSILEPT

SEQ ID NO: 115999 - protein, 158 aa, Glycine max
  Coding DNA Sequence Number=SeqID_24314
  Gene Ontology: Mol. function=sequence-specific DNA binding; Cellular component=nucleus; Biological process=regulation of transcription, DNA-dependent
  Homolog annotation: Hit_ID=A7LHH1; Match level="QueryCoverage=31%, HitCoverage=27%, E-value=1e-22, Identity=98%"; Hit description=WRKY30
  Pfam annotation: Domain name=WRKY; Domain location=64-113; Score =51.8; E_value=2.4e-12; Accession=PF03106.6; Description=WRKY DNA -binding domain
KRKSAQYANRLSPRVGRFINAAGTTGFPTGKRAVSATQLIYDHDYEFELGTLVKTEASNNSLYVMDGYQWRKYGQKVTRDNPSPRAYFRCSSAPSCPVKKKSRPAGMQAWHWPSFYNVVTGKTLALPNLIALQHIPLSPAGVIAKRPAPIALPNSCAA

SEQ ID NO: 116000 - protein, 110 aa, Glycine max
  Coding DNA Sequence Number=SeqID_24315
MGDQEETQEQMKADMLALKEQMASMMEAMLGMRQLMEKNAATAAAVTAYPYGLPPNYPPPVLQDDAGHIASPVLEREPPQQPDEVHKDPQDYAQRDVEFYPPIPEGPAPS

SEQ ID NO: 116001 - protein, 171 aa, Glycine max
  Coding DNA Sequence Number=SeqID_24316
MTFLGETSSQIIANLRLAFIFPNGSITHNQTGVYFQSSTIKPMRVPNDFSFETLKSKMHNTLQLTNDQLVVEIYYRLSFIDAELLCTINRTPDDILNLLQSTITPTHDVILYYNGKWNIPRQGGFLGYSFTKTNPIRFDIPLGCSMDKLKDLIKQVAPMGFPLMEFTNHRW

SEQ ID NO: 116002 - protein, 185 aa, Glycine max
  Coding DNA Sequence Number=SeqID_24317
  Homolog annotation: Hit_ID=A1B1X9; Match level="QueryCoverage=32%, HitCoverage=39%, E-value=1e-17, Identity=67%"; Hit description =Transcriptional regulator, BadM/Rrf2 family
  Pfam annotation: Domain name=Rrf2; Domain location=1-72; Score=1.9; E_ value=2e-05; Accession=PF02082.11; Description=Transcriptional regulator
MSGLREKGYLVSEKGHGGGWELRADLRDITLLDVYQAIGSPALFSIGPAADPSPCLVEHAVDARLDQALARLLILLLQFDLRVMLHHMRGDGGLKHFKHHTADKRGQRQRNEGCHDPVDQRPTAVQQRRVARKPANSSVCVMVIAMLAEASAIARHTPVSESKKACIDFLLCDDWRSGKNGGLSI

SEQ ID NO: 116003 - protein, 176 aa, Glycine max
  Coding DNA Sequence Number=SeqID_24318
  Homolog annotation: Hit_ID=A5C169; Match level="QueryCoverage=71%, HitCoverage=11%, E-value=1e-08, Identity=29%"; Hit description =Putative uncharacterized protein
MGAKSLEVVKRGSHPNNGWFPDEIRAEMTGRLLARSLTFDCRIMHYIIVRILLPRFSNLAQASEEDLILMWAFLTGRQIDWAHLVRYRMHKALRANAPLPYPQLVTLFLRHFQIPLDDEPFVQVKRSFAIGAGTITSFGYHKDRDGQWLKKDALHPQDERTPSPPPQRDDSALMTK

SEQ ID NO: 116004 - protein, 337 aa, Glycine max
  Coding DNA Sequence Number=SeqID_24319
  Homolog annotation: Hit_ID=Q84VI1; Match level="QueryCoverage=100%, HitCoverage=51%, E-value=1e-149, Identity=80%"; Hit description =Envelope-like protein
MATSPKETAASGSPAVPSSPHQEQPEFNIQPIQIIPGQASVPEKLVPRRQQGVKIAENPSLATSPREVDTEMDKKIRSIVSSILKDASVPDAEKDVPTSSTPNVSVPDVNKDVPTSSAPNAEALPSPKETPAPRAPETAPGDLIDLEEVESDEEPIANRLAPGIAERLQNRKGKIPLKRSGRIKTMAQKKSTPITPATSRRSKVAIPSKKRKEISSSDSDDDVELDVSTSKRAKKSGRKVPENVPDAPLDNISFHSIGNVEKWKYVYQRRLAVERELGRDALDCKETMDLIKAAGLLKTVTKLGDCYEGLVREFIVNIPSDISNRKSDDYQRVFVRG

SEQ ID NO: 116005 - protein, 210 aa, Glycine max
  Coding DNA Sequence Number=SeqID_24320
  Homolog annotation: Hit_ID=Q6WAY4; Match level="QueryCoverage=88%, HitCoverage=33%, E-value=3e-21, Identity=34%"; Hit description =Putative uncharacterized protein
MGTNQTGKRFYQVKIKGLDITNIKELGRLMGPLQMQAFRKVYGKILDLTIVEISTEAVVSLTQYHDQPLRCFTFGDFQLVPTAEEFEEILRCPLGGRKPYLFSRFLPSLSKIAVMVRDSARGLDRVKQTQNGVVGLPRKYLEGKARDMANQEEWVPFMDVLALLIFGVVLFPNMDGLVDLAAIDAFLAYHHSKESPVVAILVDLFDTFDR

SEQ ID NO: 116006 - protein, 36 aa, Glycine max
  Coding DNA Sequence Number=SeqID_24321
MEDRVTTDQSSSLPGAGPAENVAARQPSSSRQNANP

SEQ ID NO: 116007 - protein, 97 aa, Glycine max
  Coding DNA Sequence Number=SeqID_24322
  Pfam annotation: Domain name=G-patch; Domain location=2-43; Score =17.1; E_value=0.0016; Accession=PF01585.14; Description=G-patch domain
MMVARVMLGYGYEPGMGLGQNNGGKTSLVCTRGNHGKFGLGYKPTQVDIRKNLSSSVPAPLPILIHLHVYFFTLKNARSDDESLKGTNTQDPAVDFE

SEQ ID NO: 116008 - protein, 80 aa, Glycine max
  Coding DNA Sequence Number=SeqID_24323
MSICIALGVWLVYKPSLGGVDIEEEELIDLWSNPFQGEGDDAIIPRKGPVTRAMSKRLQEDWARAAEEGTRVLMNLKVDF

SEQ ID NO: 116009 - protein, 168 aa, Glycine max
  Coding DNA Sequence Number=SeqID_24324
MTTLTQIWMTLLLSNIQPSDHNSDLPLPKCQLVYAILTRMSIHVAQLIADAIYLFAGMAPTRHPLDPDKSNRALGFPALITGLFQSFGVPVAPSKYLRHLVRQQAANHRAHVQTHDCLYQLSLSLQSQGFTSFPCPAEAPAEAPDEADEAREDEEMTDLLDFLGGGIL

SEQ ID NO: 116010 - protein, 126 aa, Glycine max
  Coding DNA Sequence Number=SeqID_24325
  Subcellular localization annotation: CTP_CleavageSite=22; ConfidenceScore=5.02e-01
MSQRGSLIPTHIQPDIHGLGARVSTKGSNAKSVRNPCLPNDVALVKPPMGLYVQRQDSIELVALGKTYDGGSTIHNVAYADNVVRVSVEQVIDGDAEVPFPTSEFNMRAVVQLKTLKLLKRSTMLL

SEQ ID NO: 116011 - protein, 35 aa, Glycine max
  Coding DNA Sequence Number=SeqID_24326
MSPAVREDSFQLLTGALAEEIKARYDKAAVKVSLL

SEQ ID NO: 116012 - protein, 109 aa, Glycine max
  Coding DNA Sequence Number=SeqID_24327
MVSRSIIPFEKHIAKVGTTSNNMLSKTTTLDEGSLLSSKSETQHDHRFTFTPYVPMDPVPSGVANCRSLPFGGRATRGSRMRLPREENARSRHQRLFEENIGKGVVYEL

SEQ ID NO: 116013 - protein, 165 aa, Glycine max
  Coding DNA Sequence Number=SeqID_24328
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPCGAVYFDVWRNCASIAHGSGRG

SEQ ID NO: 116014 - protein, 35 aa, Glycine max
  Coding DNA Sequence Number=SeqID_24329
MVRGARVINGSGMEKEEREETPLQGEDESRRSSPP

SEQ ID NO: 116015 - protein, 372 aa, Glycine max
  Coding DNA Sequence Number=SeqID_24330
  Gene Ontology: Mol. function=protein binding; Cellular component =signalosome; Biological process=red or far red light signaling pathway
  Homolog annotation: Hit_ID=A7QQG8; Match level="QueryCoverage=55%, HitCoverage=51%, E-value=3e-65, Identity=65%"; Hit description =Chromosome undetermined scaffold_142, whole genome shotgun sequence
  Subcellular localization annotation: CTP_CleavageSite=22; ConfidenceScore=5.20e-01
MSPSSIFATHLSFRRSGLTGLHCSSTSSVPLMVSLAGNKDHDFGPLGNFGPRLDQVLKLVVEGETFDMMSTYTPQDLEALVHREYHYENKIFLGGDLNGHVGRTSRGYEGSYGVYDLGEGNVEDKSILDFLLAHDFTIANTLFFGVVLSAYCTKEINCVIAGAGYYNTELHVIDGIPQLIFVRSSYTIETVEAERISVDHVAHLKPSDGGSAATQSFGVGEVFDFCSDCQLVMSLNNRGGLSWAVNSKHEILLNLTKASEGFMAAHLTGIHSAIKMLHSRIKVLHHYLLAMQKGDVPCENSLLRQVSSLLRRLPAIESGKFQDDFLMEYNDTLLISYLAMLTNCSSAMNELVDKFNIAYDRHSRRGGRTAFM

SEQ ID NO: 116016 - protein, 211 aa, Glycine max
  Coding DNA Sequence Number=SeqID_24331
  Homolog annotation: Hit_ID=Q5CDC4; Match level="QueryCoverage=13%, HitCoverage=21%, E-value=2e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLPPYALTMVTGENVVATLTLTLQFLLLVLLMQQATGTELEFVIMVIAVSCVKLLSAHNSTQHTSRKHKV

SEQ ID NO: 116017 - protein, 81 aa, Glycine max
  Coding DNA Sequence Number=SeqID_24332
MDSGQFRKLVYQVNRISPPNFKALSLPHYDLPPYALSGHTGSMECPRAPPRYAHVAFESYPQKNGGLREPSRGYGYHCIIK

SEQ ID NO: 116018 - protein, 125 aa, Glycine max
  Coding DNA Sequence Number=SeqID_24333
MGRIKRILRLCRFEFLTREKGDTKEFRRLVLRSFGKERRETQKEFRRLVLGEFFLAKGEENEKMNSTSFQGLENQKTSESFWYKEEEEVQRDFKACKGLIGKAKVFKIVVRKIDFLKMQNKALLL

SEQ ID NO: 116019 - protein, 56 aa, Glycine max
  Coding DNA Sequence Number=SeqID_24334
MMKTKPTCVSKLRNNIEGYILCGTSRGSSGGYIHLGCSREQGGYIPCGSLPGKVLQ

SEQ ID NO: 116020 - protein, 94 aa, Glycine max
  Coding DNA Sequence Number=SeqID_24335
MASRDIILLGNKDYGGRDYQRQCLTKRGKPPLPMSHTDPGIRPNISMCVQRCRCNVCMEQQIFLTTNVIDRQTHTKHNNIAKGVALAPMYPQVR

SEQ ID NO: 116021 - protein, 104 aa, Glycine max
  Coding DNA Sequence Number=SeqID_24336
MTVSHGPSTLLTFGFGLGRYWSAMCRRQYSNLFVDELRGSGGGGGAFVACCRPSSGCYGVSPCAYLGGAVLLAESPVNRGLDDLARGDGHSIELTEARNQSWKP

SEQ ID NO: 116022 - protein, 171 aa, Glycine max
  Coding DNA Sequence Number=SeqID_24337
  Homolog annotation: Hit_ID=Q6UUU1; Match level="QueryCoverage=35%, HitCoverage=58%, E-value=2e-09, Identity=46%"; Hit description =Putative uncharacterized protein
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRLRPPDEHHKIDAQVRGGETRQDYKIQAFPPGSSLVRSPVPTLPLPDT

SEQ ID NO: 116023 - protein, 80 aa, Glycine max
  Coding DNA Sequence Number=SeqID_24338
  Homolog annotation: Hit_ID=UPI0000ECBAF8; Match level="QueryCoverage =51%, HitCoverage=48%, E-value=1e-16, Identity=100%"; Hit description= UPI0000ECBAF8 related cluster
VVGASDGPWRRWAAAAAVEDDPFLFFDGMQAWHWPSFYNVVTGKTLALPNLIALQHIPLSPAGVIAKRPAPIALPNSCAA

SEQ ID NO: 116024 - protein, 196 aa, Glycine max
  Coding DNA Sequence Number=SeqID_24339
  Gene Ontology: Mol. function=protein kinase activity; Cellular component=intracellular; Biological process=protein amino acid phosphorylation
  Homolog annotation: Hit_ID=A7Q5D4; Match level="QueryCoverage=84%, HitCoverage=10%, E-value=7e-69, Identity=78%"; Hit description =Chromosome undetermined scaffold_53, whole genome shotgun sequence
  Pfam annotation: Domain name=Ank; Domain location=125-157; Score =24.2; E_value=0.0005; Accession=PF00023.21; Description=Ankyrin repeat
  Pfam annotation: Domain name=Ank; Domain location=158-190; Score=9.7; E_value=1.3; Accession=PF00023.21; Description=Ankyrin repeat
  Pfam annotation: Domain name=Ank; Domain location=56-89; Score=32.3; E_value=1.8e-06; Accession=PF00023.21; Description=Ankyrin repeat
  Pfam annotation: Domain name=Ank; Domain location=90-122; Score=22.8; E_value=0.0012; Accession=PF00023.21; Description=Ankyrin repeat
  Pfam module annotation: Pfam domain module=Ank::Ank::Ank::Ank; Domain location=125-157::158-190::56-89::90-122
MAAQPSPDNDRVVPCERIRSFSEKPIPSSSIDLLFKAASDYGSNSLSSLLEAQNADEQTALHLACRCGSAELVEAILEYEEANVDVLDKDGDPPLVYALAAGSPECVRSLIKRGANVRPQLRDGFGPSVAHVCAHHGQPECMRELLLAGADPNAVDDEGESILHRAVAKKSADCALVILENGGNGSIAILNPKNMS

SEQ ID NO: 116025 - protein, 139 aa, Glycine max
  Coding DNA Sequence Number=SeqID_24340
YRLPLLDFVGVTPTGMTFFAGFAYLEGECVTNIVSHRQECQGQVQIFNRVEYAHWALKRVLKNSLGDLCSVWDAMNNMITLQHVEIKASFETTSQWIQSICSRGDFAFQIKGYVRSKSTSRRRLRPYLKDLRNLMCVAK

SEQ ID NO: 116026 - protein, 50 aa, Glycine max
  Coding DNA Sequence Number=SeqID_24341
MGGGVWLFGKTARKPHYKRNLKESWASSSKGNNTRKSSLPWIQTENANET

SEQ ID NO: 116027 - protein, 41 aa, Glycine max
  Coding DNA Sequence Number=SeqID_24342
MEQNRLRPRSEVKTSQWQKSTKVLRDGGKWRIGSRPTVVPS

SEQ ID NO: 116028 - protein, 130 aa, Glycine max
  Coding DNA Sequence Number=SeqID_24343
  Gene Ontology: Mol. function=protein binding; Biological process =defense response to fungus
  Homolog annotation: Hit_ID=Q1SWI6; Match level="QueryCoverage=73%, HitCoverage=44%, E-value=2e-23, Identity=55%"; Hit description =Leucine-rich repeat, plant specific
  Pfam annotation: Domain name=LRRNT_2; Domain location=27-67; Score =49.3; E_value=1.4e-11; Accession=PF08263.3; Description=Leucine rich repeat N-terminal domain
MKNLEMDLMVSAMLWLFSLPCRESVCIPSERETLLKIKNNLNDPSNRLWSWNHNHTNCCHWYGVLCHNVTSHVLQLHLNTTFSAAFYDGYYHFDEEAYEKSQFGGEISPCLADLKHLNHLNLSGNYFLGA

SEQ ID NO: 116029 - protein, 115 aa, Glycine max
  Coding DNA Sequence Number=SeqID_24344
  Homolog annotation: Hit_ID=Q2HTA0; Match level="QueryCoverage=60%, HitCoverage=10%, E-value=5e-07, Identity=45%"; Hit description=IMP dehydrogenase/GMP reductase, related
  Pfam annotation: Domain name=DUF1723; Domain location=40-87; Score =24.7; E_value=0.00035; Accession=PF08330.1; Description=Protein of unknown function (DUF1723)
MLQCEGFSSKLRYDFEIPNGEIVRNWVANMILKFHEDPTVNGFEIIIFLRQVWETNTFHLPVGELTITLDDVSSLLHLPISGTFHSFHALYVDEAVFLLMELLEVFGEEARVETT

SEQ ID NO: 116030 - protein, 196 aa, Glycine max
  Coding DNA Sequence Number=SeqID_24345
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
QLGANDYTELRYYSVSYEKAPRFPKGERRTGSEQESARGSFQGETPGIFIVLSGFATSDLSVDFCDARQGGGAYGKTPATRPFYADTARRSRTTERSESVSEEAEERPIRKPPLPARNSYDHDYEFELGTPKTNYGHLHALAICMQAWHWPSFYNVVTGKTLALPNLIALQHIPLSPAGVIAKRPAPIALPNSCAA

SEQ ID NO: 116031 - protein, 117 aa, Glycine max
  Coding DNA Sequence Number=SeqID_24346
MTGPLDESISCFLIRVDPWVLVPITLRGLHVLAIRGLHALTFRGLHRPRLESGYTPSHWVLVPHFSHPGPLGPSRIFLQKDVASGGSNLARLGELSSPGRAELAWASWAATTSPILL

SEQ ID NO: 116032 - protein, 24 aa, Glycine max
  Coding DNA Sequence Number=SeqID_24347
MHPLSFGDSSAGREVHWPNGVSLE

SEQ ID NO: 116033 - protein, 141 aa, Glycine max
  Coding DNA Sequence Number=SeqID_24348
  Homolog annotation: Hit_ID=A5B4U1; Match level="QueryCoverage=83%, HitCoverage=22%, E-value=2e-30, Identity=48%"; Hit description =Putative uncharacterized protein
SQTISFSDIQCDVPELKGDNYKIWKERILLQLGRMDKDYAIRKDEPPAITDESSPADVIDDQFITSDKTLASTLIMKFSSLRLTSVKGVREYIMKMRDISSQLKKLEEEERLVMEMGESALLTTAYGKNKAIKSQANQKGN

SEQ ID NO: 116034 - protein, 108 aa, Glycine max
  Coding DNA Sequence Number=SeqID_24349
  Homolog annotation: Hit_ID=Q84VH5; Match level="QueryCoverage=49%, HitCoverage=7%, E-value=1e-23, Identity=98%"; Hit description =Envelope-like protein
MAQTCLDTSGESCASGAVSKERCLMIAELKACKTHRQLAMMVKAAEEEEAAEEEEDHQIAKEITAKQVQHWPKKGKLSAGKLSVKYAILHRIGAANWVPTNHTSTVAT

SEQ ID NO: 116035 - protein, 397 aa, Glycine max
  Coding DNA Sequence Number=SeqID_24350
MVMIGEVPTEPHALPQFRFELQLDKLFDGLFVHCHDLSAFNRCGVSMVGFWIGGYGNFIVRWGMETMALSSLSVFLPIKAKYDVFASTSGHQVHVASGLDSLVHKTKGGIALVDEDPGHHEVSYNDGDNHRVVLVDEVDALEVSLSGLAGLSSIGKDASDGYRSCRCCLVYFGLPLAFCPLPSSYFAPLDVLRVLLLLDGSNSLRCCCQYCSDIDNIWLRLTPPGMFRLGPFGERLALVWLVPLVRLVRVRFGVCFALVTLLFGLVDFILESGPGCSPWLIRTVRTHRVLVADWPRRSRSCNETKASKLSMDLGGSPSYQVTAALLRDVPLCQEGTQMLVWICCPIVPLEVEWLPPQRYVYLHNAERCGWIARRPRDVWHEPLVGHGQPLALSTLPR

SEQ ID NO: 116036 - protein, 217 aa, Glycine max
  Coding DNA Sequence Number=SeqID_24351
MTTLTWIWMTLLLSNILPSDHNANLPLQMYQLVCAVMTLGSRPQDAQWTRRSPRGPWGFQLWGSAHKTPSGSEGAQQGPGFPALVTGLCQSYRAPVPPTSSCHRDIGKHLVDPKKANRVLQLSALITGLCQFYGVPVAPNKFIRHPINRAFIKKYCTPRQAQGETPQQPGECWQRATDAPPPPLEFTSAQQQKVRVLPTTHGRPIGNQVQSQRKVKY

SEQ ID NO: 116037 - protein, 57 aa, Glycine max
  Coding DNA Sequence Number=SeqID_24352
MEERERKIFRPDKFSAGLPFKIVLDWRYPTPPEQRGKDQNTQLPLQKHYPRENPIGP

SEQ ID NO: 116038 - protein, 59 aa, Glycine max
  Coding DNA Sequence Number=SeqID_24353
MHYSDHIIPAGEVCVVPGHASDPLPDGHRLFPTSRPSGPVDGYPSRAGARSIIDICGGA

SEQ ID NO: 116039 - protein, 50 aa, Glycine max
  Coding DNA Sequence Number=SeqID_24354
PWFADMAYFKVAGIIPKDLTWQQRKKFKHDARFYIRDDPHLFKIGADNLL

SEQ ID NO: 116040 - protein, 142 aa, Glycine max
  Coding DNA Sequence Number=SeqID_24355
MYWDQGSSDVLDVQDDTVFITILYHVDSRPMVRQRDIAVFNVMTWGPLVESAGRGVSQHISSGLDQRLFSGGFVNDMVVGGSAGDFVVFEGIVADGIAVEGIVVEGMVVEGIVVEGIVVEGIVVEGTGRGNVAFVGDMMGLG

SEQ ID NO: 116041 - protein, 23 aa, Glycine max
  Coding DNA Sequence Number=SeqID_24356
AFSEEIAKRAYRAKLSALSEFIL

SEQ ID NO: 116042 - protein, 30 aa, Glycine max
  Coding DNA Sequence Number=SeqID_24357
MGLLKWRKGKNDKGDGARLPTRRIGYKRIA

SEQ ID NO: 116043 - protein, 103 aa, Glycine max
  Coding DNA Sequence Number=SeqID_24358
MEIDFDKIQSVPTRKEGQISSKTLTCLNLRRSEYRQLPQQLHSLKGLQHKVLALLNISYSQKGKKDKRSDLTKKRVLARLRTTPLRQANWTTTASTDGLRERT

SEQ ID NO: 116044 - protein, 210 aa, Glycine max
  Coding DNA Sequence Number=SeqID_24359
  Homolog annotation: Hit_ID=Q6WAY4; Match level="QueryCoverage=88%, HitCoverage=33%, E-value=4e-22, Identity=34%"; Hit description =Putative uncharacterized protein
MGTNQTGKRFYQVKIKGLDITSIKELGQLMGPLQMQAFRKAYEKILDLTIAEISTEAIATLAQYYDQPLRCFTFGDFQLVPTVEEFEEILGCPLGGRKPYLFFGFLPSLRKIAIVVRDLARGLDRVKQTRNDIVGLSRKYLEGKARDMANQDEWVPFMDVLALLIFGVVLFPNVDGLVDLAAIDAFLAYHHSKESPVVAVLADLFDTLTE

SEQ ID NO: 116045 - protein, 21 aa, Glycine max
  Coding DNA Sequence Number=SeqID_24360
ESIDEEDPRPTSSNGACINTP

SEQ ID NO: 116046 - protein, 151 aa, Glycine max
  Coding DNA Sequence Number=SeqID_24361
  Subcellular localization annotation: CTP_CleavageSite=44; ConfidenceScore=5.54e-01
PPPPPPTSDASASTSSVKRTHKASCLGSLSTGPPGVERPVVHVDPATGKANSPHRKKLRTYLGIMARDKAEFDIPEASGSRTKRKLLQTMGERWRQFKLDLTRKWALAIDQDGVEDTVCDKYGISKEKWAQFFQTRRDPSWEDVRIKAQAI

SEQ ID NO: 116047 - protein, 125 aa, Glycine max
  Coding DNA Sequence Number=SeqID_24362
MAAQLIRDRVEMECLEGAWEPSKATRDESARTLQRTVAWILPTPTPYRLVEPVQVIEVTSSEEDPEEDLEELPPEPAVDALDFLEGDEDPLLEVDSHEEVMSASEADSTEDSGPREMATSGGSSS

SEQ ID NO: 116048 - protein, 180 aa, Glycine max
  Coding DNA Sequence Number=SeqID_24363
  Homolog annotation: Hit_ID=UPI00006A17C9; Match level="QueryCoverage =89%, HitCoverage=97%, E-value=4e-08, Identity=26%"; Hit description =UPI00006A17C9 related cluster
  Subcellular localization annotation: CTP_CleavageSite=95; ConfidenceScore=5.33e-01
MVMLVRMVCTLLFAAAWVKSCPSMHSSCVIASLSGCARTVGPPPISGGGPGTVKRKLLARACSPLKFRTCRLSKARECSPMMARMCNPLKVRTCSALMVRTCSPLKARTCSPLNGEGNEYPRRGRVVLSRRGRVVLSTVRVRACSPLMARTCSPLKVRACSPLKARTCSPLMVRTCSPLE

SEQ ID NO: 116049 - protein, 362 aa, Glycine max
  Coding DNA Sequence Number=SeqID_24364
  Homolog annotation: Hit_ID=Q6WAY6; Match level="QueryCoverage=82%, HitCoverage=61%, E-value=6e-30, Identity=29%"; Hit description =Putative uncharacterized protein
VKSLGTTSLKELGQLMGQLQRQAFRKAYGKIWDLAMVEVSTEAIASLSQYYDQLLRCFTFGDFQLSPMVEEFEEILGCPLGGRKPYLFTGFYPSLARISKIVQISAQELDHRKQVKNGVVGIPRKYLEAKARILAGVLFLNVDGLVDLAAIDAFLAYHNHKESPLFMYGWFHTFFAKRLRHACPLESHRSCTEKGRENWDQLLANKEGASVNWFPRWKEGRTGVLISCGGFLNVPLMGTRGCISYNPVLAIRQLGYPMRGAPLEYELVPVCKAWEVLQKKDKELRGSNNGTIGGYRKWLKAHVQGLDWLPSLRTTKREEVEAPEEDKEVQALRVEVEQAQTVKERFKSAALKIRKENTELRD

SEQ ID NO: 116050 - protein, 159 aa, Glycine max
  Coding DNA Sequence Number=SeqID_24365
  Subcellular localization annotation: CTP_CleavageSite=41; ConfidenceScore=5.13e-01
VAFLGKANFPNVCLRRKWPRGSLPQRGPGRIRQPKELVPLLSMTVTALGALYTSNASRPSRDGRFSGSDAAPAVDITGYSHGQWIPFDADAISQLLGYPLVLEEGQECEYGQRRNRSDGFDEEAIAQLLCIPRQDFARTAAGRRVRIMRTNMTTLTQYG

SEQ ID NO: 116051 - protein, 103 aa, Glycine max
  Coding DNA Sequence Number=SeqID_24366
ARLSATRSPLVRRKRKGELGPTLGYHGGAGFINYNPVLAIRQLGYPMRGVPSDESITPFIARVSVTTTRGYSKEFARHGMRREERTESLGEAVMGSSAAIISD

SEQ ID NO: 116052 - protein, 162 aa, Glycine max
  Coding DNA Sequence Number=SeqID_24367
SRGSPITGLCQSFGVPVAPSKVIRPPITWAFIEKYFTQRQAQGDAPQAAGAPPPPHQADPAGSFDTERYLRHSMRQHAANHRGLGQVHECLYQVSLSMQSQGFAPFLCPTPDQFKAEVAWPGDWPEAQAREAPAEAPDDGEEAGMDEEMSDLLGFLGGSGAT

SEQ ID NO: 116053 - protein, 60 aa, Glycine max
  Coding DNA Sequence Number=SeqID_24368
  Subcellular localization annotation: CTP_CleavageSite=31; ConfidenceScore=5.12e-01
HEVLHSLPPNHLLPQTQSSRSSQDPNTNSTRGMNDSGMEKEKREEMPLQGEDESRRSSPP

SEQ ID NO: 116054 - protein, 148 aa, Glycine max
  Coding DNA Sequence Number=SeqID_24369
  Gene Ontology: Mol. function=arsenate reductase (glutaredoxin) activity; Biological process=response to arsenic
  Homolog annotation: Hit_ID=Q9KJI1; Match level="QueryCoverage=70%, HitCoverage=98%, E-value=3e-45, Identity=71%"; Hit description=ArsC
  Pfam annotation: Domain name=ArsC; Domain location=7-86; Score=70.0; E_value=8e-18; Accession=PF03960.6; Description=ArsC family
MSNITIYHNPACGTSRNTLEMIRNSGTEPNVILYLENPPSRDEVLKLIADMGITVRYPILINRPIVVTPLGTRLCRPSEVVLDILPDAQKGAFAKEDGEKVVDDAAPYHDGNEFIPFIMQQQIMKPMYQADRPFRRFAIVHSSGPVVA

SEQ ID NO: 116055 - protein, 120 aa, Glycine max
  Coding DNA Sequence Number=SeqID_24370
ELARTLQRTVEWILPTPTPYRLVEPVQVIEVTSSEEDPEEDPKELPPEPAADALDFLEGDEDPLLEVDSPEEVMSASKADSTEDSGLGEMAISGGSLSQWTALWISFVYFFRVGVSRTDC

SEQ ID NO: 116056 - protein, 103 aa, Glycine max
  Coding DNA Sequence Number=SeqID_24371
  Homolog annotation: Hit_ID=Q1SN17; Match level="QueryCoverage=77%, HitCoverage=17%, E-value=7e-12, Identity=43%"; Hit description =Transposase, putative
MRSDINTGVRGRASFLLIACERSGRLTKDEKIVVADMTKSMVKPRNILLMLKEHNANSYTTIKQIYNVRHAYRSSIRGSNTEMQQCMMLFDRDQYIHWHRMKG

SEQ ID NO: 116057 - protein, 228 aa, Glycine max
  Coding DNA Sequence Number=SeqID_24372
  Homolog annotation: Hit_ID=Q6WAY3; Match level="QueryCoverage=17%, HitCoverage=1%, E-value=2e-08, Identity=65%"; Hit description =Gag/pol polyprotein
MTLLRCVDAKEANFMIEEIHEGSFGTHANGQAMARKILRAVITGSLWRAIVAPMHPLDPDKSNRALGFPALITGLCQSFGVPVAPSKVIRLPITRAFIEKYCTARQAQGGDPQAPDAPPPPPQADPAGSFDTERYLRHLVRQQAANHRAHVQTHDSLYQHSLSLQSQGFASFPCPTPDQFRAEVAWPGDWPEAQAGEAPAEAPGEANEAREDKEMTDLLDFLGGSGAT

SEQ ID NO: 116058 - protein, 98 aa, Glycine max
  Coding DNA Sequence Number=SeqID_24373
MGQVSSFDGRLSHNYYAYWGKISPSRYKVTSVDRIAPARHPMDTKKFNRVLGFPALITSLCQFYGVSVAPSRVIRPLTNRAFIKKYYAPRQAQGEAPQ

SEQ ID NO: 116059 - protein, 64 aa, Glycine max
  Coding DNA Sequence Number=SeqID_24374
MALEWWSQRKHHVPVRVPGAAEVDVGVGVADVEGRSAGLALALALLAPRIETVRSSGFQQFFLM

SEQ ID NO: 116060 - protein, 170 aa, Glycine max
  Coding DNA Sequence Number=SeqID_24375
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRNRKKAALLAFFHRLRPPDEHHKIDAQVR

SEQ ID NO: 116061 - protein, 63 aa, Glycine max
  Coding DNA Sequence Number=SeqID_24376
SPRNRENVAAVLWSLCTGDPLQLKLAKEHGAEAALALEEDIRGSQDSIWWRDLLSSQQQQQNQ

SEQ ID NO: 116062 - protein, 113 aa, Glycine max
  Coding DNA Sequence Number=SeqID_24377
DAGSRQARQGASAGVGGCRGWLNYAASEQIVLRVHHMRAIGAGLFAITPAGERGMCCKAIKLGNARVFPVTTLIPPAAEARRDDGRHACRPERGWHGAGPGPSAQGRVPSSNS

SEQ ID NO: 116063 - protein, 192 aa, Glycine max
  Coding DNA Sequence Number=SeqID_24378
MRSWVRGQWIPFDADALSQFLGYPLVLEEGQECEYGQRRNQADGFDEEAIAQLLCIPGQDFARTVAGRRVRIMRTNMTTMTHIWMTLLLSNIQPSDHNSDLPLPKCQLVYAILTRMSIHVAQLIADAIYLFAGMMPTRHPLDPDKSNRALGFPALITGLCQSFGVPVAPSKVIRPPITRTFIEKYCMQRQAK

SEQ ID NO: 116064 - protein, 166 aa, Glycine max
  Coding DNA Sequence Number=SeqID_24379
STLEDPRELERVADEEHRGVVAHQVPVAFVGVELDGEAAHVALGVGRAALAGHGREAQEQRRLLADLGEDAGAGVLGDVVGDGEGAIGARALGVHHAFGDAFTVEMGKLFYQPEVLQQRRAARAGGQGVVVVGHRGARGGGQMLLVGHGTHSLRNSWNARRRGRAT

SEQ ID NO: 116065 - protein, 282 aa, Glycine max
  Coding DNA Sequence Number=SeqID_24380
  Homolog annotation: Hit_ID=Q2HW90; Match level="QueryCoverage=94%, HitCoverage=61%, E-value=2e-24, Identity=29%"; Hit description =Putative uncharacterized protein
MGTNQTGKRFYQVKVKSLDTTSIKELGRLMEPLRMQAFRKTYGKILELTTTEVSIEAIASLTQYYDQPLRCFTFGDFQLVPTIEEFEEILGCPLRGRKPYLYSGCLPSLSRIATVVKDSARGYGKSRGLGPVYGCVSVANFWGRPLSKRIDGLVDLAAIDAFLAYHHSKESPVVAVLADLFDTFDPKQDTRHPCPLQSHRSCTEKRRIDWDQLLAGIGGRAIHWFPRWKEGKEGVLFSCGGYPNIPLIGTRGCINYNPALAIRQLGYPMRGAPTEENMSPFL

SEQ ID NO: 116066 - protein, 149 aa, Glycine max
  Coding DNA Sequence Number=SeqID_24381
PPLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLGIL

SEQ ID NO: 116067 - protein, 51 aa, Glycine max
  Coding DNA Sequence Number=SeqID_24382
MYRSLMKNLWLSKCYLAKPSSGWAKRAKSLSPDNLVKFLEVLLGLSAIPMG

SEQ ID NO: 116068 - protein, 88 aa, Glycine max
  Coding DNA Sequence Number=SeqID_24383
  Subcellular localization annotation: CTP_CleavageSite=67; ConfidenceScore=5.24e-01
MSSSAPFVIQGQRVRWQAKIPYGHPRLSSTEGNEFNGIRMMFLLSSSGNIQAQRRARFFSAGQGRSSAMAKGSVVVVQLCRFQNTEVY

SEQ ID NO: 116069 - protein, 99 aa, Glycine max
  Coding DNA Sequence Number=SeqID_24384
MPPQTGTLSLNSEYMRWYRRKTKVYVDPKHARRGILGEIAETLHFMVSPVGRRVCTFDDLLPCIEKITLLSDKEDRILEAHEDAPPSQAQFEHQQFNIL

SEQ ID NO: 116070 - protein, 155 aa, Glycine max
  Coding DNA Sequence Number=SeqID_24385
MRGNSSTSNLAPLDLEIEATCRRNNAERRRNILQERTAQPSLEEAESSSVFPELRESKVGASEAHIMAEDQPRRVTLENYSSSTVSQFFISIARPKVQAHNITYPHSLIRLIQGNLFHGVPEDAVRLNMFSFSLVGEAKRWLHSFKGNSLKSWEE

SEQ ID NO: 116071 - protein, 258 aa, Glycine max
  Coding DNA Sequence Number=SeqID_24386
MDRARLVYELVTWMDMDVGSFISGQIWQMAQSNSFRLGFSALITALCIARGVVPDSLSFESQSPVINLAYIRKNCWNPDDPTITFPGTRKTRAQGPSDASAPSSSAPPAPAPTPSGTSMQTPDVIVLMLQSLHHSLCQVMQSIHDLAQHQPIMSMEAFMAQAEPEPEVTPEAEAEAEETPECRSKLHDDESKGTSTWVVVTGNKRGYISCGSVQVEGTSTWLFKENKGGYIPCGSLLVKDFTRLKRNLKDRRSLGDWI

SEQ ID NO: 116072 - protein, 167 aa, Glycine max
  Coding DNA Sequence Number=SeqID_24387
  Homolog annotation: Hit_ID=UPI00006A2D9E; Match level="QueryCoverage =84%, HitCoverage=74%, E-value=9e-09, Identity=19%"; Hit description =UPI00006A2D9E related cluster
GGPLGTSTYRLKRVACPHLQRVARPCLKEYTSSPSEGYMPSPSEDYTSSPRGLYVLTFRGLHILTFRGQHVLTFRGLHAFTFRGLHALTFSGLHVLALRTTRPHLQRATRPHLQRTTRLHALAFRGLHVLAFGGLHALTFRGLHVLIFRGLHALSFRGLQSLPSEDY

SEQ ID NO: 116073 - protein, 132 aa, Glycine max
  Coding DNA Sequence Number=SeqID_24388
MNLQSLFQGPKNLGLEDLRPPSTFAFPSPPAAPVLPEPASGPTPDHAEFAGCGPATTSYEHGGVSVEAQEPQPDQEDDILEASEPTPPESFIFKTDPVAATPQVTPEPSTVVLDMSSSQPESSAPVPDLTLP

SEQ ID NO: 116074 - protein, 122 aa, Glycine max
  Coding DNA Sequence Number=SeqID_24389
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVAFIPVFLLTLHTHYAHCSTAPKNNSATPNPCVVVPKP

SEQ ID NO: 116075 - protein, 82 aa, Glycine max
  Coding DNA Sequence Number=SeqID_24390
  Subcellular localization annotation: CTP_CleavageSite=45; ConfidenceScore=5.12e-01
MTRTRLFSAAQGKSCPGMHSRRVIDSLSGCARTVGHPPISGAQVSVKHLRANDLLKARACSPLQARMCSPLMARTYSPLKVI

SEQ ID NO: 116076 - protein, 85 aa, Glycine max
  Coding DNA Sequence Number=SeqID_24391
  Gene Ontology: Mol. function=nucleic acid binding
  Homolog annotation: Hit_ID=Q2A9Z4; Match level="QueryCoverage=100%, HitCoverage=14%, E-value=1e-09, Identity=44%"; Hit description=Zinc knuckle family protein
MTIEESIHVTFDETNITSPRKEFLDDIADSLEDMHNQEMNLKRKRNEENKDVQDDIAQENDDLPKEWKTSRNHPLDNIIGDISKG

SEQ ID NO: 116077 - protein, 106 aa, Glycine max
  Coding DNA Sequence Number=SeqID_24392
MSCPEPLAFLHRWGVDVIGAIEKPKPRTNRFRWQPLNDYQPMYPEFPDEDIMALFEEKLDKDRDKWTVWLGFDCTNNMAEYEACVLAVQAAIDSMSNYSGVRRLSV

SEQ ID NO: 116078 - protein, 91 aa, Glycine max
  Coding DNA Sequence Number=SeqID_24393
MAEIKEGSSTKTSQSLFHSNSNKEAGDNTVLAQGSINQQFIQLKLGARDKSFKHVVSFLAKRLSQSNMAFIILNFMHSVHTSEIHAKISTK

SEQ ID NO: 116079 - protein, 88 aa, Glycine max
  Coding DNA Sequence Number=SeqID_24394
ISVNHGLHDASSIGACRPRIFFINGFLFFLEDEWKKNGERKRERRRHFKEKMSLEEAHHHRRPWIRAWRKKEMNEGRGREEHKILCSK

SEQ ID NO: 116080 - protein, 92 aa, Glycine max
  Coding DNA Sequence Number=SeqID_24395
MWVSTERFPADFRWEEKEKTDFKKEEKEKREGKVFERAGRRVTRGMRVPRKEYARSRHQRLFEENVGKTGKDAIYELLSERFGSCIYARGRY

SEQ ID NO: 116081 - protein, 166 aa, Glycine max
  Coding DNA Sequence Number=SeqID_24396
LYFNGRVYEDNDGVIFEGRKYVALQICDDEDVETMIESFQQQQQMSVLELYVEKDVAGSSIFHSANSVLSCGHNLSHHESKLPRSISNLHDNEDDDLASNSYIEESLNEDDSVDGISDTDDEVTNIIEPISIVHPTEGVPGIQNPFWNDALHHNNVNWSHPDEDIC

SEQ ID NO: 116082 - protein, 66 aa, Glycine max
  Coding DNA Sequence Number=SeqID_24397
MPNYYEKGRAPDLESVLEDFMTYQASSKGDCYSMQQQGAQFERDYSSVDYQWESKWKPYYHNEVEG

SEQ ID NO: 116083 - protein, 37 aa, Glycine max
  Coding DNA Sequence Number=SeqID_24398
MKVDGTVDKYKARLVIQGFRKKEACLVDRIPRKKNKV

SEQ ID NO: 116084 - protein, 90 aa, Glycine max
  Coding DNA Sequence Number=SeqID_24399
MGSSQKPLLKKRFYQVKIKSLEVTSLRELGQLMGQLQRQAFRKAYAPRPTWALQNIPPEGCCFWRNQPGSPGRAELAWASWAATTSPSLL

SEQ ID NO: 116085 - protein, 148 aa, Glycine max
  Coding DNA Sequence Number=SeqID_24400
MAYQLATSRKITVSLRKKWYIDSGCSKHMTGDASNFTHISPKKSGCHTLISSGDLCSMTCDHSLVLVRFRNITERKQVSLRIRKFPYFTKKITKKQQGGVLSKMGVQIAPRPTWALQNIPPEGCCFWGKQPGSPGRAGRQPPPLFCYK

SEQ ID NO: 116086 - protein, 73 aa, Glycine max
  Coding DNA Sequence Number=SeqID_24401
  Subcellular localization annotation: CTP_CleavageSite=26; ConfidenceScore=5.08e-01
MKDCKNTSGEDISFTSRISQSLTNSSQALKPGLNRWPFHARALSALMDRLAHISEFWLSACLSRLADGLKQCA

SEQ ID NO: 116087 - protein, 175 aa, Glycine max
  Coding DNA Sequence Number=SeqID_24402
MVSRGGEKSEECLFHLGELHDMETCPRDGRATSMTHGQGAARSVRERNMTSRRSEYPPTVPKPMPFSYQSNKVVPWKYTPPAFGEGVATEVDSLSAKVTNITGLSGITHSGRVFAPPHSEELPSKGKAPMTQESAGAATPSKEVDPPVVKGAEKKEGLQGKTVTLEEAHEFLRLI

SEQ ID NO: 116088 - protein, 126 aa, Glycine max
  Coding DNA Sequence Number=SeqID_24403
  Homolog annotation: Hit_ID=A6FJQ2; Match level="QueryCoverage=30%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFLPRRVGAHPSELLLQPEVTLLAQAVCVLGALPLPRSLTRCARSFGCGERYQLTQGGNTVIHRIRGYAED

SEQ ID NO: 116089 - protein, 101 aa, Glycine max
  Coding DNA Sequence Number=SeqID_24404
MGSKKTNNGSWGAAIPAVSMGNRGVLAQAVEAKLHGESKNNSRVQDKNQEEFKTQEESLESRIKIQGSRSQESRSRFKTQDSRIKRRLNQDKYEKFFSKIE

SEQ ID NO: 116090 - protein, 54 aa, Glycine max
  Coding DNA Sequence Number=SeqID_24405
  Subcellular localization annotation: CTP_CleavageSite=16; ConfidenceScore=5.40e-01
MLVATPRVFLLWNTHPASHASPSRRRKSSLAKNLCYSSSSFLLPLAKRFKGLTA

SEQ ID NO: 116091 - protein, 87 aa, Glycine max
  Coding DNA Sequence Number=SeqID_24406
MQPNAILPRKGPVTRAMSKRLQEDWARVDKEGLRVLMNLRLSSSFSRKLLKELLKEVFSKKLLKEVFLRKLLKEVFLRKLLRKLPSL

SEQ ID NO: 116092 - protein, 87 aa, Glycine max
  Coding DNA Sequence Number=SeqID_24407
MGPLQRQAFRKVYGKILDLTAVKVFMEAVVSLAQYYDQPLRCFTFGDFQMVPTIEEFEENLVLFPNVDGLVDLAALTPSSRITTARK

SEQ ID NO: 116093 - protein, 263 aa, Glycine max
  Coding DNA Sequence Number=SeqID_24408
MVGQGGEVLGNIGGPHMGHNRNAYPYVLPPNYMPPTMHMPNENANHVVPVTFEGQQPWEHAQCDFDPYPTFTAEGLAFNAMPQPNTTEAPQPHPLQQLCFLVGGPPPAVEGIEKLDLIEERLRAVEGFGDYLFANMAELCLVPDVVIPPKFKMITMIVDTLPVFYCKKLVGYMPSSFVDLVFAGKRIEVGMKRGKFDYLASAGTSNRRFGASRAIKKEGEAHAVASAPTWPKPQQTPHNTYQYAQHQPSFSARVGNPSSLVPV

SEQ ID NO: 116094 - protein, 192 aa, Glycine max
  Coding DNA Sequence Number=SeqID_24409
PGPSPDIGRRPTVQAHPEREAITHLLCIPGQDFTRAAAKRRVRIMRTNMTTLTWIWMTSLFSNILPSDHNANLPLQMYQLGSRLQDAQWTRRSPTGPWGFQLWWRASVSPTGCPFPQRGIAPTKTLSGPGEVQQGPGSFQALITGPLSVLRSAFTSGKAQGETPHQPGDGRQRAIDAPPSPLEFTSVHPQKG

SEQ ID NO: 116095 - protein, 150 aa, Glycine max
  Coding DNA Sequence Number=SeqID_24410
MVSGNRLPRECNRLPGLKTRFHVLKLYNSSLVSGNRLPRLCNRLSEMKSLKIPLYLHIVRTVEWILPTPTPYHLVEPVQVIEVTSSEEDPEEDPEELPPEPAVDALDFLEGDEDPLPEVDSPEDVMSASEVDSTEDSGPGEMAISGGSLS

SEQ ID NO: 116096 - protein, 233 aa, Glycine max
  Coding DNA Sequence Number=SeqID_24411
MAMFDLDVVLEFYANAWPTEEGVRDMRSWVRGQWIPFDADALSQFLGDALVLEEGKECEYSQRRNQADGFDEEAIAQLLCIPGQDFARTAAGRRVRIMCTSMTTLTQMWMTLLLSNVLPSDHNSDLPLPKCMPPTRHPLDPDKSNRALGFPALITGLCQSFGVPVTPSKVIRPLITRAFIEKYCTPRQAQGDAPQAVDAPPPPHQADPAGSFGMERYLQHLILQQAANHRGQV

SEQ ID NO: 116097 - protein, 168 aa, Glycine max
  Coding DNA Sequence Number=SeqID_24412
MDPKMSNKALGFPVLVTGLCQSYRVPVPPARSCHRDIGIAPTKTPSGPGEVQQGPRVSSSGYGPLLSYRVPVPPDKGSCPQDTQWTRRSPTGSWSCQALIRGLCQFYGVPLTSSKGIRPPTNRAFIKKYCISRQAQGETPQQPGDGRQRATDAPPSPLEFTSAHPQKG

SEQ ID NO: 116098 - protein, 40 aa, Glycine max
  Coding DNA Sequence Number=SeqID_24413
MTLQLADRSITRPYGVIEDVLVREVEQEVLKVRAKFDITH

SEQ ID NO: 116099 - protein, 244 aa, Glycine max
  Coding DNA Sequence Number=SeqID_24414
MRGAQRKGVSHLSCERFRRARSQGYTRIHKAWRSPLRKDKELRGIRNGVIGGYHGWLIIHTRGLDWLSKLKVNDKENFEAPEEDEEVRALKLELGKARLAKEKFKSDATHIRKECTELQEENAATARALEQETKRARKEKYGREKFRGALWGSNNELKLRREERDRSQVHGMILKEELVACARSKRSLAQHLEAMEQSMLAIIGQYKEELNQSVAHEQKLVEDFAQVIEAVPESNKHENAVTRK

SEQ ID NO: 116100 - protein, 148 aa, Glycine max
  Coding DNA Sequence Number=SeqID_24415
MQHCMKVSTIPLRTGFVVHMSRAGGVFHALAGPLIHVDQGRTLIVYGMDYQVFGDFHFQPDSPPTCPLRPVIPKNTCPPRLTAAAGTELAGASSSSPVMIAHSTKELYKRHCPSSLTRYCWIGLSPIVQDSPLLPPVGVRAVSQSQCG

SEQ ID NO: 116101 - protein, 133 aa, Glycine max
  Coding DNA Sequence Number=SeqID_24416
MAAQLIHDRVKMECLEGAWETLEGNTRFRFRGTIRFTTTSLVHPDEPACTLQRTVEWILPTPTPYRLVEPEDPEEDLEELPLEPAVDALDFLEGDEDPLPEVDSSEEVMSASEADSTEDSGPGEMAISGGSSS

SEQ ID NO: 116102 - protein, 74 aa, Glycine max
  Coding DNA Sequence Number=SeqID_24417
  Subcellular localization annotation: CTP_CleavageSite=65; ConfidenceScore=5.16e-01
MACNLCLTASRYLAPFVAQYVKFRDMPKIKRKYVTQSKSKARCFRNVSVGDFAKIVNRSSSFVVRSSSFFGLQL

SEQ ID NO: 116103 - protein, 200 aa, Glycine max
  Coding DNA Sequence Number=SeqID_24418
  Homolog annotation: Hit_ID=A2Q4P8; Match level="QueryCoverage=57%, HitCoverage=46%, E-value=9e-16, Identity=40%"; Hit description=IMP dehydrogenase/GMP reductase, related
  Pfam annotation: Domain name=DUF1723; Domain location=69-118; Score =64.3; E_value=4.1e-16; Accession=PF08330.1; Description=Protein of unknown function (DUF1723)
MVMMLQRDSLVVHETRQCSHHLSSMLHMPCGVDSVTWEEGDTDWEAVPEIEGLVAATGLSPLIDCSVITGDPGLISAFVERWHSETSTFHLPVGELTITLDDVSSILHLPITGALHSFHALSTEEARFLLTELLEVSVEEVRAETTLTRGAYVRLGWVRDIYDARCQPGGGLSLLALIYCTLLVALFLLIRVHIRACGPP

SEQ ID NO: 116104 - protein, 236 aa, Glycine max
  Coding DNA Sequence Number=SeqID_24419
  Gene Ontology: Mol. function=phosphoprotein phosphatase activity; Biological process=intracellular signaling cascade
  Homolog annotation: Hit_ID=A7R8Y3; Match level="QueryCoverage=58%, HitCoverage=40%, E-value=3e-26, Identity=41%"; Hit description =Chromosome undetermined scaffold_3090, whole genome shotgun sequence
MTTTKNKYEERCAMPPIIKLNQSEVCASYYKCGHGNDVQPWLQRGLLPKWLRRGNQHIGNDDVRVFRRKLDIMKRHEFVWEPYPSTVISLLPPVCLVGSLAWYAVVPLICFQVIEWHQPDRVLRQFGMQQPIPESPSQPLNIHGITLKGKHDENRGQLFAPMIDQWNNRHAFRVDAYPRQEGLLSFNSDYMVWYRRKTKMFVDPTNAKTATLGEVAEALQYMVSPQGRNTCTFDDL

SEQ ID NO: 116105 - protein, 126 aa, Glycine max
  Coding DNA Sequence Number=SeqID_24420
MVVILPKEHLVVWFCSLHNRPDNYLKGIINSLNQRLLLGGLSSRQKGSTECGYYVMHWMSTIILGTFRNNWEAYFNDPRPLEPERLKALRIQWAQFYLRVRDQAWDLGTVVFSLVYFGLTFFTFSM

SEQ ID NO: 116106 - protein, 84 aa, Glycine max
  Coding DNA Sequence Number=SeqID_24421
MTVRLRDNRMINDKDGSQSQSSQSNVVEKFLLNAQVVSIGEINNLRQDCYCLTVGTVDEIIIDAPWSYDSRPNCTTTFDPSKGG

SEQ ID NO: 116107 - protein, 152 aa, Glycine max
  Coding DNA Sequence Number=SeqID_24422
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=98%, HitCoverage=33%, E-value=1e-67, Identity=82%"; Hit description=ATP synthase subunit alpha
  Pfam annotation: Domain name=ATP-synt_ab_N; Domain location=1-45; Score=10.2; E_value=0.022; Accession=PF02874.14; Description=ATP synthase alphabeta family, beta-barrel domain
MAGELVEFEEGTIGIALNLESKNVGVVLMGDGLMIQEGSSVKATGRIAQIPVSEAYLGRVINALAKPIDGRGEISASESRLIESPAPGIISRRSVYEPLQTGLIAIDSMIPIGRGQRELIIGDRQTAIGQKASSVAQVVNTLQERGAMDTLL

SEQ ID NO: 116108 - protein, 133 aa, Glycine max
  Coding DNA Sequence Number=SeqID_24423
  Homolog annotation: Hit_ID=A6FJQ2; Match level="QueryCoverage=28%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARLTYGVERQLQCKARNHSVFRSGMRKIPKKKGKKVFSLSFLDPSSPRLASGSPGPPKDFRVKEPACLGKPVTSGLSLRVPSSNS

SEQ ID NO: 116109 - protein, 172 aa, Glycine max
  Coding DNA Sequence Number=SeqID_24424
MDRFALTLNGSQELPRLLAKAKAMADTYSAPEEIHGLLGYWKNTITKRAARDPYRTRSKSRTMGDQEETQEQMKADMSALKEQMASMMEAMLSMKQLIEKNAATAAAASSAAEADPTLLATTHHPPSNIVGRGRDTLGHDGSPHLGYNRAAYPYGLPPNYSPPVLQEGGSSR

SEQ ID NO: 116110 - protein, 109 aa, Glycine max
  Coding DNA Sequence Number=SeqID_24425
  Homolog annotation: Hit_ID=A5BUC7; Match level="QueryCoverage=59%, HitCoverage=26%, E-value=8e-07, Identity=50%"; Hit description =Putative uncharacterized protein
MAPNLKIMPVLKELDMKKAKARIMQSKFVHYFKGCKSQRHSFVKEYSKLKFLGIDNQMQQSGEVNLIYCKSKDQLADMFTKSLPINKFELKELEFAVPKARRSVEDILL

SEQ ID NO: 116111 - protein, 89 aa, Glycine max
  Coding DNA Sequence Number=SeqID_24426
MGRNVSALIGKYVPHIPKICKDLGSTYTFDLLYEVQAEEPSSSSPTLVPPTVQPLPTPELKPLSVNLKYAYLEDKEKFSVIISASLAVE

SEQ ID NO: 116112 - protein, 183 aa, Glycine max
  Coding DNA Sequence Number=SeqID_24427
CRCSSPVPTDEVAVSPAKPLPKPDPEVNDPLNLMTLTISELFLRPYQVTWDATVFGVFNPDFLLYIKYEDLSEIAHGGQCLGISSFQRSGQSQFECESYIKTWMQSSKCDVYLGAYLNGEHWQMVVILPKEHLVVWFYSLHNMPDNYLKGIINRQKGSTECGYYVMHWMSTIILGTFRNNWEV

SEQ ID NO: 116113 - protein, 144 aa, Glycine max
  Coding DNA Sequence Number=SeqID_24428
TDIDDRWVHFSDHVVPTGKLYVVPGQVAPDYMEWFFQISHPFLTPTEDTVEPRPAPPPPTHDDDFVEPPVVEVSVTSDLPTHSVVDCTTCVRIGRIAEHLERVINLRMVTEGTDSYDIMDPCLRIARDDDPDDSLRPRQRPRID

SEQ ID NO: 116114 - protein, 106 aa, Glycine max
  Coding DNA Sequence Number=SeqID_24429
MGDSDKCGLYIKENPSRLVALGRVYEGSTAVHNIPLLHGQVKVGVEEVKNAEAPIPIPTDEEVMSPAKPPDRPDHEIDDPLYLMTLTIPQLFVRPLQVMWDAIMFG

SEQ ID NO: 116115 - protein, 26 aa, Glycine max
  Coding DNA Sequence Number=SeqID_24430
PETCRKSKGSRLTRSVKFRNVTEIKR

SEQ ID NO: 116116 - protein, 132 aa, Glycine max
  Coding DNA Sequence Number=SeqID_24431
MERSMIDAASGGALGDMTPAEARNLIEKMASNSQQLSARNDAIVLRGFHEVATDSSSSAKIKKLEGKLDALVNLRNHPNLRWTSPPQQQQPVPPFQNAAGPSKPHVPPLMEQQQQQSQQRQQATEAPPSTFL

SEQ ID NO: 116117 - protein, 55 aa, Glycine max
  Coding DNA Sequence Number=SeqID_24432
MAARNERERLLTQALNNLAQVMANQGGGGGATMYHGLDRFQRNNPPTFKGGYDPE

SEQ ID NO: 116118 - protein, 83 aa, Glycine max
  Coding DNA Sequence Number=SeqID_24433
MMITKDDDKGDDKKLKDQSKNNSSESKDKNHEEFKTQEESLESRIKIQGSRSQESRSRFKTQDSRIKRRLNQDKYEKFFSKIE

SEQ ID NO: 116119 - protein, 107 aa, Glycine max
  Coding DNA Sequence Number=SeqID_24434
MHERQSIHGDPNNSGEWRIALGNHYACLQTYGWRMHERQSIHGAPKKSGEWRIALGSHYAWLQTHGWRMHERQSIHGVPNKSVGRTEWSTGFFPPKKANMLSAKKNK

SEQ ID NO: 116120 - protein, 95 aa, Glycine max
  Coding DNA Sequence Number=SeqID_24435
MQNSEVSVDVCRNLPSTGGRCGAHGCVFQGRKVMQSYPPKVSDRRHQEAWARATKEGPRVLMNLRLSSSFSRKFSQRSFSRKFSQESFSRKLPSL

SEQ ID NO: 116121 - protein, 74 aa, Glycine max
  Coding DNA Sequence Number=SeqID_24436
  Subcellular localization annotation: CTP_CleavageSite=24; ConfidenceScore=5.17e-01
MARICSPLKARACSPLKARTCSPVKEMRSSPLNWRTCSPLRGGRAVRLRLMHDAFHCPVGLRYPSLFCFHNPVA

SEQ ID NO: 116122 - protein, 230 aa, Glycine max
  Coding DNA Sequence Number=SeqID_24437
  Gene Ontology: Mol. function=hydrolase activity; Biological process =lipid metabolic process
  Homolog annotation: Hit_ID=A4W694; Match level="QueryCoverage=100%, HitCoverage=66%, E-value=1e-116, Identity=86%"; Hit description =Patatin
MDTAARLFDSGKEFWMCASRGDDYSPGYFSPQKENWLDIIRASSAIPGFYRTGALLDGISYLDGGISDAVPVQEAARRGAKTIVVIRTVPSQMYYTPQWFKRMERWLGDSSLQPLVNIAKQHETTYGAMQRFIEKPPGKLRIFEIYPPKPLLSMALGSRIPALRMDYKTGRLCGRYFLATVGKMLAEQPPLHRHKRIITPPAIVANDALTVPLVDIPQANDALLDNEDLA

SEQ ID NO: 116123 - protein, 380 aa, Glycine max
  Coding DNA Sequence Number=SeqID_24438
ENFEAPEEDEEVRALKLELGKARLAKEKFKSAAIHIQKECTELQEENAATARALEQETKRARKEEYGREKFRGTLWGSNNELKLRREERDRSRVHGMILKEELVACARSKRSLAQHLEATEQSMLAIIGQYKEELNQSVAHEQKLVEDFAQVYAEKEARGRVIDALHQEATMWMDRFALTLNGSQDLPRLLAKAKAMAEADLSALKDQMATISEVMLKLQKTIEDKATATASSTVREAEPVLQPALNPGRERNTTMFGRRYSPQAYPYGLPPDFTPCATPGDLSQAPTFEGQLPPYDDYPGQDDEEGDTHLGPLLHLKDPSPHELPQPNIVRHIPISPTPVKESVPFVEDKGKIEALEERLRAVEGLGNYPFSDLADLCL

SEQ ID NO: 116124 - protein, 104 aa, Glycine max
  Coding DNA Sequence Number=SeqID_24439
DAGSRQARQGASAGVGGCRGWLNYAASEQIVLRVHHMRAIGAGLFAITPAGERGMCCKAIKLGNARVFPVTTLDFKGINPVDQDDLVVVSIIISNFIVSRNLID

SEQ ID NO: 116125 - protein, 213 aa, Glycine max
  Coding DNA Sequence Number=SeqID_24440
MAIYRKKPFWGREGSPKRAGFLGMKLFHGPGEPDASLGELGSRKIQKKRSFCPLPWYLFVLLIKTLSDSLLHTGKFDIPEGSTAKKKVMSTVATKWRQFKSSLTTKYVYANNEGQDKHDPSAKYGLDPENLKQYAKSRQTPNYNDRRSSILDCNTSEVEDGSNKAIWVDDIYSVMQSYPVKALDRRLQEDWARDAGEDLRILMSLRVDFGPMG

SEQ ID NO: 116126 - protein, 152 aa, Glycine max
  Coding DNA Sequence Number=SeqID_24441
  Gene Ontology: Mol. function=metallopeptidase activity
  Homolog annotation: Hit_ID=A6WWX4; Match level="QueryCoverage=100%, HitCoverage=93%, E-value=2e-60, Identity=78%"; Hit description =Putative metalloprotease Oant_0756
  Pfam annotation: Domain name=UPF0054; Domain location=1-143; Score =179.3; E_value=9.9e-51; Accession=PF02130.8; Description =Uncharacterized protein family UPF0054
MVEAGNWPDETALEGLVRKSVEAAWANLGLKSAASELSVVFADDALIQTLNAEWRGKDKPTNVLSFPAFPVKAGAQPGPMLGDIIIARETVEREAREEGKPLENHLAHLVVHGFLHLLGYDHETDAEAEVMEGREREILHALAIPDPYAVSE

SEQ ID NO: 116127 - protein, 164 aa, Glycine max
  Coding DNA Sequence Number=SeqID_24442
MVISLTVHFEFINVAAAQDIAELQRLTLGIAAGLGDVQQRRATRHVEQLGNLVAAGYRLQQKEARRNIGGFQRDRAAVQQAQTPQFDHLIPFRQPQRRRGLGRRADPGAQQPSIADAAAVTQRLSGETAVLIEGIANVHRHAGANALLSQNQPLLLQQFHRLAD

SEQ ID NO: 116128 - protein, 221 aa, Glycine max
  Coding DNA Sequence Number=SeqID_24443
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=65%, E-value=6e-33, Identity=100%"; Hit description=LacZ protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTQVVVGVEVKAVGAVFQGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 116129 - protein, 221 aa, Glycine max
  Coding DNA Sequence Number=SeqID_24444
  Gene Ontology: Mol. function=transporter activity; Cellular component= membrane; Biological process=transport
  Homolog annotation: Hit_ID=A9N1W2; Match level="QueryCoverage=87%, HitCoverage=50%, E-value=5e-75, Identity=70%"; Hit description =Putative uncharacterized protein
MLSGMLLPPQTRPQGELRQGASGGWAAWRDLLRENSVWRFMLCVTLMQGAHAAYYSFSAIWWQEAGYSASVVGYLWSLGVVAEIVIFALSNRLFRRWSARDLLLLSGVCALVRWTLLGASTALPLLIVAQILHCGSFTVCHLAAMRFIAARKGAEVIRLQSLYSALAMGGGIAVMTMVCGVLFTHLHGQLFWVMALVALPGAVPAATRGLRLQQLTNALLL

SEQ ID NO: 116130 - protein, 330 aa, Glycine max
  Coding DNA Sequence Number=SeqID_24445
  Gene Ontology: Mol. function=pantetheine-phosphate adenylyltransferase activity; Cellular component=cytoplasm; Biological process=coenzyme A biosynthetic process
  Homolog annotation: Hit_ID=Q6AFJ7; Match level="QueryCoverage=43%, HitCoverage=90%, E-value=2e-56, Identity=77%"; Hit description =Phosphopantetheine adenylyltransferase
  Pfam annotation: Domain name=CTP_transf_2; Domain location=10-142; Score=52.8; E_value=1.2e-12; Accession=PF01467.17; Description =Cytidylyltransferase
  Pfam annotation: Domain name=DUF177; Domain location=163-312; Score =95.0; E_value=2.3e-25; Accession=PF02620.8; Description =Uncharacterized ACR, COG1399
  Pfam module annotation: Pfam domain module=CTP_transf_2::DUF177; Domain location=10-142::163-312
AGVMSSRIAVVPGSFDPPTLGHLDVIRRAAALYDELHVLVVHNPGKEAMLPIAQRLSLLERSIADDGMEGEIVVGSWSMGLLVDYARDVGAGVLVKGIRSQIDVAYESPMAIVNRHLADIETVFLLPDPSHAMVSSSLVRQVASLGGDVTPPFVLPVRDIVRRPGEMREHEFSVALRETWGEGIVSFEAGTEMDLDIRLESVHEGILVSGTADAEYTGVCGRCLIDISRPVEVEFQELFAYPGEEETDFEVQDDHVDLETLVRDAAVLALPFQPVCQPDCPGLDPKTGERLTMSTGTEQVAPIDPRWSALQNIADQDGGAESHVAEKEES

SEQ ID NO: 116131 - protein, 107 aa, Glycine max
  Coding DNA Sequence Number=SeqID_24446
  Subcellular localization annotation: CTP_CleavageSite=79; ConfidenceScore=5.15e-01
SSLSQTGLRFRDCNHIVEFVSATYRLRLKKSRKGKSPGKDSQGVLLLSPSALSSSLSQTGLRFRDCNHIVELVFVEFVSATYRLRGGGEAIWKSIVVGFKPPREAIE

SEQ ID NO: 116132 - protein, 76 aa, Glycine max
  Coding DNA Sequence Number=SeqID_24447
  Subcellular localization annotation: CTP_CleavageSite=60; ConfidenceScore=5.41e-01
MLATHSGYRATARKPASNCFFTSSFIFKDVSGFILLSFCFTGEHSGFRGPISWSSWATILSNSGGSPTSSFPSSSV

SEQ ID NO: 116133 - protein, 161 aa, Glycine max
  Coding DNA Sequence Number=SeqID_24448
  Homolog annotation: Hit_ID=Q5QJQ3; Match level="QueryCoverage=63%, HitCoverage=81%, E-value=4e-56, Identity=100%"; Hit description =Putative uncharacterized protein
MTDPGLKRKKHRMTPIEHFLIEIGTELEFVIMVIAVSCSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTPVRHDLSALAAGTGNRNSRA

SEQ ID NO: 116134 - protein, 35 aa, Glycine max
  Coding DNA Sequence Number=SeqID_24449
MGHLRLSYFLVGIINMKIQKKVLRKKAQSFKNLGI

SEQ ID NO: 116135 - protein, 82 aa, Glycine max
  Coding DNA Sequence Number=SeqID_24450
MPKSSPNMHVKQELLPGTLTWNLPECILGKTKWLPSLGSVSIMASDRMQLQNMCKKGAQIFQRICPKVEGSGSPSVSLNDEE

SEQ ID NO: 116136 - protein, 184 aa, Glycine max
  Coding DNA Sequence Number=SeqID_24451
KDAITKPDPRHPYHTRSKSRMMGDLEEVQEQMKADMSVLKEQTTSMMEAMLGMKRLMESNAATATAASTVAEADPALPTVAHHPILNIVGQGRSTLGHVSNPHPGYNRGAYHYDLPPNYTPPTMHKDAGHVTPLILEGEPPRHPDRVHEDPREGAQGDVNSYSPFPVEGPAPNTLPQPNITGEP

SEQ ID NO: 116137 - protein, 386 aa, Glycine max
  Coding DNA Sequence Number=SeqID_24452
MLRLISSLVLQEYNKMKPCKVSYQNIKQKMKFGNQELPVLTNEFHYPGREAANDKFNCLIDNIWNIPKNTNNNEQFVCSVKKGIICALYNFCIADNQGVPLLTKASPSGKGYTAFVLLSGPHKGVYTNFKDLCLAKEDIQSPIYKGFYSREEAEKALELNTTDINKIKRSLEPENPTIIINTGQTKTSQKTYKDTVSPNAPGSTNDLNLDNFKKIQSLLFKVHNNQTQIPGLYIGVHAYFNQKFVCINKTPYCQDKTNCPCKIKFLFRKARLDMDQFKSFGYEDLAITAKSLLDYGCLESILIPPSDRFEGFNPSINEAINLIQGRNDGLHCHQDNYLPEQLHCSELSLAMLMKLLPEDHRDYPCLFNDEYESWDVQGNTHTSTAL

SEQ ID NO: 116138 - protein, 275 aa, Glycine max
  Coding DNA Sequence Number=SeqID_24453
  Gene Ontology: Mol. function=RNA-directed DNA polymerase activity; Biological process=regulation of transcription, DNA-dependent
  Homolog annotation: Hit_ID=A5C5U6; Match level="QueryCoverage=94%, HitCoverage=13%, E-value=2e-39, Identity=34%"; Hit description =Putative uncharacterized protein
MEPEYWDKNPFKATAKVFPPGFHYKPIATNKTRKFYEFILIDTNSVSIKHFKDPKDPNLNTHSTIQILKVMQPRHYGSNLNQPKKISAPFDPAGYNYWDYIDAWTNVFWHQNSKFKHSWLIYFKNNTVYNFPNWFLQWWNYFGPIPQIFSEEVQQGFQQFNKLYNSKESRIPADLKYGKTENSKQYPPLQRHAFVKWWSQFDTSKAAPDQVNNWFQSNPEFLKPADQETSLFLNQKSQLAAFLASSKSKESLAQNFKEVLQLLHRKWKRTFQEGS

SEQ ID NO: 116139 - protein, 40 aa, Glycine max
  Coding DNA Sequence Number=SeqID_24454
VVDSDDVGSIDLRKNPLQEGGDDAILPRSGPIIRAMARRL

SEQ ID NO: 116140 - protein, 81 aa, Glycine max
  Coding DNA Sequence Number=SeqID_24455
MSIKTNTIQYKPFHKRYKVGRNDNPPKPRANLVEGDDIIIAVISQTLGLPNTFVLIRVCLPLTLLWGIENNKFILVIQELL

SEQ ID NO: 116141 - protein, 59 aa, Glycine max
  Coding DNA Sequence Number=SeqID_24456
MLNLLIDYENQIASEKKKGTIMVVGKSSKKKGKEKGHWKRHCKKYLDSLKNKKQGTIDN

SEQ ID NO: 116142 - protein, 56 aa, Glycine max
  Coding DNA Sequence Number=SeqID_24457
MVLIAAIAAALTSIIFFMLIMASIIVVICSFMASMSAFIYSCTSSTSPITLALARV

SEQ ID NO: 116143 - protein, 249 aa, Glycine max
  Coding DNA Sequence Number=SeqID_24458
  Homolog annotation: Hit_ID=Q6WAY4; Match level="QueryCoverage=43%, HitCoverage=20%, E-value=5e-08, Identity=32%"; Hit description =Putative uncharacterized protein
MVSIWDLARVEVSMEPIASLAQYYDQPLRCFIFGDSQLSPMVEEFEEILGGRKPYLFSGFYPSLARISKKVQISAQELDRQRQVENGVVGIPIKYLEVKARILADKGEWTPFIPHSHTVDFRGSPLSKCGWPTYMTPSTEDVKKAMQGLFPVLQLSMWGWFHTFFSKKVGPSIRYKDRELRGSSNGIIGGYHKWLRVRTQGLDWLPNLKTVRDDEVKASEESDEVQALKAKLERARVVEEKFKSIAIKV

SEQ ID NO: 116144 - protein, 169 aa, Glycine max
  Coding DNA Sequence Number=SeqID_24459
  Subcellular localization annotation: CTP_CleavageSite=21; ConfidenceScore=5.15e-01
MAMLVHVSSITFILCWIPTVRLFMTGSVWSSFQLSLIFCPNLPGSFKNNFSPKDLSINPPAIEAYISKRDGILKVGSMGSLFPLDFILSPWAKSTRFVIHAEVCSGVSGVFRDGVHAEVRNVFHSVVQWVSRWGSVVAMGLTVEFEHCATSVLTKEFEASFTLCFWVLI

SEQ ID NO: 116145 - protein, 32 aa, Glycine max
  Coding DNA Sequence Number=SeqID_24460
MKKLQAEMLPRRFREQIREDFPSFFLRSSFFN

SEQ ID NO: 116146 - protein, 119 aa, Glycine max
  Coding DNA Sequence Number=SeqID_24461
GREEKETFCKDRTVASILEEESHSSDLLSPDSPSSRESVTQLPEAITMVEEHDQRITLEDYASSSVPQFFTSIARPEVQANNINYPHSLIHLIQGDLFQGLPNEDDGILLVGLLWRLDL

SEQ ID NO: 116147 - protein, 35 aa, Glycine max
  Coding DNA Sequence Number=SeqID_24462
MAQLDQPAEWRRCACGLMCITLRLPRRAVLLDEGS

SEQ ID NO: 116148 - protein, 289 aa, Glycine max
  Coding DNA Sequence Number=SeqID_24463
  Gene Ontology: Mol. function=transporter activity; Cellular component= membrane; Biological process=sulfur metabolic process
  Homolog annotation: Hit_ID=Q7D230; Match level="QueryCoverage=98%, HitCoverage=85%, E-value=1e-145, Identity=90%"; Hit description=ABC transporter, substrate binding protein
  Pfam annotation: Domain name=NMT1; Domain location=44-254; Score =21.3; E_value=5.1e-09; Accession=PF09084.2; Description=NMT1THI5 like
  Pfam annotation: Domain name=OpuAC; Domain location=35-272; Score= -32.8; E_value=0.0011; Accession=PF04069.3; Description=Substrate binding domain of ABC-type glycine betaine transport system
  Pfam annotation: Domain name=SBP_bac_3; Domain location=37-243; Score= -63.3; E_value=0.00086; Accession=PF00497.11; Description=Bacterial extracellular solute-binding proteins, family 3
  Pfam module annotation: Pfam domain module=NMT1::OpuAC::SBP_bac_3; Domain location=44-254::35-272::37-243
  Subcellular localization annotation: CTP_CleavageSite=28; ConfidenceScore=5.21e-01
MSHKNKSKGVPIMKKTWVFAAVAALFSSASAYAETSVTIGMSGWTGFAPLTLAKQAGIFEKNGLKVEIKKIPQASRHLALASGDIQCAATTVETWIAWNANGVKSTQIFQMDKSHGADGIAVRSDVSKITDLKGKTVAASAPGTSPYFFLAWILKENGLTLKDVKVVNLEPGPAAQAFVAGQNDAAMTYEPYLSTVRAAPDKGKILATTLDYPAVMDTFGCTPDFLKANPQAAKALADSYFQALDLIKSDPEKSYETMGADVKQAGEAFAASAKFLEWQDKAANQKFFE

SEQ ID NO: 116149 - protein, 45 aa, Glycine max
  Coding DNA Sequence Number=SeqID_24464
MAAQEHEMELQHLNKNEETDKRKRSIALKASSSMQEVLDLVALIT

SEQ ID NO: 116150 - protein, 108 aa, Glycine max
  Coding DNA Sequence Number=SeqID_24465
MVGYTPSSFTDLVFASKKIEVGLKKKKGKFDHPTRTTEKTGANKEGEDEGETHAVTAIPVRPNFPQPNNIFTQPITNFLLTHPPVSTKAIPKSTTKSVYRTSNDEHHL

SEQ ID NO: 116151 - protein, 131 aa, Glycine max
  Coding DNA Sequence Number=SeqID_24466
MVMGDPISRLSFPCWNICLFAKACLHFSGENTETFSSLTSYPELRRSEFLIGGYVGARASLLSTTPPFVAMTQELVARGDTLRLSAPRHSVTPSVIHEQRPIWSSAPFPEMSAFSDGDFPSLTSYPELRKV

SEQ ID NO: 116152 - protein, 122 aa, Glycine max
  Coding DNA Sequence Number=SeqID_24467
TSHLPCLADTSGQVLITAAVSPAKPPSKPDPEVDDPLYLMTLTIPELFLRPYQSIQRSGQSQFEFESYIKTWMQSSKCEVYLGAYLNGPDNYLKGIINSALKGLDDASQPKSKAPARWIVVK

SEQ ID NO: 116153 - protein, 56 aa, Glycine max
  Coding DNA Sequence Number=SeqID_24468
MENWRTALRNNFAGLQTRRWRTQEQRRMENWRTSATNNFARLLDSKVVGYMNSARE

SEQ ID NO: 116154 - protein, 191 aa, Glycine max
  Coding DNA Sequence Number=SeqID_24469
  Subcellular localization annotation: CTP_CleavageSite=38; ConfidenceScore=5.18e-01
DLTVSIRGARRARARPAELPSTSATPTPASTSAAPSVPAQTDSQRFEAMLQSIHQGQIILLQSLQVVVPPGSIPSVEQFREMVAWPGTQPFLYGEDEGPTSQVPQHVEDESSEATIPKPFVVGEEVGETQVRQVVAATPERSLEATSESPAPVVDLPSSQHKADPSTPILEIPEDPTTPVLTLDTSPPTTP

SEQ ID NO: 116155 - protein, 49 aa, Glycine max
  Coding DNA Sequence Number=SeqID_24470
MAPKTCSLSTSALDRISCIKRLILIKHRPQIPLVGLNSTRTALRQTYYN

SEQ ID NO: 116156 - protein, 124 aa, Glycine max
  Coding DNA Sequence Number=SeqID_24471
  Homolog annotation: Hit_ID=A5AZG1; Match level="QueryCoverage=33%, HitCoverage=12%, E-value=2e-07, Identity=57%"; Hit description =Putative uncharacterized protein
MKREKHASYSSHDSCKSLSEELSDYYRGRHSSHTKHHSQRREKDRRPQEVNISLPYFHGKDNVEAYLDWEMKVEQLFACHHISEERKVPLATLSFQGSSMREFQKGVLDASLKNLSQKQGENHP

SEQ ID NO: 116157 - protein, 44 aa, Glycine max
  Coding DNA Sequence Number=SeqID_24472
EKEGEACHPARPRELSLPRRARLLPLEGTAFWKTSRKAQMGLIT

SEQ ID NO: 116158 - protein, 142 aa, Glycine max
  Coding DNA Sequence Number=SeqID_24473
MGEAEEVQEKMKAENGGHKRANGHNDEGHDEHEEDNGSQCGYSCPLLALSLSTNDPMMCKFKTSTTSCHMACLPNYTPPNVAYIPNEDTHEIPHHNLANFEPWLEYANEGQAVGGIPLENTSEGPQYHHQPQPSCSTAVKPS

SEQ ID NO: 116159 - protein, 112 aa, Glycine max
  Coding DNA Sequence Number=SeqID_24474
MISSSLLVGIGVLKAYVPFSRCDDWRCHFKNKEIHDKLSVAKPSVASYLRQEIQPEQEADRVHGLPAQPPVKFNNMVVISLSMKLKEEHCSIGFLRPLTNQNKNPLTYGSME

SEQ ID NO: 116160 - protein, 168 aa, Glycine max
  Coding DNA Sequence Number=SeqID_24475
MPISPCRCIGWDRAHKSPSGPGEVQQGPGVSSSGIAPARHPVDPKKSNRVLELSSSNYGSLSVLRSTCHLQQRHQALTNRAFIKKVLLLQAGAGRNTTVAWGWSVAGNRHTATTSRVNLSSSAKRLERCLRHMADQQATKSKAKGKQSTRSVTYKPSCVQLKTLKKRY

SEQ ID NO: 116161 - protein, 83 aa, Glycine max
  Coding DNA Sequence Number=SeqID_24476
MKGLFVTKLESNEVLLSPIALKVVGPLLLDSNSSRDGTNHPSNSLYGNPQEGNKETAITKDQKNGMKAKPMEFNRQFFRIIQH

SEQ ID NO: 116162 - protein, 86 aa, Glycine max
  Coding DNA Sequence Number=SeqID_24477
MKLPMCRSKLHDESKLIQRSFDDNKGDDKKLKESKNEFKMFKIESRTFQGSRGNLISRIKNQDSRFKLPRIRINIQDSRFKNQEKN

SEQ ID NO: 116163 - protein, 71 aa, Glycine max
  Coding DNA Sequence Number=SeqID_24478
MAHQRSCHSARQSSLAHKEKLGNSLKTWEEVDEKFLKKYFPESKTAEGKAAISSFHQFPDKSLSEALERFR

SEQ ID NO: 116164 - protein, 68 aa, Glycine max
  Coding DNA Sequence Number=SeqID_24479
MKMLLIPHDVSSIGASEWRRKRERRRHFKEKMSLEEAHHHRRPWIRAWRKKEMNEGRAREEHEILCSK

SEQ ID NO: 116165 - protein, 138 aa, Glycine max
  Coding DNA Sequence Number=SeqID_24480
MVRWMAMENLMLEGTGTQYSDRITYMCGVEDATFSGIRAVRTFRTVCYVLTIFWKAGVAAHDVQRYVKESDWAAQCTRQDKMSNEELKLQDPRCRIQCPGHPARKYWTHKSVISLTDCAGSTMSDTMSRTSCPKILDT

SEQ ID NO: 116166 - protein, 19 aa, Glycine max
  Coding DNA Sequence Number=SeqID_24481
MTLWGSNKVVCHHAKGDRT

SEQ ID NO: 116167 - protein, 209 aa, Glycine max
  Coding DNA Sequence Number=SeqID_24482
  Gene Ontology: Mol. function=farnesyltranstransferase activity; Cellular component=chloroplast; Biological process=isoprenoid biosynthetic process
  Homolog annotation: Hit_ID=Q2VJ74; Match level="QueryCoverage=96%, HitCoverage=67%, E-value=5e-85, Identity=83%"; Hit description =Geranylgeranyl pyrophosphate synthase
  Pfam annotation: Domain name=polyprenyl_synt; Domain location=39-209; Score=90.7; E_value=4.7e-24; Accession=PF00348.8; Description =Polyprenyl synthetase
MTAHVDTTASQESDLLQLHHALQAHLEHLLPAGQQADRVRAAMRAGTLAPGKRIRPLLLLLAARDMGCDVAQQGILDLACAVEMVHAASLILDDIPSMDNARMRRGRPAIHCEYGENVAILAAVALLSRAFEVIALAPGLPATHKAEAIAELSSAVGLQGLVQGQFQDLHDGAHSRSPEAITLTNELKTSVLFRATLQMAAICGRCVSA

SEQ ID NO: 116168 - protein, 289 aa, Glycine max
  Coding DNA Sequence Number=SeqID_24483
  Homolog annotation: Hit_ID=A5ASR8; Match level="QueryCoverage=75%, HitCoverage=46%, E-value=1e-10, Identity=25%"; Hit description =Putative uncharacterized protein
  Subcellular localization annotation: CTP_CleavageSite=41; ConfidenceScore=5.34e-01
MAEPSKKRKGSSSTAATAAHHRHGPSEASTAPIHPSLSSPRSSTLFSSDDQRLQYLSQFSSRIILDPKYLDVEFFNDETFDCYQVFQNSGLVDFMSLKLPHYPELVKVFYCNLKIQDGIISSEVHGIPMIIDQSLFFSLTHLPSQGAPFEGTIVDNWKFDYSSHDARRMVCNDQAEMTGRLLAGSLTFDNRIMHYIIVRILLPWSSNLAQASEEDLILMWAFLTGRQIDWAHLVRYRMHKALRANAPLPYPQLITLFLRHFQIPLDDEPFVQVKRSFAIGAGVVTSFGY

SEQ ID NO: 116169 - protein, 246 aa, Glycine max
  Coding DNA Sequence Number=SeqID_24484
MGEIEEVRERMKADMQALKVQIATMMKVMNSMKKIVEVNTTVVAEVEPTPPFGLNQINHSTLDMVGQGGNELGSMDNPHVVQIQNKHTFLPYGLPPNYTPPNVAHIPDENNSTPISIESQQPQFDHAHVSQPMGETHEVPHHNLADFEPFLRYATEGPAVGDVPLPNTLEGPQFFPQPQSLHFAVGRVPPTMVEREKLDHLEERFRAIAGGGNYAFANLEELFLVPNIVIPPKFKVSYPNFIQGPS

SEQ ID NO: 116170 - protein, 81 aa, Glycine max
  Coding DNA Sequence Number=SeqID_24485
MAKELLQGVATYPSVGGQRETHGQILLISNAGVEVAQQLAWASCLLPPEMNGSGMEKEERQRRRHFKEKMSLEEAHHHRRL

SEQ ID NO: 116171 - protein, 237 aa, Glycine max
  Coding DNA Sequence Number=SeqID_24486
  Homolog annotation: Hit_ID=Q6WAY6; Match level="QueryCoverage=45%, HitCoverage=19%, E-value=2e-12, Identity=35%"; Hit description =Putative uncharacterized protein
WFPRWKEGKEGVLFSCGRYPNIPLVGTRGCINYNPALAIRQLGYPMRGAPTEESMSPFLVRDFGAQNSKTIQRIHKAWETPLKKDQELRGIRNGIIGGYHEWLKVHIRGLDWLAKLKVVSKESFEAPEEDEEVQALKSKLGKAKLAKEKFKLAATHVRKECAGPRGARKEEYGRNKFRGALWGSNSELKLQREERDQSRAHSMVLKEELIACSRSKRSLSQRLCETETNMLAIIAKY

SEQ ID NO: 116172 - protein, 155 aa, Glycine max
  Coding DNA Sequence Number=SeqID_24487
  Homolog annotation: Hit_ID=Q6WAY4; Match level="QueryCoverage=81%, HitCoverage=23%, E-value=2e-11, Identity=33%"; Hit description =Putative uncharacterized protein
MRFYQVMVKSLRTTSLKELGQLMGQLQWQAFHKAYGKIWDLAMVEVSTEAIASLAQYYDQLMRCFTFGDFQLSPMVEEFEEILGCPLGGRKPYLFSGFYPSLARISKIDQISAQELDHRKQAENGLVGIPRKYLEAKARILRSMLFSPIITTRKA

SEQ ID NO: 116173 - protein, 108 aa, Glycine max
  Coding DNA Sequence Number=SeqID_24488
MPPYAKFLKDMLTKKNWYIHSDRIVVEGKALIDLGASINLMPLSMYWGLREIEIMPTRKSLSEELNGYYRGRHSSHTKHHSQRREKDRRPQEVNISLPYFHGKDNVEA

SEQ ID NO: 116174 - protein, 174 aa, Glycine max
  Coding DNA Sequence Number=SeqID_24489
MGEAEEVQEKMKAEMEAMKEQMATMMEAMMSMKKIMEANAVIVAATSAVAKVNPMLPSGLKQMNHPTSNMAHEIPHHNLADFEPCLGYTTEGQAVGGIPLQNTLEGPQCHPQPQPSHSTAVKNPHAMAEMGKRKGSGPLKEVLDFDKYKGTTCPKNHPKMYCRKIRAYAKMRNC

SEQ ID NO: 116175 - protein, 124 aa, Glycine max
  Coding DNA Sequence Number=SeqID_24490
MTLKEYLEAFHLWLVIDYQRLPSTPSSLFKPGNRLHPLVIDYQRLPDLVFKPGNRLHPVELACLGTSQVLTDRLCPGWVGIGQAWFWAIAPHLTSPRSPDPRDISPGGGRAMVHNKFFTSTKRA

SEQ ID NO: 116176 - protein, 80 aa, Glycine max
  Coding DNA Sequence Number=SeqID_24491
MNPKRIKVIPEWLTPPSVEGRSPEYEEPRDLRSNPFQGGGNDAILPRKALGRRLQVDWARDPREGPRVLMSLRVDFEPMG

SEQ ID NO: 116177 - protein, 108 aa, Glycine max
  Coding DNA Sequence Number=SeqID_24492
  Homolog annotation: Hit_ID=A5BYZ7; Match level="QueryCoverage=35%, HitCoverage=23%, E-value=8e-08, Identity=64%"; Hit description =Putative uncharacterized protein
  Pfam annotation: Domain name=zf-C2HC_plant; Domain location=35-89; Score=43.7; E_value=6.4e-10; Accession=PF07567.3; Description =Protein of unknown function, DUF1544
MSGSGSNSSGGDTITSGSSSVARSKYKNAPGNKTDIGWEHGIDVDGNVKKVKCKYCSKIASGGVFRFKRHLVGTRKDSEPYATVNKGVFVQKEKKVVQVMGVAVFKQL

SEQ ID NO: 116178 - protein, 72 aa, Glycine max
  Coding DNA Sequence Number=SeqID_24493
MTQELEARGDTLRLSAPRHSVTPSVIDEQRPMWSFCALSEMSEFLIGGYVGGRASLLSATLTSSVMLGTGVT

SEQ ID NO: 116179 - protein, 101 aa, Glycine max
  Coding DNA Sequence Number=SeqID_24494
MARKSPVVAILAMYDTFDRGCEKSGARIVCCALGSLCVAGFTPFSPRRKDRELRGSSNGIIGGYHKWLRVRTQGLDWLPNLKTVRDDEVKASEESDEVQAL

SEQ ID NO: 116180 - protein, 66 aa, Glycine max
  Coding DNA Sequence Number=SeqID_24495
MGVSLAARKHPVLTTLRDTKAQIPHPTKSLTRERENSHYRWKASRAVSAVGTGFPKSQPRAGVGIE

SEQ ID NO: 116181 - protein, 46 aa, Glycine max
  Coding DNA Sequence Number=SeqID_24496
GPCAVNPLRAVVRRKVVPAKLSGRGDLDPPTRVLYGYAGRGAPRCV

SEQ ID NO: 116182 - protein, 75 aa, Glycine max
  Coding DNA Sequence Number=SeqID_24497
MSINEKGFIWLEQALGLESSEKIHIHGQDSKGKGKGSNEDPQEKQNQMMNFQKNGKPQKIIHSSIIAKISHKGEN

SEQ ID NO: 116183 - protein, 239 aa, Glycine max
  Coding DNA Sequence Number=SeqID_24498
  Gene Ontology: Mol. function=phosphoribosylaminoimidazolesuccinocarbox amide synthase activity; Cellular component=cytoplasm; Biological process=purine nucleotide biosynthetic process
  Homolog annotation: Hit_ID=A4VN84; Match level="QueryCoverage=97%, HitCoverage=79%, E-value=1e-81, Identity=62%"; Hit description =Phosphoribosylaminoimidazole-succinocarboxamidesynthase
  Pfam annotation: Domain name=SAICAR_synt; Domain location=1-216; Score=244.8; E_value=1.9e-70; Accession=PF01259.9; Description =SAICAR synthetase
MANFWFEQLQDVVPNHLTGIAPESVVAPDEVEQVKGRAVVVKKLKALPLEAIVRGYLVGSGWKEYTAKGTVCDIPLPAGLQLAQQLPKPLFTPSSKAAVGEHDENISVAQVEALIGKDLTTQVEKAAIALYTRAAEYARTKGIIIADTKFEFGVDDQGVLHVMDEVLTPDSSRFWPADQYQIGSNPPSYDKQYVRDWLESCGWNKTPPGPELPADVAQRTSDKYMEAFAKLTGRTLLAE

SEQ ID NO: 116184 - protein, 64 aa, Glycine max
  Coding DNA Sequence Number=SeqID_24499
MNSKRKGEKEMSERIVIIKKGEIVEAMTSKIILMMPKNQELSKFQIIRSQKASRIKFQRIKIQE

SEQ ID NO: 116185 - protein, 143 aa, Glycine max
  Coding DNA Sequence Number=SeqID_24500
ARQRSVEWPGVFPWYAQVASGSYHFGKGGCWPRGKVPYRLEPAPKWALPAGRVGVGAGTWGASLWMGVGALACMGAELGESPARAEKLGCSDPPSVGTCGGDIIELPSLQTYFNSFPGEYQVREAGRHGPLVLPGPSTAERTL

SEQ ID NO: 116186 - protein, 70 aa, Glycine max
  Coding DNA Sequence Number=SeqID_24501
MARCGRDQNRDVLDRITAVLETLVEERDVEPAEYQGLMAFPLRTEKIFEAMGCLEEHKGPLCDIMLQGGG

SEQ ID NO: 116187 - protein, 348 aa, Glycine max
  Coding DNA Sequence Number=SeqID_24502
  Subcellular localization annotation: CTP_CleavageSite=38; ConfidenceScore=5.61e-01
MAESSKKRKVSSTSTAAHRTSRPGATGASQAPIPPSLSSSTLFSSYEQRIRNSSIFQSHQILDPKYLDLEFFDGETFDCYQVFQNTGLIPFMSLKLPYPELVRVFYSNLKIQDGTLIFEVHGIPMIIDESLFFSLTQLPSQGAPFEGTLVDQWKFDYSSHDARRMVCIDQADMANRLLVGSLTFDCRIMHYIIVRILMPCSSNLAQASEEDLILMWDFLTGHPIEWAHLIHYCMHKALRSSAPLPYPQLPFVQVKRSFAIGAGAVTSFGYRKDMDGQWLKKDAKPPQDECTPSPPPQRDDSSTLMFFRSYEASTPMLVNALIPWMVVYMPLMLALKEWIPASLSLRRM

SEQ ID NO: 116188 - protein, 100 aa, Glycine max
  Coding DNA Sequence Number=SeqID_24503
  Homolog annotation: Hit_ID=A7PQI8; Match level="QueryCoverage=100%, HitCoverage=19%, E-value=7e-12, Identity=41%"; Hit description =Chromosome chr6 scaffold_25, whole genome shotgun sequence
MGGSHEDTSAVASTVLFVSGMTTRCIQVLGREIQTYNEGAAGDYNYWIDFSNFSWIFGTYVTVSKVDQSCGCIPTIAAVGLSFYSYGFPLVGTCLEIGAV

SEQ ID NO: 116189 - protein, 62 aa, Glycine max
  Coding DNA Sequence Number=SeqID_24504
MSSHEENACTSHQCLFKENARKTKTRSANFENKGSGVVYAWGRFILVANKEPFKALDLETMF

SEQ ID NO: 116190 - protein, 146 aa, Glycine max
  Coding DNA Sequence Number=SeqID_24505
RIEPAPTLTEKNHVDQAQGQIQVFLDNPKRRQGPHSTYLSHIFTGLGFGVANLELPILYFDLLSNLNSAINEDTKIERVDRILMIFWVNYPSGSMIVKSLDASTHIKDKEGSMSYEVVVECSSVMNEMVSDDEGEMMGAGVTNLEE

SEQ ID NO: 116191 - protein, 176 aa, Glycine max
  Coding DNA Sequence Number=SeqID_24506
  Subcellular localization annotation: CTP_CleavageSite=54; ConfidenceScore=5.04e-01
MSFILWLAKRNWLLTLDKAAFLNKGNLSKFGLTFVIWLLSAGLLVLGRLLIFFSCGRLMSIESSSPVLASHGCLRKRSVGDFDCHREEAKNNVMLAPLLGSVIELSDSDTNEDEGHDLDSAVTYAVNSASSLVESPSKKRRTSEARGVVFPVGFVTPLPSALTPPPTLVLSLLAME

SEQ ID NO: 116192 - protein, 248 aa, Glycine max
  Coding DNA Sequence Number=SeqID_24507
  Homolog annotation: Hit_ID=Q5XM22; Match level="QueryCoverage=34%, HitCoverage=48%, E-value=2e-21, Identity=59%"; Hit description =Resistance-like protein HAAS-2
  Subcellular localization annotation: CTP_CleavageSite=87; ConfidenceScore=5.27e-01
MTHSYESLPFSIALMLRLLPLVVPLLLLSSSFFFATSHARWCLFLTHIVVSSLAHRFYFVFFAFASSSSLLLGERPELKLSSHARKMAMFGRPTPEIEGLMAANGLKVTITLDDIALLLHLPIVGAFHSFEQLHVDDAVDMLVELLEVNVADARAETIQYHGSYVRLWWMRDVYQTKIEACHWIVAARAYLLHLIGCTLFANKSATHVHVVFLDAPCDLTQSVTYAWGATSLVHMYDNLNETSKSMTR

SEQ ID NO: 116193 - protein, 238 aa, Glycine max
  Coding DNA Sequence Number=SeqID_24508
  Gene Ontology: Mol. function=DNA binding; Cellular component=nucleus; Biological process=regulation of transcription, DNA-dependent
  Homolog annotation: Hit_ID=Q5JMM1; Match level="QueryCoverage=31%, HitCoverage=11%, E-value=1e-09, Identity=43%"; Hit description=Auxin response factor 3
MDASGFAMGIVLLQKGHPLSYFSRYSPPPPSSHSIKRRRFHDSIILRKQNKKQQQQQHEFTSFQQLHHHRPLHPGTPHRLRQPKLPQAHGLLPPRSPGLARSHLLGPINIPKICTASEKGMRVRSKGFRVRVLSEGSVRGFVGGDDRICSLEQLLEPDVRALWDAELEREESCEASDDEKRSVVTAMDCIFSVLTHYGEATGRLDYKQQRPSKELVAKDLHGVEWKFHHIYRGFTYYV

SEQ ID NO: 116194 - protein, 238 aa, Glycine max
  Coding DNA Sequence Number=SeqID_24509
  Gene Ontology: Mol. function=catalytic activity; Biological process =trehalose biosynthetic process
  Homolog annotation: Hit_ID=A7NV04; Match level="QueryCoverage=29%, HitCoverage=19%, E-value=2e-27, Identity=85%"; Hit description =Chromosome chr18 scaffold_1, whole genome shotgun sequence
  Pfam annotation: Domain name=Trehalose_PPase; Domain location=70-238; Score=-63.7; E_value=0.011; Accession=PF02358.7; Description =Trehalose-phosphatase
MGCKLALEDKTRVAFRRRQRHEHVDASRHAKPCNCSSLASQQQKATMQNLSSSTEVGFVNSLAFAKSGEFLVAGVGHVKIFSNCVLLTVVLKVGMSCQGCAGAVNRILGKMEDSSSTCTWVLSSFNSNILTPTINYGCHLHSSNTGITDIALLSSRIKSEKALAEKVRLVLNEYPQLRLTQGRKVLEICLTIKWDNGKALEFLLESLGYENSNDVFPIYIGDDRTDEDAFRLTNAATP

SEQ ID NO: 116195 - protein, 327 aa, Glycine max
  Coding DNA Sequence Number=SeqID_24510
  Subcellular localization annotation: CTP_CleavageSite=63; ConfidenceScore=5.50e-01
MTSKKKKKKHCHSAIFQSTSRTHRGTKNTLVPTKHHKRNSISGRGVPPSPKNMKCQILPLRVSFSSEAGLLATVSQSQQHYGKQFVRSESLDRNSSDFRSSNNSSRSSSLRSQNSSTSSVTAATATTTTTIPKSKPRIRNQFHTHPSPKPQLRASAPTHNQGRKSTSAWGIFRLGVVAAPEIGLHDLKVRNRNCVVSRNSSSSSSNSAKSVKTSNRNNKKGNHKVLKQLVGKGGGLLSGCDCSYETVQPNNMVMIKGGNGNAKRTNMTESTAHAAKEKVVELKKHHKHKQQKQGKKVTSRRRTFEWIKELHASHPDDDDEEALLSNA

SEQ ID NO: 116196 - protein, 183 aa, Glycine max
  Coding DNA Sequence Number=SeqID_24511
  Homolog annotation: Hit_ID=Q6WAY4; Match level="QueryCoverage=89%, HitCoverage=29%, E-value=5e-20, Identity=35%"; Hit description =Putative uncharacterized protein
MGTNQTGKRFYQVEIKGLDITSIKELGRLMGPLQMQAFRKAYGKILDLTIAETSTEAIASLTQYYDQPLRCFTFGDFQLVPTVEEFEEILGCPLGGRKPYLFSGFLPSLSKIAIVVRDSVRGLDRVKQTRNGIVGLPRKYLEGKARDMMNQEEWVPFMDVLALLIFGVVLFPNVDGLVDLAAN

SEQ ID NO: 116197 - protein, 90 aa, Glycine max
  Coding DNA Sequence Number=SeqID_24512
  Pfam annotation: Domain name=zf-BED; Domain location=13-57; Score =42.3; E_value=1.7e-09; Accession=PF02892.6; Description=BED zinc finger
MLPPHSSVGKTQSNVWDHFTEEPGPNLEKKARSNYCEGLIKFENGTTAMWNHLDRCKKRVGNMSKKQISTSSMKNASFPSLPKKLYLHRT

SEQ ID NO: 116198 - protein, 138 aa, Glycine max
  Coding DNA Sequence Number=SeqID_24513
  Homolog annotation: Hit_ID=A7P464; Match level="QueryCoverage=62%, HitCoverage=10%, E-value=3e-19, Identity=55%"; Hit description =Chromosome chr1 scaffold_5, whole genome shotgun sequence
MECGSANVVTDLLHANADVTATVECLMPLAIRVRSLHTVKLLEAFDCKIDELVLHKIVDIGETLSLFMELQTLGDRTLKKLAFNHVVHSIRCMNQKHKNEAKNKVCQSFAFNIIYDILRKKAKELAKKALVTLCELHS

SEQ ID NO: 116199 - protein, 146 aa, Glycine max
  Coding DNA Sequence Number=SeqID_24514
  Gene Ontology: Mol. function=oxidoreductase activity; Biological process=metabolic process
  Homolog annotation: Hit_ID=A7PLH2; Match level="QueryCoverage=89%, HitCoverage=40%, E-value=5e-31, Identity=49%"; Hit description =Chromosome chr7 scaffold_20, whole genome shotgun sequence
MVLEEGRVLEADSMAHSIVLEAREPGSITLHALFLSYYSSKRGKSLDPEVYPPHTGEVYICGMSKEKEVSDNREEIKGNPELIVMLKKVVKTVSSHLREGVAWHNWDNILNGPATGVVAELVIDGHSNIVNLKRFSPTRFLGRRKA

SEQ ID NO: 116200 - protein, 88 aa, Glycine max
  Coding DNA Sequence Number=SeqID_24515
MFLGYLEEIKGYGLWFLESCHWRCIISHDVVFNETHMAYKTNYDLIAFSLIVASEVLEDEPTSFKATLASKENDKWQTTMDKEMKSLY

SEQ ID NO: 116201 - protein, 133 aa, Glycine max
  Coding DNA Sequence Number=SeqID_24516
  Homolog annotation: Hit_ID=A5BSR3; Match level="QueryCoverage=60%, HitCoverage=25%, E-value=9e-12, Identity=46%"; Hit description =Putative uncharacterized protein
DVRKKAQAIQKQNTAPHVLSGGGYEYLEQKLLAEKTKKKLEEAAQSGSVDGVINPPSLVRRHVKWKMAHTKKIGEMTTEAAKEIAEKIDSFEEQATQGSFVPHGHQDVLTAAIGCPKHPGRVRATGASVTIKQ

SEQ ID NO: 116202 - protein, 261 aa, Glycine max
  Coding DNA Sequence Number=SeqID_24517
  Homolog annotation: Hit_ID=A4Q7P0; Match level="QueryCoverage=46%, HitCoverage=99%, E-value=7e-37, Identity=65%"; Hit description =Putative uncharacterized protein
  Pfam annotation: Domain name=DUF581; Domain location=59-117; Score =70.2; E_value=6.9e-18; Accession=PF04570.5; Description=Protein of unknown function (DUF581)
MLPKFIISPFRVESQEGKHVNKRRKHVRSFESTNMDVGLRLLPQITSSNNTSNVLLKSAVRKANQQSIPQDLCFLKTCNLCNKQLTPNKDIYMYSRDQGFCSVECWNRQIVLDEMRELESSTKKMVAAYRQCSSEARSPTTTKFDEQSQEEEKIKSRFHGEEKKLRLIIENNHFYSDKLGQIEEQMQRRPQGEEKSSGKLIINDFMMDQIVVNQLSEFEEQMPSTFHSEGITTQKISVNHMISPTKGDQIEPGSRRGDKLY

SEQ ID NO: 116203 - protein, 223 aa, Glycine max
  Coding DNA Sequence Number=SeqID_24518
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=90%, HitCoverage=26%, E-value=7e-98, Identity=79%"; Hit description =Lipoxygenase-4
  Pfam annotation: Domain name=Lipoxygenase; Domain location=1-223; Score=-91.2; E_value=2.1e-14; Accession=PF00305.10; Description =Lipoxygenase
MSGIGKGVGGGVAVKDPSAPLGVRLLIEDYPYASDGLEIWDAIKSWVEEYVSFYYKSDEELQKDPELQAWWKELVEVGHGDLKDKPWWQKMQTREELYPYGGLILNRPTISRRFMPEKGFPKYDVLAKNPENEFLKTITGKKETHTDLTVIEILSRHASDEFYLGQRDGGDYWTSDAGPLEAFKRFGKNLEEIEKKLIEKNNDETLRNCYGPAKMPYIFSLSF

SEQ ID NO: 116204 - protein, 132 aa, Glycine max
  Coding DNA Sequence Number=SeqID_24519
  Subcellular localization annotation: CTP_CleavageSite=44; ConfidenceScore=5.65e-01
MATPPASPPPPLPPPPADASATPSTLKRTRKVTWLRSLATRPPRAERPVVNIDPATSKADGPHKKKLRTYLGIVARDKVDVTYDTWKEVPTAQKDLIWEDIQNLKSLKLLTVGQRRKFFKLSTSAGGSLDLT

SEQ ID NO: 116205 - protein, 201 aa, Glycine max
  Coding DNA Sequence Number=SeqID_24520
MSNSPYGSISWDRTHKTPSGPEGVQQGPGVFSSGYGPLPVLQGTRPPQQAHAIGSCPQDTQWTRRSPTGPWGFQLWLRASVSPTGCPSPPVRDRACKTPVDPEKSNRVLRFPALIMGLCQFYGVPVAPNKVIRPHINQAFIKKYCAPRQAQGETPQQPRDGRQRAIDTPPPPPEPLNSSTKAGALPTTHDRPAGDQFQSQR

SEQ ID NO: 116206 - protein, 87 aa, Glycine max
  Coding DNA Sequence Number=SeqID_24521
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=P56760; Match level="QueryCoverage=58%, HitCoverage=87%, E-value=8e-13, Identity=61%"; Hit description=ATP synthase C chain
  Pfam annotation: Domain name=ATP-synt_C; Domain location=34-83; Score= 22.7; E_value=0.00011; Accession=PF00137.12; Description=ATP synthase subunit C
MTILRRFDLPLQWNDIVLNTSIGDKYIVQPWYQFPFIPAGLAIGPASIGPRVGQGTTVGQAVEGIARQPEAEGKIRVLALLFANPFV

SEQ ID NO: 116207 - protein, 46 aa, Glycine max
  Coding DNA Sequence Number=SeqID_24522
MNAHLPLLNAVNTHEARQGSVVSGGCGQSATQRVVVVVMDEVGQRG

SEQ ID NO: 116208 - protein, 178 aa, Glycine max
  Coding DNA Sequence Number=SeqID_24523
MGAKMFLSQYDQTLLLKLNNPSYFSFFFTLSKWCDLVIPTLFDLGLVSTDYHVGSSIGLDLVRSTSQGVLLGAPSNNASTSSSFVGVPFEPFHRYSVPPLPNSRNCPPPSCHFRRREPWGEKIIVIQMMLLNGEGPQHPHVVAEDAPHVDDATEEVFQHPEEAGVDAQGFLGGLRDTS

SEQ ID NO: 116209 - protein, 395 aa, Glycine max
  Coding DNA Sequence Number=SeqID_24524
MASKKLSAKRSRRDAAAEGTNAAPEFDSHRFRSVEHQQRFKAIKGWSFHRERRVQLKDNEYTNFQEEIARRHWMSLVTPMAKFDLDIVLEFYANAWPTEEGVWDMRSWVRGQWIPFDADALSQFLGDLLVMEESQKCEFSQRRNRADGFDEEAIAQLLCTPGQDFSRTATGRRVRIMRTSMTTLTRMWMILLLSNVLPSDHNSDLPLPKCQLVYAILTRMNVHVAQLIADAIYLFVALIRGLCQSFGVPITPSKVIRPPIIQAFIEKYCTPRQAQGDAPQAADAPPPPHQADPVGSLGMEQYLQHLVRQQAANHRGQVRIHECLYQLSLSQQGQGFAPFACPTPDQFRAEVAWPGDWPEAQAKEAPAGAPGDAEEACMDEEMTNLLGFLGGSGAT

SEQ ID NO: 116210 - protein, 181 aa, Glycine max
  Coding DNA Sequence Number=SeqID_24525
MKRTFYLELVKVFCTRARVNLEGDLFFTVNGVEMVIDVVMWKEVAGLDMGGVCKFNETPDRYNKMQTYKGILLDLARNLRNCVGVGGLIEEDKILVYLITYILTLRSSNHAQSHRLVDYEFPYDVLASRFIDYFNVDVSNDIVYFTKTSSEITKRHLKKLEMRFVNHEWIMAEEPEARNIE

SEQ ID NO: 116211 - protein, 353 aa, Glycine max
  Coding DNA Sequence Number=SeqID_24526
  Homolog annotation: Hit_ID=A5AHQ6; Match level="QueryCoverage=87%, HitCoverage=32%, E-value=1e-10, Identity=21%"; Hit description =Putative uncharacterized protein
  Subcellular localization annotation: CTP_CleavageSite=32; ConfidenceScore=5.16e-01
GSSSTTAAAAHRRRGPSEAPTAPIHPSLSSPRSSTLFSLDDQRLRYLSQFSSRIILDPKYLDIDFFDDETFDCYQVFQNSRLIDFMSLKFPYYLELVKVFYSNLKIQDGIISSKVHGISMIIDQSLFFSLTKLPSQGAPFDGTIVDDWKFDYSSHDARRMVCNDQAEMTGRLLARSLTFDYRIMHYIIVRILLPRSSNLAQASKEDLILMWDFLTGHQIDWAHLVRYRMHKALRANAPLPYPQLVTLFLRHFQFPLDDEPFVQVKRSFAIGAGAVTSFGYRKDRNGQWLKKDALPTQDERTPSPPPQRDDSALMTKVLSELRGLRTYVGERFDSLDGPFARMDIRLTQFEEDV

SEQ ID NO: 116212 - protein, 72 aa, Glycine max
  Coding DNA Sequence Number=SeqID_24527
  Gene Ontology: Mol. function=peptidase activity
  Homolog annotation: Hit_ID=A5C4D7; Match level="QueryCoverage=87%, HitCoverage=11%, E-value=2e-10, Identity=39%"; Hit description =Putative uncharacterized protein
MASSNFLFPEENSINRPPIFNVVGYHYWKTRMQIFIEAIDLNIWEAIEISPYIPTMVAGNATIEKPREQWDE

SEQ ID NO: 116213 - protein, 68 aa, Glycine max
  Coding DNA Sequence Number=SeqID_24528
MDDIKKAYRSMALQYHHDVCHDPSMKEDSTRIWESRFHEQVIELKTRSHRHMGQKDGSSGSKMRAQKH

SEQ ID NO: 116214 - protein, 90 aa, Glycine max
  Coding DNA Sequence Number=SeqID_24529
MYRHWQQRHEGGIAIGISDWRDMLSHLMSPLVLAGHANVGSPVIGACGTRRGCFFAVFQSEKRWVGLQGVAVYSLKKIGLGFAENVACER

SEQ ID NO: 116215 - protein, 60 aa, Glycine max
  Coding DNA Sequence Number=SeqID_24530
  Gene Ontology: Cellular component=endoplasmic reticulum
  Homolog annotation: Hit_ID=P93042; Match level="QueryCoverage=58%, HitCoverage=4%, E-value=1e-10, Identity=85%"; Hit description=Root hair defective 3
MCGARSQTTKGIWIAKCAGIEPSTIAMDLEGTHGRERGEFGDLLVILASFRASNKKDLIV

SEQ ID NO: 116216 - protein, 108 aa, Glycine max
  Coding DNA Sequence Number=SeqID_24531
MRSLMRYSGFAGIKQLDSTIEDAISGGKSGSMNSQNNGTHQSSQWTSSTHLVRRVKEQAEHWAIEVTLKNYNLEHLSEAATHTPSPTTHQPWLAYQNQLLAIIFLLSH

SEQ ID NO: 116217 - protein, 69 aa, Glycine max
  Coding DNA Sequence Number=SeqID_24532
  Gene Ontology: Mol. function=protein serine/threonine kinase activity; Cellular component=plasma membrane; Biological process =protein amino acid phosphorylation
  Homolog annotation: Hit_ID=A8BLP6; Match level="QueryCoverage=98%, HitCoverage=55%, E-value=6e-15, Identity=52%"; Hit description =Kinase-like protein
MVLSKIRHRHLAMKGSRRYWLGICIGAAKGLHYLHKGVVVRGIIHHDVKSSNLLLDENHVAKVADFGLW

SEQ ID NO: 116218 - protein, 190 aa, Glycine max
  Coding DNA Sequence Number=SeqID_24533
  Subcellular localization annotation: CTP_CleavageSite=45; ConfidenceScore=5.35e-01
MVRKPRKIQKLSSPSHVAFLLPFSSTIVAQQSSKLCSPFLLQIAKGSHFRSREAHLYVMGLQISGFYDDALRYLCAEIADGKLVDMKGKVENCEILRVRETKFGVSVNWGLKKLLLKCAAEFCAGAENAYALLVMGKLGRVDGDPVLRETRIRATWGYVSSVEGGQLVVVGSCLICGCGRVHLHHRPIAT

SEQ ID NO: 116219 - protein, 348 aa, Glycine max
  Coding DNA Sequence Number=SeqID_24534
MNELVRGVEVIGVEGNKNGHIQNDEVDVGDSRKDTFPPVTIPGYEWVSREVNSYCTCFQTPDSIATFKKEVDMTIYDDFESLVVEHCTSDDRVFLKASKIMKGYDYKSLRAFVTNDQANPPLGGSDFIGDDIVGGGKLVPQHHIIDFTEKEQEKIKEQAKEKEEEDRTNKVILHYYQGKLCRLDHVLVAPNIISLWNAELIAVIWHWKEIVATADERIKLMSELLKIMKVEVSKIEQLGVALAKITTLEKSVMDAKTKLEELSLELVVEQNKSKTIEDEKKIDEDNLTSANEELANLTKVMENLESKLQNKYKIKSDLDTKLEERISTCYDEEEEEEKKNEADSKVAN

SEQ ID NO: 116220 - protein, 26 aa, Glycine max
  Coding DNA Sequence Number=SeqID_24535
MRNGLQIQKRTLHQTYSEGRSFEVIG

SEQ ID NO: 116221 - protein, 196 aa, Glycine max
  Coding DNA Sequence Number=SeqID_24536
  Gene Ontology: Mol. function=nucleic acid binding; Biological process= DNA integration
  Homolog annotation: Hit_ID=A5APL5; Match level="QueryCoverage=52%, HitCoverage=25%, E-value=4e-10, Identity=34%"; Hit description =Putative uncharacterized protein
MASVPSNLISQSFPNSIAEKLNDSNYLHWQQYVQPVLKLHKLQRFFVNPVVLPRYLTEDDCIADRINPEYETWEVQDQTLLVWLQSTLSKSVLSRVLGSNHSYQSKKHTLSIAEIDALLHGHETMLTMRSQTLTKTVIPVALEACMTVAVVAVPFLIEILDVVAVVLAEAVEVADLPIFSAKSVLSMGTMLMSVIS

SEQ ID NO: 116222 - protein, 199 aa, Glycine max
  Coding DNA Sequence Number=SeqID_24537
MERSMIDAASGGVLGDMTPAEARNLIEKMVSNSQQFSARNDVIVIRGVHEVATNSSSLAETKKLEGKLDALVNLVTQLALNQKSLPVARLCGLCSSADHHTNLCPSVQQSGAIEQPEAYAAKIYNRPPQPQQQNQPQQNNYDLSSNRYNPRWRNHPNLRWSSPQQQQQQSAPSFQNVAGPSRPYVPPPMQQQQQQKQHQ

SEQ ID NO: 116223 - protein, 56 aa, Glycine max
  Coding DNA Sequence Number=SeqID_24538
MEFFLIIYPLDIDIGFVIIKKGEIVEARLQEDVLMMPKEHTSQVLFKTRIHEIQDI

SEQ ID NO: 116224 - protein, 261 aa, Glycine max
  Coding DNA Sequence Number=SeqID_24539
MGSFLKFFQEGAVFYVICMHAPRKPPVELASLLSVNESPVAMAILPCIGNRQSNWRVPLAGVANGIGELGVGGATSISDLVLSGKYVALQICDDEDVETMLESFQQQDQMLVLELYIEKDVAGGSMFHSANSLTSCGNNLSNNEAQPPRNVSNLHGDDDDDDDYLVSNSYVEESVDEDDSIDGVQGIQNPFWNDALHYNNINWSHPDEEDICGLKMPSSFNVGQELYVGMDFDSKDVVKNAVKQYVMKVHQSFKVVESKWN

SEQ ID NO: 116225 - protein, 307 aa, Glycine max
  Coding DNA Sequence Number=SeqID_24540
MPFRTYEKVWTVLEGKTNDQSEQRAISRSFLPLPCFLGCDSVCCLNVVLPGCWGKLGRIDGDPVLRETRIWATWEYVSSVGGGQQGMETLGTSGGVLLPKTKLDQSRPNPGIEARGASGNQLPGDVIDYQASKGTGALWRPLIVMVAQLIHDRVEMECLEGAWETLEGNTRCRFRGTIRFTETSLVHPDEPVRTLQRTVEWILPTPTPYRLVEPVQVIEVTSSEEDPEEDPEELPPEPVVDALDFLEGDEDPEVDSPEEVMSASEADSTEDSGPREMATSGGSSSYNIPSISCWQQHNILPAEPTIG

SEQ ID NO: 116226 - protein, 113 aa, Glycine max
  Coding DNA Sequence Number=SeqID_24541
  Gene Ontology: Mol. function=pyruvate kinase activity; Cellular component=mitochondrion; Biological process=glycolysis
  Homolog annotation: Hit_ID=A9P7U5; Match level="QueryCoverage=80%, HitCoverage=17%, E-value=1e-39, Identity=89%"; Hit description =Putative uncharacterized protein
MMRIPAEMLINCHLLDSMTTRVVDSMTDNLRPTRAEATNVANAILDGSDAILLGAETLCGLYPVETISTIGKICAEVEKVFNQDLYFKKTVKYVGEPMIHLESIASSEHLLTG

SEQ ID NO: 116227 - protein, 140 aa, Glycine max
  Coding DNA Sequence Number=SeqID_24542
  Gene Ontology: Mol. function=hydrolase activity, hydrolyzing O -glycosyl compounds; Biological process=carbohydrate metabolic process
  Homolog annotation: Hit_ID=A7QJH2; Match level="QueryCoverage=63%, HitCoverage=11%, E-value=3e-36, Identity=68%"; Hit description =Chromosome chr8 scaffold_106, whole genome shotgun sequence
MRKEKIPHQAPFAIQAAQLLGRAIGAGLFAITPAGERGMCCKAIKLESIGRLPIVGMQGRTDVVRHIWDELRTYDVPVSAFWLQDWGGQRETLIGSQLWWNWEVDAQRYWGWKELIKDLSSQNIKVMTYCNPCLALVIHP

SEQ ID NO: 116228 - protein, 154 aa, Glycine max
  Coding DNA Sequence Number=SeqID_24543
MVGLNFLSPADIPELKFINAVTVSNALDIMLQIIIGNDRNLGLECVAVCGSIQSKPFQVFWLRISARSPSWTLSVFRVISSMNCNAFAFSSSQLAMAMAQCKKWMSMKHDTLDYLMGGCVVADMWAQICRHVSKSFLVGEPQGHSVVGCVGMRK

SEQ ID NO: 116229 - protein, 319 aa, Glycine max
  Coding DNA Sequence Number=SeqID_24544
  Gene Ontology: Mol. function=nucleic acid binding; Cellular component= intracellular; Biological process=protein amino acid glycosylation
  Homolog annotation: Hit_ID=A7PDG3; Match level="QueryCoverage=52%, HitCoverage=32%, E-value=7e-33, Identity=46%"; Hit description =Chromosome chr17 scaffold_12, whole genome shotgun sequence
MCQNRWLYERLSQSWRLSGEYHFSDKQKKHKRSTVGLLDKVFSLRRVSTPHGEPNKVAKTVVKKEKKHSSWLIICKQKKASIFHIKAAGARTYKKGGTEFILEKEIHERPVHGIRSKVVARKAPHKDLPNYAQHIVPIFCLPQEWLWCESWCGNATKYKAKTIDLCNNPMTKEPKLQLGGHRASHKKIKGCFASRNESSESSECVVEHQHGASFHNEVETVNESKKSKGHECPICLKVFPCGQALGGHKRSHMVGGSKSRSFQTIVLQEPVAEIRDFLDLNLLAATKEESNSHADSNSNRPWWIVEDNHKQEALVGLIS

SEQ ID NO: 116230 - protein, 75 aa, Glycine max
  Coding DNA Sequence Number=SeqID_24545
MIRRGLCRNRCKLSNIRRIEMTGNIGGMSLSGNGRKLKRNGGGSGLTERSGSLKQVSIGKLGLIENDILGDINSA

SEQ ID NO: 116231 - protein, 160 aa, Glycine max
  Coding DNA Sequence Number=SeqID_24546
MWAFHKGLQIDWAHLVRYRMHKALRLNAPLPYPHLITLFLQHFNIPLDSEPYVPIKRSFLIGVSGIASFGYIKEHDGSWVKKSARNVGEEGPEGEDSSLLSKILERFDGLQTFVGERFDTLELQVDMRFNEMESRMTKVEEDVSYIQSSFDLPPPPPPSS

SEQ ID NO: 116232 - protein, 48 aa, Glycine max
  Coding DNA Sequence Number=SeqID_24547
MVAEFQLVLEQMDVKTSFLYGKLDEVILMKQPEGFEVRAIPQAIEYEI

SEQ ID NO: 116233 - protein, 148 aa, Glycine max
  Coding DNA Sequence Number=SeqID_24548
  Homolog annotation: Hit_ID=A5BEV8; Match level="QueryCoverage=76%, HitCoverage=14%, E-value=5e-13, Identity=38%"; Hit description =Putative uncharacterized protein
MAVNEPTYNNADKNPSCCGCVMRTTHGLPCACIGEDSWSLVCNHLLKELRKWSDDYIKLFGGIDRFEELRRSLFVDGLSMVTMDKWMDITEMRYVIASRYNVILVSLLLQQSMAYFPLRSQPPTDSSVHRIICIGHVYGYHFAQIDSR

SEQ ID NO: 116234 - protein, 166 aa, Glycine max
  Coding DNA Sequence Number=SeqID_24549
MMSSKQRKSGGSKPTTQYDTRRFHSFEAWTRYDDNVMGRHILAERKVEIYHTELDEFKAELERRNFHKCLTNLDDSSIDLALVKEFYASLYSPEGPSPKQVRIRGHLIRIDADSLNAFLETPVVLSEGESLPAYSRYCRMPTDIKEIEVALCIPGRGLILNAEGQP

SEQ ID NO: 116235 - protein, 54 aa, Glycine max
  Coding DNA Sequence Number=SeqID_24550
MPSKPTRKGRKWLKAQVEKDEGPSGEGQSPRVEKDEGPEAETLSRLLIVAEDPN

SEQ ID NO: 116236 - protein, 119 aa, Glycine max
  Coding DNA Sequence Number=SeqID_24551
CTICGRAHESGCCIPIEEHPTHEVNYMGNQPKNNFNVGRFSGFQHGQQYNQQQGQWRNHPRNQFNRDQGGPSIRPQQQGPSLYDRTTKLEETLTQFMQVSMSNQKSTESAIKNLEVQVG

SEQ ID NO: 116237 - protein, 149 aa, Glycine max
  Coding DNA Sequence Number=SeqID_24552
  Gene Ontology: Mol. function=endonuclease activity
  Homolog annotation: Hit_ID=Q9AY32; Match level="QueryCoverage=42%, HitCoverage=95%, E-value=1e-25, Identity=95%"; Hit description=RRNA intron-encoded homing endonuclease
  Subcellular localization annotation: CTP_CleavageSite=21; ConfidenceScore=5.09e-01
MVVTGDGELGWTLGWVDRSASGVHRSARPFCRRCAPVLNWPGRASGQSGAFVFHSQSEILGFMKDEHCEAFAKDVFINQERKLGARRRSDTVLVSTINDADQGSADVAFRTPLALYEKSKSLGSGGSMVARLKLKGIDGRAPPGVEPAA

SEQ ID NO: 116238 - protein, 146 aa, Glycine max
  Coding DNA Sequence Number=SeqID_24553
  Homolog annotation: Hit_ID=A5BFN6; Match level="QueryCoverage=51%, HitCoverage=13%, E-value=2e-08, Identity=37%"; Hit description =Putative uncharacterized protein
MGCMGTYLTHGPKIYPKAHENPRAFSCIFGPIFLESSIQCPWGVGLHHKAYWAVKTATSLWIKLFYKEKTKKFHDSMIVKKDFMVGKKVLLYNSRLGLMSVEIKSDSTNKSFKVNGHRLKPFLTNPSLVDVVVEETSILHPTLPPP

SEQ ID NO: 116239 - protein, 87 aa, Glycine max
  Coding DNA Sequence Number=SeqID_24554
MASNFKVSLIFDIEYIKGTSNSLPDYLTRIGNLPTGRKEYRQRSQAGSSRANHQEIIYLFWVTNPGWVIYPEKQFRRVINPDCLNQT

SEQ ID NO: 116240 - protein, 101 aa, Glycine max
  Coding DNA Sequence Number=SeqID_24555
MGTNQTGKRFYQVKVKSLDTTSIKELGRLMEPLQMQAFRKTYGKILELTLAEKTISFIRVSPLFEQNCNCGQGFSKRFGQHKTDLERHSGPTTEVPRRQGE

SEQ ID NO: 116241 - protein, 50 aa, Glycine max
  Coding DNA Sequence Number=SeqID_24556
VEASFMMMNQVDSSSFDDDKDDDKKPKKMISRLSQQIQDQEDEFKTQEKK

SEQ ID NO: 116242 - protein, 37 aa, Glycine max
  Coding DNA Sequence Number=SeqID_24557
MSEIWQKGELGTRVFEEVQEHVVIDYTNMIIDYQRAF

SEQ ID NO: 116243 - protein, 110 aa, Glycine max
  Coding DNA Sequence Number=SeqID_24558
MTMITPSSKLTLTKGNKSWEIRHLSESPTEGQEARQERFARLKTVLDSVDSRLDQAREIDRVRDNERARLRAEMDHDCDRWRALERKNAQMRLKVNELNLKKRGPLIKFK

SEQ ID NO: 116244 - protein, 128 aa, Glycine max
  Coding DNA Sequence Number=SeqID_24559
  Subcellular localization annotation: CTP_CleavageSite=81; ConfidenceScore=5.16e-01
PQVIPNPLLDLVIPIPITNTLPNLDQTSSQSAQPTNRFNHDPTNSSSIPGSDHPHTLPSVTLRRSTRHSKHPLYLSDYVISQSQAAYPIQHHCSLLPLSPPYKTFINHISSVYEPQFYHQDIPYPEWR

SEQ ID NO: 116245 - protein, 110 aa, Glycine max
  Coding DNA Sequence Number=SeqID_24560
MKNGGKSSRNRSQKRLGSASAWIFFTETIFLTNFKGKEGGGCRPTRPGELGCFHEKAPPSVGTPWKAQVGLVAICTTLFTKYTPFAFFADSFSVTSRNFTDYVMILVFFL

SEQ ID NO: 116246 - protein, 270 aa, Glycine max
  Coding DNA Sequence Number=SeqID_24561
  Subcellular localization annotation: CTP_CleavageSite=43; ConfidenceScore=5.65e-01
MAPTASVIACSAAGGTPPGSTMISGRLAAASPATTQSPARKARAAHRMRQVGCCTTMDGNFPAMSRGSAATPAASFLAIPRYNPAASLPGSATTVGVPASVCSRIASVSGRLPSQGVPYCSAMRWPPPSPKMCSAWPHCEQMWMAMFSTTPRIGTSTFWNMRRPLRASSSATSCGVVTMTAPTTGTFCASVSATSPVPGGMSTIRSRANRRRSGSRWSWPAGHGRSGAPCSCCPGSRDGPRRPAWSARWDRRCRRPAGRPWRPRRPAPAP

SEQ ID NO: 116247 - protein, 47 aa, Glycine max
  Coding DNA Sequence Number=SeqID_24562
STLEDPTRDTPEIKWKHRCTVSEEFREGFDRSSTFIIRSSSFFDLQR

SEQ ID NO: 116248 - protein, 36 aa, Glycine max
  Coding DNA Sequence Number=SeqID_24563
RIASEEVEVFQRVSSAKSFDVIGFYSGLFGFFKNDH

SEQ ID NO: 116249 - protein, 99 aa, Glycine max
  Coding DNA Sequence Number=SeqID_24564
MVTTKELETHMDSYEKIISDLQESMQNSFEMIQKSIKGLMVSIATQHKGPKITTEDGNHSGTHEPIVSVLDRAQIPFSSFDGSNYREWKAKSKQFFELE

SEQ ID NO: 116250 - protein, 69 aa, Glycine max
  Coding DNA Sequence Number=SeqID_24565
MNSLHTWLISQALRASAKRNTQWLSARKNPEEDELYRFAECTAPGHQAHRFSSSAKREKRAKPKSTNVR

SEQ ID NO: 116251 - protein, 195 aa, Glycine max
  Coding DNA Sequence Number=SeqID_24566
  Homolog annotation: Hit_ID=Q6WAY6; Match level="QueryCoverage=83%, HitCoverage=26%, E-value=2e-13, Identity=31%"; Hit description =Putative uncharacterized protein
CEKNSARVVCCLPALSVWLVSHLFQQDTRHPCPLQSYRSCVENGRVDWDQHLARIGGSAINWFPRWKEGKEGVLFSCGDYPNVPLIGTRSCINYNPALAIRQLGYPMRGAPTEGSLSPFLVRDLGAQGLKVIQRIHKAWRESVEERQGSLGGIRNGVIGGYHGWLRVHTRELDWLSKLKVIDEENFEAPEEDEEV

SEQ ID NO: 116252 - protein, 85 aa, Glycine max
  Coding DNA Sequence Number=SeqID_24567
  Homolog annotation: Hit_ID=A5AT23; Match level="QueryCoverage=71%, HitCoverage=6%, E-value=1e-09, Identity=45%"; Hit description =Putative uncharacterized protein
MHIHGEDHKGKGDGNNEDFHTGEIKANADLPREWRVSRYHPLDNIIGDISKGQTKNGIFVNQSKYCKDLIHKFGMKNAKHMATPM

SEQ ID NO: 116253 - protein, 78 aa, Glycine max
  Coding DNA Sequence Number=SeqID_24568
  Homolog annotation: Hit_ID=A2Q1A3; Match level="QueryCoverage=97%, HitCoverage=27%, E-value=3e-11, Identity=32%"; Hit description=RNA -directed DNA polymerase
AASYLNCRIMPLPFSYLGIPIRANPRRCGLWDPILRKTESKLSRIPNRVAEKLTQIQRRFLWGGGLDQKKIAWVKWDC

SEQ ID NO: 116254 - protein, 122 aa, Glycine max
  Coding DNA Sequence Number=SeqID_24569
NVYTDRHSGISARQRDSKVSMTDLVSAEDDAFRITDSKKVYTDNHSGISARQRDSKVSMTDLLSAEDDAFRLTDSKKVYTDNHSGISACQRDSKVSMTDLVSAEDDRDSNVCMRDLGSAEDD

SEQ ID NO: 116255 - protein, 67 aa, Glycine max
  Coding DNA Sequence Number=SeqID_24570
  Subcellular localization annotation: CTP_CleavageSite=53; ConfidenceScore=5.66e-01
MGVQIAPRPTWALQNIPPEGCCFRRKKSKPRRFRNVSVTFSVKNFAKVSTVLRCSSFVLHRSSIFNG

SEQ ID NO: 116256 - protein, 89 aa, Glycine max
  Coding DNA Sequence Number=SeqID_24571
MTGDWLGALERRLKMGWNMPRADTSTLPKAPVIATTGHLANVNLVSLSTARGYLIPTARRFTSFYFEGGHVDMKKKLIARVRLQLILKH

SEQ ID NO: 116257 - protein, 44 aa, Glycine max
  Coding DNA Sequence Number=SeqID_24572
ELCDPQSKDLDRTWVVNGQRLKQHHGGAIVSQPTLRREGDARLA

SEQ ID NO: 116258 - protein, 162 aa, Glycine max
  Coding DNA Sequence Number=SeqID_24573
MWAFHTGRQIDWAHLVRYRMHKELRLNAPLPYPHLVTLFLQHFNIPFDSEPYVPIKRSFLIGAVVIASFGYCKEGDGSWVKKGAQPHDDEGHLPVGEDSSLLQSILDKFDGHQTFVGERSDALEQQADMRFDEMDSRITKVEGDVTYIHTCFDLPLPPPPSS

SEQ ID NO: 116259 - protein, 156 aa, Glycine max
  Coding DNA Sequence Number=SeqID_24574
  Gene Ontology: Mol. function=transporter activity; Cellular component= integral to membrane; Biological process=transport
  Homolog annotation: Hit_ID=A8GEN9; Match level="QueryCoverage=86%, HitCoverage=12%, E-value=2e-65, Identity=91%"; Hit description =Transporter, hydrophobe/amphiphile efflux-1 (HAE1) family
MADISDYLVSNLQDPLSRIEGVGDVQVFGSEYAMRIWLDPTKLASYALMPSDVQTAIEAQNTQVSAGKIGDLPAAADQQLTATVKAQSRLQTPEQFRNIILKSDSSGALVRLGDVARIELGNEDYSASARLNGHPGGGDRSQAGGGRQRPSTPPSW

SEQ ID NO: 116260 - protein, 220 aa, Glycine max
  Coding DNA Sequence Number=SeqID_24575
  Homolog annotation: Hit_ID=Q84VH5; Match level="QueryCoverage=100%, HitCoverage=32%, E-value=1e-76, Identity=70%"; Hit description =Envelope-like protein
  Subcellular localization annotation: CTP_CleavageSite=21; ConfidenceScore=5.25e-01
MATSPKDTSSPGSPSVPSSPSSTKAPSNQEQPEFHIQPIQMIPGQAPVPEKLVPKRQQGVKISENPSPATSPREVDPEMDKKIRSIVSSILKNASVPDADEDVPTSSTPNVSVPDADKDVPTSSTPNAEALPSPSEEESTEEEDQATEETPAPRAPEPAPGDLIDLEKVESDEEPIANKLAPGIAERLQSRKGKTPITRSGRIKTMAQKKSTPITPTTSR

SEQ ID NO: 116261 - protein, 111 aa, Glycine max
  Coding DNA Sequence Number=SeqID_24576
MVEREMITMMVDTLPVFYYEKLVGYMPSSFADLVFAGERIEVGLKRGKFDYVSSASANAKRIGATGAKRKEGDAHVVSSTPAWVKPQQTPHGTHQYAQHHPSFSAHAGKRL

SEQ ID NO: 116262 - protein, 125 aa, Glycine max
  Coding DNA Sequence Number=SeqID_24577
MKQKGKRKKDREGRHVIVKKYKSFVKSKHIFWKQGTDAKSLFSRITEIRMDEFIELIKEHNLETLGCLSAHLTVAMTNFARCFQIIIVTRALWSDRGVRPETDTLTPKFVSPQISRLGSHDKRPH

SEQ ID NO: 116263 - protein, 163 aa, Glycine max
  Coding DNA Sequence Number=SeqID_24578
MIIRGQDIYNSQEETTSSPSSGGSEDEVRGEESSEEVYPHEEGDLLKVAKDQLTMKDKRDEEEKLEKQKKKKDSKALSSKAKGKEKEEKDSSKKIVKKENHFATKGDIKRALLLKQSLYLLLSRETSPSTAIPPELEVIPQVKELLDEGLVRKSLNPCALLVP

SEQ ID NO: 116264 - protein, 93 aa, Glycine max
  Coding DNA Sequence Number=SeqID_24579
MDVDEDHEVPIILGHPYMLIASCVVDMGRKKLEMGFEDQMINFDLFEENKHVLDQNVYLQVMEGDKERNGPLSERVKKPNVSHYRLAAALAKQ

SEQ ID NO: 116265 - protein, 132 aa, Glycine max
  Coding DNA Sequence Number=SeqID_24580
ENGGVASHPARPGEQSDFLQKQPPSGGIFWRAQFRNVTELHELPSDGCQVPQNGQMKVACHQAKACGCSAILCPGRFVEAVIKGVVKDRAALMLMLCQILLCTKRAKAALSGGYALNLTATFCNSKLSLFFT

SEQ ID NO: 116266 - protein, 61 aa, Glycine max
  Coding DNA Sequence Number=SeqID_24581
MRHLSDQGVPINTKRIKVIPEWPTPPSVEEKSPEFQEPRDLRSNPFQGGGNDAILPRKGIG

SEQ ID NO: 116267 - protein, 21 aa, Glycine max
  Coding DNA Sequence Number=SeqID_24582
MGVFPFLPYNLAAMPGVSSVA

SEQ ID NO: 116268 - protein, 129 aa, Glycine max
  Coding DNA Sequence Number=SeqID_24583
MSHNSDLNLDRARLVYGLVTHMDMNIGVLISCQISSIAQSNSSRLGFPALITTLCKARGVTSDSLTYESLSLAINLAYIKKNCWNVGDLIVNFRGVRKARARPADVPSSTPLTPFTSATPTPAPPGPSS

SEQ ID NO: 116269 - protein, 106 aa, Glycine max
  Coding DNA Sequence Number=SeqID_24584
AWGFKLWLRTSVSPTGDRARKTPSGPGEVQQGLRVSSSDYGPLSVLESAHRPQQGHQAPINRAFIKKYYAPRQAQGETPQQPRDGQQRAISAPPPPLEFTSAHPQK

SEQ ID NO: 116270 - protein, 350 aa, Glycine max
  Coding DNA Sequence Number=SeqID_24585
  Gene Ontology: Mol. function=catalytic activity
  Homolog annotation: Hit_ID=A1FV06; Match level="QueryCoverage=99%, HitCoverage=47%, E-value=0.0, Identity=95%"; Hit description =Putative uncharacterized protein precursor
  Pfam annotation: Domain name=GDE_C; Domain location=50-349; Score= -243.4; E_value=0.036; Accession=PF06202.5; Description=Amylo-alpha-1, 6-glucosidase
MPMRSQTGSVMFDALFALAQQEMDQDRVDAIRDPAFDEGRPVPCECFQTGARWPYVWTRDVSFAADLALARLDPQRTRQSLQFKLSAARDGHTPGLFVAQDTGSGGSWPISSDRVVWFLAARHLLEDLAFAEQVWQALQGTLAQDRAMVFDAQMGLYRGETSFLDWREQTYPDWTREDVRFIGDSYALSTNVLHYQALRLAERLAGKRGDARADEYKAWADALAQQVDARFWREDMGQYMSYIGEAAHPVPYAKVDLLGLSLGILADVLPTGRARRALAAYPVGPAGSPVVWPQEGQQPIYHNRAIWPFVSAYSLRAARQLDDAPRIAAEIRSLMRGAALAGSNMENYEL

SEQ ID NO: 116271 - protein, 99 aa, Glycine max
  Coding DNA Sequence Number=SeqID_24586
  Subcellular localization annotation: CTP_CleavageSite=27; ConfidenceScore=5.08e-01
PDFQGRRGRTGHHATCGALPAAGPYLRLSRFQGGQAVKQKKITLSGAPADVSGLPNVAVSRHVPICTDDRSARARALGFAATAAPSYSSGLGPCPDGRV

SEQ ID NO: 116272 - protein, 86 aa, Glycine max
  Coding DNA Sequence Number=SeqID_24587
RTQGLDWLPNLKTVRDNEASEESDEVQALKAELERARVVEEKFKAAIVSSAPKSERIITGQRHDLKDELKACLRSEKKFVPTVKRD

SEQ ID NO: 116273 - protein, 141 aa, Glycine max
  Coding DNA Sequence Number=SeqID_24588
MRSEPICAYVYINGEIIQSSSANAIFRGDKTKSLLLNPTMMLPNIITVIQLSITDNDGTPIITALWYRRPVYEFNGEVQYRAIQIIDEEGVLCMFHTFANMTSVICMELKDDVHNSLSPTQVNDLSWVDMEQQLDNSLKLE

SEQ ID NO: 116274 - protein, 76 aa, Glycine max
  Coding DNA Sequence Number=SeqID_24589
  Subcellular localization annotation: CTP_CleavageSite=48; ConfidenceScore=5.25e-01
LIRQIGKSVVFHSFAKPSCWLSKNSLSATICLKNLTNGLMSISTSLVISMDKWMNIADMGYVIASTYNVMQSYPPP

SEQ ID NO: 116275 - protein, 347 aa, Glycine max
  Coding DNA Sequence Number=SeqID_24590
FDYVSPIGASSRRTRIAGAKKKEGDAHTVTSTPAWPKPPQTPHGTHQYAQHHLSFSARAEASSDTALTHRGELFRLRLRLGLTRPTTLTLTQTRRGTFHLDPNDIWGTLAIFHHQPIGRGGPGKDHLVSIPKMDGPNIKMNPLANHGGEAVNAIEVSRSHGPKLLKDVTTPGRFINKVLQKAGMIPCGGRKEDSCLMHPGVLHDMETCSAIRDLLQQMINQGRLEVGSKREEEQHVCMQSVDEEGPKMPKPLKSRAVPWRYAPSSGRKEEATDISSLSAKVTNITGLSGISRSGRVFAPPSLPIQPAITKGKARMVEGQNVKVIPAPDEDVPTKDLSEGREGCGKKE

SEQ ID NO: 116276 - protein, 197 aa, Glycine max
  Coding DNA Sequence Number=SeqID_24591
  Gene Ontology: Mol. function=signal transducer activity; Cellular component=integral to membrane; Biological process=signal transduction
  Homolog annotation: Hit_ID=A4WD76; Match level="QueryCoverage=91%, HitCoverage=24%, E-value=2e-78, Identity=81%"; Hit description =Diguanylate cyclase/phosphodiesterase precursor
  Pfam annotation: Domain name=EAL; Domain location=1-181; Score=170.7; E_value=3.8e-48; Accession=PF00563.11; Description=EAL domain
EFGLSSRVDLWVLDHTLRFLAEHREQLPGHRFAINLAPSTVCRVQFPLEVSRLLAKYAIEPWQLIFEVTECSTFGNGEQAQHILQQLQKMGVRIAIDDFGTGYASYARLKSVDADILKIDGSFIRNIVNNSLDYQIVASICHLARMKKMLVVAEYVETEEIRSAVHALGIDYVQGYLIGRPVALASLLEAEASVADA

SEQ ID NO: 116277 - protein, 164 aa, Glycine max
  Coding DNA Sequence Number=SeqID_24592
MAPTRHPLDPDKSNRALGFPALITGLCQSFGVPVAPSKVIRPPITRAFIEKYCTQRQAQGDAPQAADAPPPHQAGPAGSFDTEQYLWHLVRQQAANHRAHVQTHDCLYQLSLSLQSQGFTSFPCPTPDQLRAEVAWLGDWPEAWAGEAPAEAPTRQMRPARTRR

SEQ ID NO: 116278 - protein, 177 aa, Glycine max
  Coding DNA Sequence Number=SeqID_24593
VRKECAELREGNAVTTRALEQETKRARKEEHGREKFRGALWGSNSELKLRREERDQSRAHSMVLKEELAACSKSKRNLSQRLCETETSMLAIINKYQEELNLAMAHEHKVADEYDQVYAEKEARGRVIDSLHQEATMWKHRFALTLNGSQELPRLLAKAKAMADTYSPPRDPQTSQL

SEQ ID NO: 116279 - protein, 134 aa, Glycine max
  Coding DNA Sequence Number=SeqID_24594
MTRGNPSDLQPFDPEIDRTFHRLVRHHFVPFEHPEHSVVGNFEHPDFEHSKNMAQPPPRERTLREMGAPDFTYESLCIQYPDEDVPCVLKIGLIHLLPKFHGLVGEDPHKHLKEFYIVCSTMKPPDVQEDRGIL

SEQ ID NO: 116280 - protein, 127 aa, Glycine max
  Coding DNA Sequence Number=SeqID_24595
  Homolog annotation: Hit_ID=Q2HVN2; Match level="QueryCoverage=71%, HitCoverage=26%, E-value=2e-09, Identity=35%"; Hit description =Putative uncharacterized protein
MRWKIVGGDKVRLWEDKWNQQQQPLAERYPRLYQISTQQNQIIRHMGQHMQSGWEWQFLWRRSLFENEIESAVNFLKDIEGIHIQQQGSDEWEWLGDQTRKYSTRSAYNLILEASKGGQHQDWCKEL

SEQ ID NO: 116281 - protein, 162 aa, Glycine max
  Coding DNA Sequence Number=SeqID_24596
  Homolog annotation: Hit_ID=Q6WAY6; Match level="QueryCoverage=76%, HitCoverage=21%, E-value=6e-14, Identity=32%"; Hit description =Putative uncharacterized protein
LAAIDAFLAYHHSKESPVVAVLADLFDTFDRRIDWDQLLAGIGGRTISWFPRWKEGKEGVLFSCGRYPNIPLVGTRGCINYNPALAIRQLGYPMRGAPTEESMSPFLVRDFGAQNSKSIQRIHKAWETPLRKDQELRGIRNGIIGGYHEWLKVHIRSLDWLA

SEQ ID NO: 116282 - protein, 78 aa, Glycine max
  Coding DNA Sequence Number=SeqID_24597
MVENLRKITHGNVTEAPRLGFSSRNQFFSLISSDSQITRRAEHFSLSPLPLFIGKWGRSLPPSSPRRARLLPPEATAF

SEQ ID NO: 116283 - protein, 168 aa, Glycine max
  Coding DNA Sequence Number=SeqID_24598
  Homolog annotation: Hit_ID=Q6WAY6; Match level="QueryCoverage=39%, HitCoverage=11%, E-value=4e-08, Identity=44%"; Hit description =Putative uncharacterized protein
MGTRGCISYNPVLAIRQLGYPMRGAPLEDELAPVISRGFNKTNVETLQKVRKAWEVLQKKDKELRGSNNGPIGGYQEVEAPEEDEEVQALRAELEQAQTVKERFKSAALKIRKENTELRDRLCETETNMLAIITKYQEELNLATAHEHRVADKYAQVYAEKEARGGIL

SEQ ID NO: 116284 - protein, 177 aa, Glycine max
  Coding DNA Sequence Number=SeqID_24599
MEFGDIVVHFNILDAMKHPSEDHSVFRAEIIDQIVDDYMKHPFLSDLHTCHSLCIESESEFEFDHVSDFYAENESEFESGSDFLGVVSLDVDFLESECTNHVVGSTYTFDLLYEVQAEEPSSSPTLVPPTIQPPPTPELKLLPETLIYAYLEDKEKFPMIISASLAAEQEEKLLLVL

SEQ ID NO: 116285 - protein, 123 aa, Glycine max
  Coding DNA Sequence Number=SeqID_24600
MAYSLVDGASPHLFSFIFHYIKVTNLQELGQLKLKDPASIEAPQASFHHKESLLLELMLKFVQFQRVSITKCDFSALSMKKESRRAPESKQSAKREINSLSESSVSCQAQRSIGAKPKSTYSR

SEQ ID NO: 116286 - protein, 389 aa, Glycine max
  Coding DNA Sequence Number=SeqID_24601
MNYHTKFDEFKTKLERRNWHKELTNFMDGSIDVAIVKEFYANIYDPLDKSPKQVRVRGHLIKFDEDALNTFLKTPVIIEEGENLPAYSRFRRLRPDPQELAARLCIPGRGFELNADGLPLKILRGNLTMLAQTWSVLSFSNLAPTSHTSNITLDRARMIYDIIQKMDMNLGYIISAQISMIAQHDSSRLGFPALVIALCKARGVTSDSLTFESLNLAINLAYTKGKRSEAPLSSALPTPAPSTSTAAPSTPTSSLPAPASAPSTSTAALSAPTSSTPLPVPAQVSTGPSTVAWPGVHPSRSRVGEASSAQEPVPEEDEPIPPEPDTKIAQEEATSPELVPESSPSPAPVLEDPESSALAPMPDQSLAQDPPVALMLDLNENAEDHLQDD

SEQ ID NO: 116287 - protein, 263 aa, Glycine max
  Coding DNA Sequence Number=SeqID_24602
MAKLIYGIIMKMDMNLGYLISHQISIIAKHDSSRLGFPALITALCKARGVTSDSRSLESLSPAINLAYIKKNCWNLDDPTVTFRGPRKARGKRSEAPPTSAAPDASAPFSSTLLDPSTVAPSSSTPATPTPIPVQFPVQLPASSALASSLHRGQVIIMQSLQSSGLPSIMSTNELLTQVTEEPVLAKDELTPIEPCSVAADTSMAQEEVSSPDPMPEPSPALISEDTMPSAPAMEPGQPIIQDAPVATMLDLNEDPPQDEQDV

SEQ ID NO: 116288 - protein, 128 aa, Glycine max
  Coding DNA Sequence Number=SeqID_24603
  Homolog annotation: Hit_ID=UPI0000E2C0B1; Match level="QueryCoverage =70%, HitCoverage=92%, E-value=2e-11, Identity=45%"; Hit description =conserved hypothetical protein
MASGATCVQRLDGSRDSAIHTKYRISLRSSSMQEPRYPLPRVIDEEAGRTGRRGHPLPPDGKMNKQVRGSIWIVEASTMILPQVHLRKPWYDFSLPLNDKVQWTSHNVAGSEPLTSPQSEHFTGPFNR

SEQ ID NO: 116289 - protein, 238 aa, Glycine max
  Coding DNA Sequence Number=SeqID_24604
  Gene Ontology: Mol. function=helicase activity; Biological process =viral genome replication
  Homolog annotation: Hit_ID=Q9LTU4; Match level="QueryCoverage=99%, HitCoverage=19%, E-value=6e-56, Identity=42%"; Hit description =Helicase-like protein
MARDRLAHSEVHNIRLKLIADHEKDGRIYNVPTVSEVAALIAGDFDTYSRRDIILETRNGQLKRIDELHSSYLGLQYHLLFPYGEDGYRPDILHRATSSGQKRKRNRLTMREWFAFRLQCMSNEAQTLLHSRKLFQQFVVEGYTMVESKRLSFIRNNQKKLRVNKFCSLQQSLDAGATKGLQKGKRVILPSMFVGGPRYMDQLYFDDRPDILSRVFKLKYEQMLSDLTKNHLLGKVVA

SEQ ID NO: 116290 - protein, 76 aa, Glycine max
  Coding DNA Sequence Number=SeqID_24605
  Subcellular localization annotation: CTP_CleavageSite=15; ConfidenceScore=5.04e-01
MKETNKGSPVESPTVATYPSAGGRRVTRGMRVPRKEYARSRHQRLFEENVRKTGKDAIYELLSERFGSCICARGRY

SEQ ID NO: 116291 - protein, 42 aa, Glycine max
  Coding DNA Sequence Number=SeqID_24606
MAKSSRYLGDGGKWRIGSRADRCPFPALDKVENVAAWQPSIL

SEQ ID NO: 116292 - protein, 95 aa, Glycine max
  Coding DNA Sequence Number=SeqID_24607
MFVSLLKHVCIFSGENNETFSSLTSYPELRRSEFLIGGYVGARASLLSTTLPFVAMTQEALPKRFRNVFREESRKGLNRSSTFFIRSSSFFDLQR

SEQ ID NO: 116293 - protein, 142 aa, Glycine max
  Coding DNA Sequence Number=SeqID_24608
  Homolog annotation: Hit_ID=Q84VH5; Match level="QueryCoverage=72%, HitCoverage=27%, E-value=4e-24, Identity=99%"; Hit description =Envelope-like protein
HQIAKEITAKQVQHWPKKGKLSAGKLSVKYAILHRIGAANWVPTNHTSTVATGKAAASGAVSKDALIAELKDTCKVLEATIKATTEKKMELERLIKRLSDSGIEDREAVEEEEEAEEEEEAEEEEDAAEDTESDDDDSEATP

SEQ ID NO: 116294 - protein, 15 aa, Glycine max
  Coding DNA Sequence Number=SeqID_24609
MASMDTSAMVNSKIF

SEQ ID NO: 116295 - protein, 115 aa, Glycine max
  Coding DNA Sequence Number=SeqID_24610
MVLNQMMMKDTNRLKETLLSFRVFWTGLMDFKPMLVRGLTPWNVKFVIIKKGEIMEASFMMMNQAILMMPKAQVIDSRLIQDCKIKHQESNPRFKIQEKKSRSNKSRLHIGSDKY

SEQ ID NO: 116296 - protein, 648 aa, Glycine max
  Coding DNA Sequence Number=SeqID_24611
  Gene Ontology: Mol. function=protein histidine kinase activity; Cellular component=integral to membrane; Biological process=two -component signal transduction system (phosphorelay)
  Homolog annotation: Hit_ID=A4WCN1; Match level="QueryCoverage=100%, HitCoverage=72%, E-value=0.0, Identity=81%"; Hit description=Multi -sensor signal transduction histidine kinase precursor
  Pfam annotation: Domain name=HATPase_c; Domain location=325-437; Score=45.1; E_value=2.5e-10; Accession=PF02518.17; Description =Histidine kinase-, DNA gyrase B-, and HSP90-like ATPase
  Pfam annotation: Domain name=HisKA; Domain location=221-278; Score =6.4; E_value=0.066; Accession=PF00512.16; Description=His Kinase A (phosphoacceptor) domain
  Pfam annotation: Domain name=Hpt; Domain location=567-643; Score =61.1; E_value=3.7e-15; Accession=PF01627.14; Description=Hpt domain
  Pfam module annotation: Pfam domain module=HATPase_c::HisKA::Hpt; Domain location=325-437::221-278::567-643
MPLDSFRLEPDNSTQNMRSAPDKEAAESVSISFNGSKIEIASSLNSTGMRLVWQVPFGTLLLDTLQNILLPLLLNIGLLALALFGYSTFRFQPGRQSDASAVPAGTSNELRVLRALNEEIISVLPLGVLVHDQEANRTVMSNKIADHLLPHLNLQNITTMADQHQGVIQATINNELYEIRQFRSQVASRTQIFIIRDQDREVLVNKKLKQAQRLYEKNQQGRAAFMQNIGDAFKQPLRALASQAAALNTSESHQLACQADSLVRMVDEIQLANMLENDFWKGTPTLFSIQDLIDEVVPEVLPVIKRKGLQLLINNHLSANDERHGDREALRRILLMIIQYAVTTTQIGKITLEVNTDESAEDRLTFRILDTGEGVTTSEIDNLHFPFLNDTQSDRYGKANALTFWLCDQLARKLGGHLNIKARESLGTRYSLHVKMAANPQEEDEERLLDDVVVMVDVTSNEIRNIVVRQLENWGAACITPDERLASQEFDLFLTDNPSNLTASGLLLSDDESGVRKIGPGQLRVNFNISNAMQEAVLQLIEEQLAQEEIAESPLGGNENAELHASGYYSLFVDTVPDDVKRLYTESAANDFAALAQTAHRLKGVFAMLNLVPGKQLCETLEHLIREKDASGIEKYISDIDAYVKSLL

SEQ ID NO: 116297 - protein, 139 aa, Glycine max
  Coding DNA Sequence Number=SeqID_24612
  Gene Ontology: Mol. function=2-polyprenyl-6-methoxy-1,4-benzoquinone methyltransferase activity; Cellular component=mitochondrial matrix; Biological process=ubiquinone biosynthetic process
  Homolog annotation: Hit_ID=Q1R9I4; Match level="QueryCoverage=48%, HitCoverage=28%, E-value=3e-33, Identity=97%"; Hit description=3 -demethylubiquinone-9 3-methyltransferase
MNAEKSPVAHNVDHEEIAKFEAVASRWWDLEGEFKPLHRINPLRLGYIAERSGGLFGKKVLDVGCGGGCPSSRAGVWHTGRLRAGNRGRTCGKTCPSVRRGNLHGDAGARSRSAVRGARLCKTGETGRPGLLLNPQPQR

SEQ ID NO: 116298 - protein, 245 aa, Glycine max
  Coding DNA Sequence Number=SeqID_24613
  Homolog annotation: Hit_ID=Q84VH5; Match level="QueryCoverage=83%, HitCoverage=39%, E-value=7e-68, Identity=96%"; Hit description =Envelope-like protein
MDLIKAAGLMKTVTKLGDCYESLVREFIVNIPSDITNRKSDEYQKVFVRGKCVRFSPAVINKYLDRPTDGVVDITVSEHQIAKEITAKQVQHWPKKGKLSAGKLSVKYAILHRIGAANWVPTNHTSTVATENLLYPCTTNCLRGHMSQTLSRQAAASGAVSKDALIAELKDTCKVLEATIKATTEKKMELERLINRLSESGINDGEAAEQEDEAAEEEVEAAEEEEEAAEEEEDAASDDDSEATP

SEQ ID NO: 116299 - protein, 197 aa, Glycine max
  Coding DNA Sequence Number=SeqID_24614
MSVHVAQVIADAIYLFAGMPPTRHPLDPDKSNKALGFPALITGLFQSFGVLVTPNKVIRPPITRAFIEKYCTLRQAQGDAHQAVDTPPPPQQADPAGSLGMERYLQHLVRQQAANHRGQVQIHECLYRFSLSQQGQGSAPFACPTPEQFKAEVAWPRDWPEAQAGEEPAGSPDGAKEARMDEDMTDLLDFLGGSGAT

SEQ ID NO: 116300 - protein, 139 aa, Glycine max
  Coding DNA Sequence Number=SeqID_24615
MSNHKSTESALKNLEVQVGQLAKQIADKSSSSFVANTKKNPKDECKAVMTRSKRFVEAEDEDSVVSKKKGSEKKGADEKKDDVRGEGNQEKEKQIMVKRKELNDQEKEKEVEKEKKMKKIRMKRGVEVNKLERRKEKKL

SEQ ID NO: 116301 - protein, 47 aa, Glycine max
  Coding DNA Sequence Number=SeqID_24616
SSSSFLSEEIHGGEAPSSLAYSLVDASIDAPQASFHQVVIRAQELQV

SEQ ID NO: 116302 - protein, 37 aa, Glycine max
  Coding DNA Sequence Number=SeqID_24617
MECQGLLHDKHTLRSSRIVRIMEVVFAIGSAVDRLCG

SEQ ID NO: 116303 - protein, 85 aa, Glycine max
  Coding DNA Sequence Number=SeqID_24618
MDQLSKYIARIAKTVVPYPSAGGASLAGGVHERNTREERFATTFAKFFTRKTSENRKTHLRLRFLRESRELYFTQIRGRIANVRP

SEQ ID NO: 116304 - protein, 212 aa, Glycine max
  Coding DNA Sequence Number=SeqID_24619
  Gene Ontology: Mol. function=structural molecule activity; Cellular component=cytoplasm; Biological process=keratinization
  Homolog annotation: Hit_ID=Q86AI8; Match level="QueryCoverage=52%, HitCoverage=31%, E-value=1e-12, Identity=34%"; Hit description =Similar to Homo sapiens (Human). Mucin 2
ELHILTFRGLHVLAFRGLQALPFRGLRVLTFRGIHALAFRGLHVLTLIGLHVLTFRGLHVLAFRGLHVLTFGGLHVLAIRGLHVLAFRGIHVLTFRGLPSSPSEGCTPSPSEDYTSSPSEGYTPSPLEDCTSLPLEDYTSSPSWGYMSSPLEDYMSSASEDYTSLPSEGYTPSPSEDYVSSPLDGYTPSPSEDYVSSPSEGYTPSPLEDYTS

SEQ ID NO: 116305 - protein, 109 aa, Glycine max
  Coding DNA Sequence Number=SeqID_24620
GLALPPEPKVGPSATHVSTKESCGDPSPTDPNTGSLSAPLHLAKRTASVHPLNLQGPELDEEAVLRALDERLPGYGKLKSSVESSLGNWSDSDDLDRTRLSCRTITRNR

SEQ ID NO: 116306 - protein, 67 aa, Glycine max
  Coding DNA Sequence Number=SeqID_24621
MSEIRRFGGLGMEERRKRKGAAQGFLENVIFIEQDVWRRQPTGNRLQAICSSVIDYSIHVIDYQNKK

SEQ ID NO: 116307 - protein, 349 aa, Glycine max
  Coding DNA Sequence Number=SeqID_24622
MPSPSESYTPSPLEDYTSSPSEGSTPSPLEGYMPSHSEGYMPSPSEDYKSSPSEGCMPSTSEDYTSSPLEGCTSSHSENNRSSPSEGCTHSPVLTFRGLRVFTFRGIHVLAFSGLHVLTFRGLNVIAFRELHAFAHPHLQRTTHPRLKRTPQGNTPSPSEGNTPSPSEDYTSSPSDDYTSSPSESCMPSPIITFRGLHVLAFRGLHALAFTGLHILPLRGLHVLTIRGLHVLAIRGLQVLAFRGLHVLAFTGLEILTFSGLHALAFRELNTLACLHLQRTTSPRLQRITRPRLQRTARPHLQRTARPHLQRTTRPRLQRTTRPRLQRTTRPRLQRTTRPRLQRTTCPRL

SEQ ID NO: 116308 - protein, 137 aa, Glycine max
  Coding DNA Sequence Number=SeqID_24623
  Gene Ontology: Cellular component=cell projection; Biological process= cell adhesion
  Homolog annotation: Hit_ID=A4W7J1; Match level="QueryCoverage=100%, HitCoverage=73%, E-value=7e-62, Identity=86%"; Hit description =Fimbrial protein precursor
  Pfam annotation: Domain name=Fimbrial; Domain location=1-137; Score =135.5; E_value=1.5e-37; Accession=PF00419.11; Description=Fimbrial protein
NTDSSEQTVNLGQYRTAKFTKVGDTTTNIPFTIELNDCDPLVAKTAAVAFTGQIDATDKTLLAVTSGSNDNTAKGVGIEILDSKSSVLTPDGATFSAAQNLIQGTNTLNFSARYKATAATTEPGQANADATFVMKYE

SEQ ID NO: 116309 - protein, 25 aa, Glycine max
  Coding DNA Sequence Number=SeqID_24624
MKKQQWKEKRKAKEKRIGEAPSTRE

SEQ ID NO: 116310 - protein, 217 aa, Glycine max
  Coding DNA Sequence Number=SeqID_24625
RRDALFGFDRRGCSVPKGQQAVQGVLAQVREGQSGCSRSGVTGYTDRIGSASYNQTPVAATCRGRAQRAGAGWGACGQHQRRRAGRSRADRAVRAAQPSRADRLPGAEPACADCWNGPAALRVPHRGHAPVFHGARDERPIPASFHEDGSHIECVRPARQPCGGAHSRAAPAGLDPAGRHRGRLPCPAAGSPGLPAQWSRTAHRRRTGHAHRRVAAV

SEQ ID NO: 116311 - protein, 81 aa, Glycine max
  Coding DNA Sequence Number=SeqID_24626
  Homolog annotation: Hit_ID=Q2HTA0; Match level="QueryCoverage=67%, HitCoverage=8%, E-value=4e-12, Identity=63%"; Hit description=IMP dehydrogenase/GMP reductase, related
  Pfam annotation: Domain name=DUF1723; Domain location=2-51; Score =59.9; E_value=8.9e-15; Accession=PF08330.1; Description=Protein of unknown function (DUF1723)
ITGDLGLISAFVERWHGETSTFHLPVGELTITLDDVSSLLHLPITSALHSFHALSTEEARFLLTELLEVSVEEARVEIALT

SEQ ID NO: 116312 - protein, 77 aa, Glycine max
  Coding DNA Sequence Number=SeqID_24627
MDLKSDLFYLQNRGGACHPAHPGEQGCFLQKQQPSGGRIWKAQLSKKLRKLTDCAKTPLFDFRHITEFHGLRKPASF

SEQ ID NO: 116313 - protein, 193 aa, Glycine max
  Coding DNA Sequence Number=SeqID_24628
MGPELTGSHVIGSRAWLIHHFITAKSAMNPDFNPTTRRVLAGGQHTPRAATCYMFALGKRCVTPRQACPRPNGFGRNLRSKTRWFTGNSAIHTKYRISLRSSSMQSRDIRCRESLFEFLGARSAGVCVCREDEEAGRTGRRGHPLPPDGSVDFSQRRGQRTAHVAAIRTLHRTIQSVGATGGVYKGQDVVNAS

SEQ ID NO: 116314 - protein, 158 aa, Glycine max
  Coding DNA Sequence Number=SeqID_24629
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=4e-23, Identity=98%"; Hit description=LacZ protein
MKVKVRTLSPMKDKGEEFESHEIINQRMLSPNKQASRHYPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 116315 - protein, 304 aa, Glycine max
  Coding DNA Sequence Number=SeqID_24630
MASNSQQFSTRNDAIVIRGVHEVATNPFASSETKKLEGKLDALANLVTQLALNQKSVPVARPEAYAANIYNRPPQPQQQNQPQQSNYDLSSNRYYPGWRNHPNLRWSSPQQQQQQPAPSFQNATGPSRPYIPPPIQQQPQPQKQPTVEAPPQPSLEELVRQMTMQNMQFQQETRASIQSLTNQMGQLATQLNQQQSQNSDKLPSQAVQNPKNVSAISLRSGKQCQGPQPIAPSSSANESAKLHSTPEKGDDKNLPNNFCAGESSSTGNSDLQKQHIPPLPFPPRAVSNKKMEEAEKRSWKHSEK

SEQ ID NO: 116316 - protein, 64 aa, Glycine max
  Coding DNA Sequence Number=SeqID_24631
  Gene Ontology: Mol. function=nucleic acid binding
  Homolog annotation: Hit_ID=A5C693; Match level="QueryCoverage=81%, HitCoverage=31%, E-value=4e-12, Identity=53%"; Hit description =Putative uncharacterized protein
MTGDASNFAHISPKKSGHVTYGDNNKGRILGVGKIGLKHSLLSVSQLCDKGYLSQPTLRREGDA

SEQ ID NO: 116317 - protein, 151 aa, Glycine max
  Coding DNA Sequence Number=SeqID_24632
VPLKACGNHMTVLRRHGPPLQWKVETLNPAIGGKGVVQPWYAFLEEMDFDDGDEISIYDRTRQFGAKMCHLSRRKIVAWFNLGWFCCNSTTHNLNARMWFDEGKTFMVSTYGANVLPQLDIRPKLRDVPPETCNVNFNNQVSEWNGKLSEI

SEQ ID NO: 116318 - protein, 173 aa, Glycine max
  Coding DNA Sequence Number=SeqID_24633
MVRTRGLGRALGHVTGRGVGRGDRDDSNDAPQHRWPIASARRQRVSVTAAHDEPVVPAPDIEADVFLDDPMAPIDVEDIVADIPADIGAEASEDEHEGFLGGLSDPFVLTQYADHVACSVWMGELSSHGRKVHSLGRSVPTIEGLVAGIGLSPLIVCSVDTSNRGLLSSFVDR

SEQ ID NO: 116319 - protein, 161 aa, Glycine max
  Coding DNA Sequence Number=SeqID_24634
MGYPPYVVLGGDRPMAQINSPTIPSCPPSTQLTYSHIALILVPLNTGSPSTPPSFHNIQAIQFPNIMNYPKPRKQGRGRKLCPKHIHILQLSLLKYPKVYPNLKFEVPQRRGALHDSKNGFLLQFGVEMVSKVWSFNGGFNGEEEEEKSNVGDEGKASEFC

SEQ ID NO: 116320 - protein, 95 aa, Glycine max
  Coding DNA Sequence Number=SeqID_24635
ETSLSTAIPLRLEVIPQVKELLDEGLVRKSLNPCALLVPKIGLPMDPKRIKVIPEWPTPPSVEGRIPEFQEPMDLSSNPFQVGGNDSILPPKGIG

SEQ ID NO: 116321 - protein, 227 aa, Glycine max
  Coding DNA Sequence Number=SeqID_24636
MVKEECKEVSVSSKRLAKKERHFEIKTNIKEISPLRQPPHFLLCKKTLVSIATPLGLEFIPQVKELLDEGLVRKSLNPCALLVPKIGILRHQIPKIGGMMNVLSGATLFCKITRAPNIFMICVHRDSLGRDSHEPKRVKVIPEWPTTPTPLIELVRNHVPSWEDAQEMGFQTLPYFNFPNATNIYVLVFFFTLVEEKSPKFQEPQDLRSNSFQGGGNDAILPHKGIG

SEQ ID NO: 116322 - protein, 45 aa, Glycine max
  Coding DNA Sequence Number=SeqID_24637
MWWGIDIICECLTFVALPHMDTMSYPNFVREPLLDDVRPFFGPRE

SEQ ID NO: 116323 - protein, 101 aa, Glycine max
  Coding DNA Sequence Number=SeqID_24638
MARTKKTGQMTSEAAKEITKKIVRAVRVTGSFVPHGRQDVLTAAIGRPEHPGRVRAAGASVPIKKYFGSTPRTSCSSSSLSPEDLQQLTQQIRDQLKESIT

SEQ ID NO: 116324 - protein, 389 aa, Glycine max
  Coding DNA Sequence Number=SeqID_24639
IRGLDWLAKLKVVSEENFEAPEEDKEVQALKSELGKAKLAKEKFKLAATHVRKECAGLREENAITARALEQETKRARKEEYGRNKFRGALWGSNSELKLRREERDQSRAHGMVLKEELVACSRSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMMEAMLGMKQLMEKNAATAAADGEGTHWGTMAALTWDTTERLTLMDCRPTIHHPSCKKMRATLLLPSMKKSLLSSPTKSIKTLKSMLGGMSSFIPRSPKGRHQARCPNPTSQHRQ

SEQ ID NO: 116325 - protein, 160 aa, Glycine max
  Coding DNA Sequence Number=SeqID_24640
  Gene Ontology: Biological process=transposition, DNA-mediated
  Homolog annotation: Hit_ID=Q1J7G7; Match level="QueryCoverage=20%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSITNNYYSRYIMARDYLDYKTQSDYRARFDKY

SEQ ID NO: 116326 - protein, 116 aa, Glycine max
  Coding DNA Sequence Number=SeqID_24641
MKKRFTHIVNHLASLGKTFPNEDLINKVLRCLSREWKPKEHEMELQRLNQNEETDKRKLSIALKTSSSIQEEDEESEDEEDFSLFVKNVNVCIHDFDDVKEESNKAASNDKHLLQE

SEQ ID NO: 116327 - protein, 118 aa, Glycine max
  Coding DNA Sequence Number=SeqID_24642
MSFPLEDYTPSPSEGHTPSPSEDYTSSPSEDYTSSPSKGHVPSPSEDCTSSPSKVMYLHLRGPHALAFKGLHVLTFRGLHVLAFKGSCTLTFRGLHVLAFKGSCTFASEGHTPSPLED

SEQ ID NO: 116328 - protein, 77 aa, Glycine max
  Coding DNA Sequence Number=SeqID_24643
MENWRTALGNQFVGLQTRWWRMHERQSIHGAPNKNSLVEDMNDNQFMGLRIKVENGELANSARQSIRRAPDSLVEDA

SEQ ID NO: 116329 - protein, 68 aa, Glycine max
  Coding DNA Sequence Number=SeqID_24644
MKRKRRIPDRRSEESKKEKIGGKQNSSRSIKETKKENRRVFRPDKFSASGSSFGIAIQGRSQLAMSRV

SEQ ID NO: 116330 - protein, 102 aa, Glycine max
  Coding DNA Sequence Number=SeqID_24645
MIMRGQDIYSSQDEATTSPSYSESEEAKGEESSEEIYPQEDGQPLVVKEKCKEVSVSSKRNFLMQSYPARALARRLQVDWARDPRQGPRVLMSLRVDFEPMG

SEQ ID NO: 116331 - protein, 104 aa, Glycine max
  Coding DNA Sequence Number=SeqID_24646
  Homolog annotation: Hit_ID=A5BMX7; Match level="QueryCoverage=58%, HitCoverage=7%, E-value=5e-07, Identity=40%"; Hit description =Putative uncharacterized protein
TWGWTENKRGYISCGSVLVKGTSTRFKENKGGLFQDHDEDQVNFCLMTKSHDNNKEVSVRKKWYIDSGCSKHMTGDVSKFIIISPSKVDMLHTATTILVKSQKM

SEQ ID NO: 116332 - protein, 103 aa, Glycine max
  Coding DNA Sequence Number=SeqID_24647
MENSTRMPSFKAKASPKGDHIHPCGEKLASSHTLKIKFNKLKASKLLFSTFCAICQRRQCNDKVWNNLETPPNIIVSLAKQFHSDWLHARNYAHDTTTNRDTH

SEQ ID NO: 116333 - protein, 139 aa, Glycine max
  Coding DNA Sequence Number=SeqID_24648
  Homolog annotation: Hit_ID=O69419; Match level="QueryCoverage=43%, HitCoverage=93%, E-value=2e-14, Identity=71%"; Hit description =Putative uncharacterized protein
LSDFATSDLSVDFCDARQGAEPMEKRQQRGLFTVLAFAGLLLTCSFVRYPLILWITVLPPLSELIPLAAAERPSAATGTTGFPTGKRAVSATQLIYDHDYEFELGTYPFLIWVSLLGHSQDAAAVVLVGRHSDQKKGIL

SEQ ID NO: 116334 - protein, 59 aa, Glycine max
  Coding DNA Sequence Number=SeqID_24649
MCTCAIFGSQDALSMHVEEYLVRVNVHKEEMAPRKLASKRSRRISGRRTSSALEMTVTL

SEQ ID NO: 116335 - protein, 248 aa, Glycine max
  Coding DNA Sequence Number=SeqID_24650
  Gene Ontology: Mol. function=racemase and epimerase activity, acting on amino acids and derivatives; Biological process=amino acid metabolic process
  Homolog annotation: Hit_ID=Q5LQ34; Match level="QueryCoverage=79%, HitCoverage=41%, E-value=2e-22, Identity=34%"; Hit description =Aspartate racemase, putative
  Pfam annotation: Domain name=Asp_Glu_race; Domain location=19-242; Score=78.0; E_value=3e-20; Accession=PF01177.13; Description =AspGluHydantoin racemase
MVNISPLYDDVSWPADEGVLGVVGVAPWATLDFCQQLYGLVQADKEWQYPRLIIDNNSKIPSRGRHLQLGERDPSPWIHATITELAAAGATVAVVPCNTAHLLWSRWSKDAAIPVINIIDATLEHIAPQGKRVVVLGSQMLYQSRLYQNALTQQHAEIVNVAASTQQLLTRCINEIKATKSVSELSMRQLADAVSSWKQQGATHIILACTELSLLKHSAIWQEMTLIDSSEALARAALRAISFRRLRD

SEQ ID NO: 116336 - protein, 69 aa, Glycine max
  Coding DNA Sequence Number=SeqID_24651
MLTSLERVQMTTLASAHQSHLGSLNDEVRITVRCLRGLPALGSKSGVVDKSEAFAPTYPQMRNSDLRSS

SEQ ID NO: 116337 - protein, 160 aa, Glycine max
  Coding DNA Sequence Number=SeqID_24652
MEIISKHFEQLDVCGKVHLKSKLQEIAYPDMNSMCPLPEKVKTKGSPKKPLTKQQKSTKRDLSYWEYVDALHSMQNMDGNCGYRAIVVLLGMGEESWSLVRNHLHKELTSWSEECGSNVFPSLFLMMPKTQVKESRVKNQRVVQSKQVSRIKESSIQIQD

SEQ ID NO: 116338 - protein, 145 aa, Glycine max
  Coding DNA Sequence Number=SeqID_24653
  Subcellular localization annotation: CTP_CleavageSite=27; ConfidenceScore=5.09e-01
MLLSSNVIYVCVRVVMLVRMIRTRLFAAARVKSCPGGGPGRVSKETCTGPLPGGSSPRRVVPLKFEGTCPFQRRGSVVLDGEDVSPLKPYKGERHMYPLDGEGVLAPLKLKARTYSPLEVRACSPLMVRTCSPLKARTCSPLTVR

SEQ ID NO: 116339 - protein, 123 aa, Glycine max
  Coding DNA Sequence Number=SeqID_24654
VYGFNPLTPLDLLPMPNVSVFKHKEDAESDLRTNPSQEVENDEDMTKSKGKDPLEGLGGPMTRARARKAKEALQQVLSILFEYKPKIQGEKSKVVSFVIRAPIGNLGISLLGDQMVADLLAVG

SEQ ID NO: 116340 - protein, 40 aa, Glycine max
  Coding DNA Sequence Number=SeqID_24655
GMVGLMIESAQPLLLKWEQLIESQGSATAEVKVDVNLGIL

SEQ ID NO: 116341 - protein, 173 aa, Glycine max
  Coding DNA Sequence Number=SeqID_24656
MSKSFEFGMTGSLDESISCFLIRMDPRRTACPHLQRATRPRHQRTACPHLQRATRPRHQRTACPHLQRVTRPRHQRTACPHLRLHALTLRGLHVLANVGLHALTFRGLHVLANRGLHALTFRGLHILAFRGLHVLTLRGLHVLALRGLHILALRGLHVLTIRGLHALTSRGLH

SEQ ID NO: 116342 - protein, 42 aa, Glycine max
  Coding DNA Sequence Number=SeqID_24657
MVWPHRSEMNWWCCYGTTKTSSLGRSKIFAFRVTTLYNIDCC

SEQ ID NO: 116343 - protein, 118 aa, Glycine max
  Coding DNA Sequence Number=SeqID_24658
MPIPWHDSTHCYFIGTSQRNPHARTLQQPVEWILPTPTPYRLMEPVQVIEVSSSEEDPEEDPEELPPEPAVDALDLPEDDEDPLLDVDFPEDIMSASEADSIEDSGLGGTANSEDSSS

SEQ ID NO: 116344 - protein, 100 aa, Glycine max
  Coding DNA Sequence Number=SeqID_24659
MERKRERRRHFKEKMSLEEAHHHRRPWIRAWRKKEMNEGRGREELVLNEGDSPGSPSILTLFICPSFLIRPSRMTKFASFQTHIDPFTGKDQIRKALKGA

SEQ ID NO: 116345 - protein, 60 aa, Glycine max
  Coding DNA Sequence Number=SeqID_24660
  Subcellular localization annotation: CTP_CleavageSite=21; ConfidenceScore=5.01e-01
MVLVAAIGTALTSIISFMLIMASIIVTICSFKASMSALICSCTSSISLITLALARIWTWG

SEQ ID NO: 116346 - protein, 503 aa, Glycine max
  Coding DNA Sequence Number=SeqID_24661
  Gene Ontology: Mol. function=deoxyribonuclease IV (phage-T4-induced) activity; Cellular component=intracellular; Biological process =response to DNA damage stimulus
  Homolog annotation: Hit_ID=A8GGT5; Match level="QueryCoverage=33%, HitCoverage=61%, E-value=2e-77, Identity=84%"; Hit description =Probable endonuclease 4
  Pfam annotation: Domain name=AP_endonuc_2; Domain location=348-503; Score=72.3; E_value=1.7e-18; Accession=PF01261.15; Description=AP endonuclease family 2
  Pfam annotation: Domain name=Asp-Al_Ex; Domain location=46-187; Score= -62.5; E_value=0.03; Accession=PF06826.3; Description=Predicted Permease Membrane Region
  Pfam annotation: Domain name=Cons_hypoth698; Domain location=18-337; Score=333.8; E_value=3.1e-97; Accession=PF03601.5; Description =Conserved hypothetical protein 698
  Pfam module annotation: Pfam domain module=AP_endonuc_2::Asp-Al _Ex::Cons_hypoth698; Domain location=348-503::46-187::18-337
MAELSVNKTPFHVHRWLPGLLLTAAIAAGAAWLASQPWLAGAGFGALTLAIIIGIVLGNSLYPRVATPCDSGVLLAKQRLLRLGIILYGFRITVQQIADVGVSGVLIDVLVLSSTFLITCLIGIRLLKMDRETVWLIGAGSSICGAAAVLASEPVIKAAPSKVAVAVATVVLFGTVGIVLYPFIWTLLPQVSAQHFGVFTGSTLHEVAQVVAAGHAMGAETENTAVIAKMLRVMMLAPFLLILGSWLQRQPSHQPGESAAGDGDGGAGLNHPFRRAEAGGRQTAAAWSADVYLADSRRRRTECAGATFHGVSASAIMGVLHQQSPIQESGMKYIGAHVSASGGVDQAVIRAHEIEATAFALFTKNQRQWKAAPLSAQVIDAFKTACDQYNFSAAQILPHDSYLINLGHPVMDALEKSREAFIDEMQRAEQLGLTLLNFHPGSHLQQIDEDACLKRIAESINIALDKTHNVVAVIENTAGQGSNLGFRFEHLAAIIDHVEDKRI

SEQ ID NO: 116347 - protein, 15 aa, Glycine max
  Coding DNA Sequence Number=SeqID_24662
DGFSENDNYNEYASS

SEQ ID NO: 116348 - protein, 65 aa, Glycine max
  Coding DNA Sequence Number=SeqID_24663
MYSCFGSICRNLPFGGRVMRGLTSASSKKGKCAESPPTFIRGKRQKNQKGKVLAPHAPITKDDNL

SEQ ID NO: 116349 - protein, 132 aa, Glycine max
  Coding DNA Sequence Number=SeqID_24664
LTSYPELRRSKFLIGGYVGAKASLLSTTPLFVTMTQELVARGDTLRLSAPRHLVSPSVIDEQRPMWSSVPFPEMSASSGGDFFKSHKGQYGDSAPFCHPEAAGPMTRRGQCGHSAPFCHLEAAGPMTRRGQC

SEQ ID NO: 116350 - protein, 128 aa, Glycine max
  Coding DNA Sequence Number=SeqID_24665
MGSFGEAGWEWEFSWRRNLFDNELGRASAFIEQATTLSPNAALKDYWVWGADPKGIFTTRTAYLCIKGDQPIGYLNRGFSQLWEIKVPPRALSFAWRLLWDRRWHLLCIFVAKRIHQTAPYKPMGYPI

SEQ ID NO: 116351 - protein, 40 aa, Glycine max
  Coding DNA Sequence Number=SeqID_24666
QARKTQNPPFSYSSRPGLRPGSLDRNPKHENFEKENDALP

SEQ ID NO: 116352 - protein, 67 aa, Glycine max
  Coding DNA Sequence Number=SeqID_24667
MATKMKRCPFEALGSMAPITSMPHIENGHGAAKTFNGAGGELTLSTKVYHPPPPLLSNNNMQAHHYI

SEQ ID NO: 116353 - protein, 160 aa, Glycine max
  Coding DNA Sequence Number=SeqID_24668
MKEGIGHILDLTPIVEKRKESLKRLTLTSHTSMGRTMSHYFSMPHQDIYSSQDEATISPSSSESEEAKKEESSEEIYPHEEGQPLMVKEECKEVSVSSKRLAKKKSHFEIKTNIKETSPLRQPPHLLLCKKTLVSTATPLGLEVIPQVKELLDEGLGPIR

SEQ ID NO: 116354 - protein, 165 aa, Glycine max
  Coding DNA Sequence Number=SeqID_24669
  Gene Ontology: Mol. function=peptidase activity; Biological process =DNA integration
  Homolog annotation: Hit_ID=Q8H6W2; Match level="QueryCoverage=55%, HitCoverage=98%, E-value=3e-15, Identity=50%"; Hit description=Gag -protease polyprotein-like protein
MASSNYLFPEGNSINRPPIFNGVGYHYWKTRIQIFIEAIDLKIWEAIEIGPYISTMVARDTTIEKPSEDRSEEERILVQYNLKAKNIITSALGMDEYFREHEMELQRLNQHEENDKKKKGIALKASSSIQEELCLFVKRFNKFLRMRETQRTQNFKPKRRIEESS

SEQ ID NO: 116355 - protein, 53 aa, Glycine max
  Coding DNA Sequence Number=SeqID_24670
GIAQAEGHPPIGKSAEGAGVQALVNEWQGRMVLFGNLVQPPIVNADPPTVLHP

SEQ ID NO: 116356 - protein, 250 aa, Glycine max
  Coding DNA Sequence Number=SeqID_24671
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=98%, HitCoverage=35%, E-value=1e-125, Identity=92%"; Hit description=DNA -directed RNA polymerase subunit beta'
  Pfam annotation: Domain name=RNA_pol_Rpb1_1; Domain location=7-236; Score=-46.2; E_value=4.3e-09; Accession=PF04997.3; Description=RNA polymerase Rpb1, domain 1
MDWILSQFFVARPVVKKPTFLRLRGSFEYEIQSWKHSIPLFFTTQGFDIFRNREISSGAGAIREQLADLDLRILMDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIV

SEQ ID NO: 116357 - protein, 158 aa, Glycine max
  Coding DNA Sequence Number=SeqID_24672
MASKKRKSIGARPTAQYDTRWFHLLDAWNRYTDNVLGRNILPERKVDIYHTEFEDFKTELERRNLHKRLTNLADRTIDLALVEDVNLYSSEGPSPKQARVRGHQVKIDADSLNTFLETPVVLEEGETLPTYSRYCRLPTNYREIEAALCIPRRVHPEC

SEQ ID NO: 116358 - protein, 159 aa, Glycine max
  Coding DNA Sequence Number=SeqID_24673
MHHSHTSMLFIGCIAHCILSLKKNELNHCYQRKAHALWRPYRTRARARVIGEVEEVQEYMKAGMEAMKEQMATMMEAMMSMKKIMKANAVAIAATSAVAKVNPMPPSGLNQMNHSTSNMVCKDMGSTGGPHYAQIQNKHAFPPYGLPPNYTLPNVAYTP

SEQ ID NO: 116359 - protein, 140 aa, Glycine max
  Coding DNA Sequence Number=SeqID_24674
  Homolog annotation: Hit_ID=UPI0000ECBAF8; Match level="QueryCoverage =29%, HitCoverage=48%, E-value=1e-16, Identity=100%"; Hit description= UPI0000ECBAF8 related cluster
KRKSAQYANRLSPRVGRFINAAGTTGFPTGKRAVSATQLIYDHDYEFELGTRRRLGHVIALQETRALLLHWLGQSEACSRSHALQVKGMQAWHWPSFYNVVTGKTLALPNLIALQHIPLSPAGVIAKRPAPIALPNSCAA

SEQ ID NO: 116360 - protein, 284 aa, Glycine max
  Coding DNA Sequence Number=SeqID_24675
  Gene Ontology: Mol. function=sequence-specific DNA binding
  Homolog annotation: Hit_ID=A9CKT7; Match level="QueryCoverage=57%, HitCoverage=86%, E-value=1e-68, Identity=80%"; Hit description =Putative uncharacterized protein
  Pfam annotation: Domain name=HTH_3; Domain location=159-214; Score =45.9; E_value=1.4e-10; Accession=PF01381.13; Description=Helix-turn -helix
  Pfam annotation: Domain name=Smr; Domain location=82-165; Score=91.6; E_value=2.4e-24; Accession=PF01713.12; Description=Smr domain
  Pfam module annotation: Pfam domain module=HTH_3::Smr; Domain location=159-214::82-165
VAKTTRPISGRLEDLLAFDDVEDPAGEPDVSLTGKDTFPRILAEPAEPPPPAPDKKPKIHQPMEKPVKRKLTRGRLPLEGRIDLHGMFQSEAHAVLLDFLLRAHERGLRHVLVITGKGRSIGSDGALKRAVPMWFSKPEYRHLISSYEDASANHGGDGALYLRERKGVTQKQMAAAIGVSPAYLSALEHGKRGKPSFDLLQRIAGYFNIIWDEAEELFFLAGSSDPKGGDRHSRPAAAIYGFRQPVGTGYSQAAAECGRGTVSRAAKKPFLRLKPLYPLLYAAS

SEQ ID NO: 116361 - protein, 131 aa, Glycine max
  Coding DNA Sequence Number=SeqID_24676
MGPILSEPQRPFVGGCTKKSIGHPEAKHCPPRVVSWGIRWRSRSQGSFVAHGRQDVLTAAIRQPEHPGHVRSAGASVMIKKYFGPTPRTSHTSSSMAPEDLEQLMQKIRDQLEESITEKVTRQLMLSFNQM

SEQ ID NO: 116362 - protein, 180 aa, Glycine max
  Coding DNA Sequence Number=SeqID_24677
  Subcellular localization annotation: CTP_CleavageSite=76; ConfidenceScore=5.49e-01
MPISPCGSISWSVPSRHRDRTHKTPSGPGKVQQGPGVSSSGYGPLSVLQGARTPPARSRHHRDRACKTPSGPEEVQQEYLSPPARASGPLLIELSSRSTASPGRRRAKHRSSLRMAGSGNRRTAITSRVHLSSSAKRLERCLRHMADQQATKSKAKGKQSTRSMTYKPSCVQLKTLKKRY

SEQ ID NO: 116363 - protein, 71 aa, Glycine max
  Coding DNA Sequence Number=SeqID_24678
MAIHLYQNFYPQCTRNWLAVDESSKIQSTKSFDLWTASVVVKAVMAQRNHSQGMTPMGALPHKSIRIFVQE

SEQ ID NO: 116364 - protein, 175 aa, Glycine max
  Coding DNA Sequence Number=SeqID_24679
MDMNLGSFISSQIILMAQHDSSRLCLPALITALCKARGVHSDSLTHERLSPTINLAYIKKNCWNIDDPIVTFKRPSKAKGKRSEAPPSSELGDQPSSSRGGGASTAQEPDTKEPPTPVAVEEETTLDQTPQPSPAPAHIPKDAAPVVEPKQLIQDSSAAPTLDLNEDQPQEESDV

SEQ ID NO: 116365 - protein, 111 aa, Glycine max
  Coding DNA Sequence Number=SeqID_24680
MPYDHDDSMPYENALLKFNSRQKFKNTRYNIKKISSVLGREFQIETAKELVKGFCKILELSSGLFGDWTYAQGCGRTRNWKGKLVPSLEDFESRSKGPTTLRAIGLRSTPN

SEQ ID NO: 116366 - protein, 120 aa, Glycine max
  Coding DNA Sequence Number=SeqID_24681
MSPSPLGSHNHSQTHLKLSERLPLRIPVSADLHTAKSLRTLWNLDLSLSRTFVHAELLKKSGLVRARALSADLDRLARISGFWLSTLVLLSGLTEVVRLANLTTHLLLDSSLRLATKGCA

SEQ ID NO: 116367 - protein, 41 aa, Glycine max
  Coding DNA Sequence Number=SeqID_24682
KETPFAEAALMEIPHQVVFLPVLVGAFLNQYFQSLVIFGMQ

SEQ ID NO: 116368 - protein, 313 aa, Glycine max
  Coding DNA Sequence Number=SeqID_24683
  Homolog annotation: Hit_ID=Q2SJR5; Match level="QueryCoverage=99%, HitCoverage=70%, E-value=4e-74, Identity=46%"; Hit description=McrBC 5-methylcytosine restriction system component
MDLGIVSEATLSWLEQLQQTWSGTSQILSREGKRFLRLGSYVGYLQSPNGESIEILPKTTFEAPTEVDPLRQLLRRMLSASLGITPREANQAALQRSEQPLHEWIISEFLRHLADLVRKGLRFDYHLIEDEHSAFIRGQLNVTAQMRMPPGRGTHFHVRYAEFSPQRIENRLLRTALDWALKMTRQGQSWRLANSLSHQLDGIEPICGNTTQSLRQWSDGKYLLDYRAIKPWCQLILEQMNPDFQHGPHQGISLLFPMERLYEGWVGYGLAGALHHDFKLIEQTKSQYMLEHVPVGEESYQRWFMLKPDFLIN

SEQ ID NO: 116369 - protein, 119 aa, Glycine max
  Coding DNA Sequence Number=SeqID_24684
MGKLDHLEERLRAIEGGCNYKTCAKRGHESFKEYAQSGETRQLKWHLMTKMMTMIVDTLPSILLWKMVGYTPSSFADLVFVGVMIKVGLKRGKSDHFALINAKKLGQVKRMRRREKPML

SEQ ID NO: 116370 - protein, 105 aa, Glycine max
  Coding DNA Sequence Number=SeqID_24685
MVKQSCLAHLDMYWDQGSSNVLDVQDDTVFITILIASWPGLVFALHSSGHSSFQRRDLGPLGGKHRAGSKSAYFIGIGSKGIVADGIAVEDIVVEGIVVEGIVVE

SEQ ID NO: 116371 - protein, 91 aa, Glycine max
  Coding DNA Sequence Number=SeqID_24686
MYASARVFRSHNTPLFCQTLDQQCQLLFDRASRIPVQILDNVLMAYLLCGEEMMRGLDQSEFFWSPRRNKSALGRTHSEILRSVGKCRRLD

SEQ ID NO: 116372 - protein, 83 aa, Glycine max
  Coding DNA Sequence Number=SeqID_24687
LCQFYGVPITSSKGIRPPTNRAFIKKYCVPRQAQGETPQQPGDGRQRATGAPPSPQLIHKKVRALLTTNRRPSPKPKVIVGHT

SEQ ID NO: 116373 - protein, 30 aa, Glycine max
  Coding DNA Sequence Number=SeqID_24688
GSPYSSRPGLRPGSLDRNPKMKRETKNITT

SEQ ID NO: 116374 - protein, 41 aa, Glycine max
  Coding DNA Sequence Number=SeqID_24689
MEATPFMLGDLGMVYYGMIPHSSRCLAKGPGCCSPEPSYLP

SEQ ID NO: 116375 - protein, 127 aa, Glycine max
  Coding DNA Sequence Number=SeqID_24690
MGTNQTGKRFYQVKVKSLDTTSIKELGRLMEPLQMQAFRKTYGKILELTIAEVSIGAIASLTQYYDQPLRCFTFGDFQLGKKTIPFLRVSPLFEQNCNCGQGFSKRFGPHKTDSKRHSGPTTEVPRR

SEQ ID NO: 116376 - protein, 224 aa, Glycine max
  Coding DNA Sequence Number=SeqID_24691
MARGGTGPMGSMRRPSPSCYVYRGKILPGLLPGDSNILPSDHNSDLPLPKCQLVYAILTRMSIHVDQLIADAIYIFAGMAPTRHPLDPDKSNRALGFPALITGLCQSFGVPVAPSKVIRPPITRAFIEKYCTQRQVQGDAPQAADALPPHQAGPARSFDTEQYLRHFVRQQAANHRAHPVGPGLYFFPCLTLDQFRVEVAWPGDWPAALAGEAPADGPAEAPDE

SEQ ID NO: 116377 - protein, 178 aa, Glycine max
  Coding DNA Sequence Number=SeqID_24692
MKDKRDQEEKLENQKIKKDSKALSSKAKGKEKEEKDSSNKIVKKENHFATKCDIKRALFLKQSFYLLLSRETSLSTAIPLELEVIPQVNELLDKGLIHKSLNPYVLLVPKIGIMRHQIPMIGGMMNVLSGATLFCKITHPPNIFMICVHRDSLGRAFHDPKKIKVIPKWPTPPSIREI

SEQ ID NO: 116378 - protein, 221 aa, Glycine max
  Coding DNA Sequence Number=SeqID_24693
MGDFISRLSFPENNETFSSLTSYPELRRSEFLIAGYVGARASLLSTTPPFVAMTQELIRGDTLWLFAPFLSSRGGGPDDKQRPKTKFGHSAPMIRGDTLWLFAPFCHPEAAGPMTSRDQVWSFCTHDTRRYLMVIRTLLSSRGGRPDDKQRPKTKFGHSAPMIRGDTLWLFAPFCHPEAAGPMTSRDQVWSFCTHDTRRYLMVIRTLLSSRGGGPDDKQRP

SEQ ID NO: 116379 - protein, 82 aa, Glycine max
  Coding DNA Sequence Number=SeqID_24694
  Subcellular localization annotation: CTP_CleavageSite=65; ConfidenceScore=5.45e-01
MDTSEPYTGAMRGIVPKPQRTARPHLQRTARPRLQRTARPHLQRVARPRLQRATRPHLQRTTRPRLQRVMYLHLQRTTRPCL

SEQ ID NO: 116380 - protein, 163 aa, Glycine max
  Coding DNA Sequence Number=SeqID_24695
  Homolog annotation: Hit_ID=Q5XM22; Match level="QueryCoverage=64%, HitCoverage=83%, E-value=1e-11, Identity=32%"; Hit description =Resistance-like protein HAAS-2
MVTTEAAKAETGQCHGPYVRMQWVGDIYEYRYQAGHWTTAAHAFLLHLLGCTLFANKSATHVRLGSSCAGHMYDHLNDASISTSRQLGGYITLLQCWIYKHFPLVAESTADPNYAPRPTLDFGFLLDPIWGAPTERVMRQFGYTQTIPAPPADSWVSFDDIHD

SEQ ID NO: 116381 - protein, 116 aa, Glycine max
  Coding DNA Sequence Number=SeqID_24696
MLSFSQMQSQFQSQMQSLGLALPPELEVGPSAARVSTKESCVDPSRNNPDTGDSEKYGLYIKENLPHLVALGRLYEGSTTVHNIPLRHDQVKVGVEEVRDADAPIPVPTQEVLLVG

SEQ ID NO: 116382 - protein, 106 aa, Glycine max
  Coding DNA Sequence Number=SeqID_24697
MVTSRKTTKVRPGFVLNRNCKTSLEDSASVEGFLSMWGFNGEQWRCFVKDPNGQIVEKCSLKLQTKFREDPTVKEGWTAFLPRKLHVASLRSFIKRLPQEAFSWLL

SEQ ID NO: 116383 - protein, 199 aa, Glycine max
  Coding DNA Sequence Number=SeqID_24698
  Gene Ontology: Mol. function=phosphoribosylanthranilate isomerase activity; Cellular component=chloroplast; Biological process =tryptophan metabolic process
  Homolog annotation: Hit_ID=A8GF81; Match level="QueryCoverage=100%, HitCoverage=43%, E-value=1e-100, Identity=92%"; Hit description =Indole-3-glycerol-phosphate synthase/phosphoribosylanthranilate isomerase
  Pfam annotation: Domain name=IGPS; Domain location=5-199; Score =315.5; E_value=9.8e-92; Accession=PF00218.12; Description=Indole-3 -glycerol phosphate synthase
MQETVLHKIVRDKAQWIAARQQQQPLAGFQNDIVPSERSFYHALQGTRTAFILECKKASPSKGLIRENFDPVEIATVYKDFASAISVLTDEKYFQGSFDFLPLVSKTVSQPVLCKDFIIDPYQIYLARYYQADAILLMLSVLTDEQYRQLAAVAHSLNMGVLTEVISEEELQRAIALEARVVGINNRDLRDLSIDLNRT

SEQ ID NO: 116384 - protein, 48 aa, Glycine max
  Coding DNA Sequence Number=SeqID_24699
MTKASQKGVRKEKGGDVCHQARPGELGCFFRSNRFWRTSWKAQVGLCY

SEQ ID NO: 116385 - protein, 311 aa, Glycine max
  Coding DNA Sequence Number=SeqID_24700
  Homolog annotation: Hit_ID=Q6WAY4; Match level="QueryCoverage=93%, HitCoverage=50%, E-value=5e-36, Identity=34%"; Hit description =Putative uncharacterized protein
MGTNLNGKRFYQVKIKGLDVTSLKELGRLMGPLQRQAFRKVYGKILDLTIVEVFTEAAVSLAQYYDQPLRCFTFGDFQIVPTVEEFEEILGCPLGGRKTYLFSGFLPNLSKIATVVGYSARESDRMKQTRNGVVGLPRKYLEGKARDMASQEEWVPFADILALLIFGVVLFPNVDGLVDLAAIDAFLAYHHSKESPVVAILADLFDTFDRRCEKNSARIVCYLPALCVWLVSHLFQQDIRHPCPFQSYRSCVEKRRVDWDQYLAGIGGSTINWFPRWKEGKEGVLFSCGDYPNIPLIGTRGCINYNPILAI

SEQ ID NO: 116386 - protein, 139 aa, Glycine max
  Coding DNA Sequence Number=SeqID_24701
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=69%, HitCoverage=9%, E-value=6e-40, Identity=85%"; Hit description=DNA -directed RNA polymerase subunit beta
  Pfam annotation: Domain name=RNA_pol_Rpb2_7; Domain location=54-127; Score=119.8; E_value=8.2e-33; Accession=PF04560.11; Description=RNA polymerase Rpb2, domain 7
MRSECLICKIGRPVDMVFIHLGVLTNECRKYLNVARVSRSNNIRGRAKAGSDNVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 116387 - protein, 48 aa, Glycine max
  Coding DNA Sequence Number=SeqID_24702
DPEALGNDHSLISTMLMQSYPVKALARRLQVDWARDPRKGPRVLMNLR

SEQ ID NO: 116388 - protein, 144 aa, Glycine max
  Coding DNA Sequence Number=SeqID_24703
MASNKRKAPSTPTQAKFDRSQKLLPERNVVVYYTEFDKFKEELERRHWDEKLTDFADGCIDIAIVKEFYMNLYDPKDKSPKQVRVRGHLVKFDKDTLNTFLKTPVVLEEGENLCTYSMFALLRPNPQELAAKLCIPGRGFKGIL

SEQ ID NO: 116389 - protein, 160 aa, Glycine max
  Coding DNA Sequence Number=SeqID_24704
  Homolog annotation: Hit_ID=A0ST23; Match level="QueryCoverage=28%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPSWNQHPYPKSINIDYRMQSRGTELEFVIMVIAVSFGKPVVPAALMNRPTRGERRFAYWALFRFLAH

SEQ ID NO: 116390 - protein, 189 aa, Glycine max
  Coding DNA Sequence Number=SeqID_24705
  Homolog annotation: Hit_ID=UPI00006A2939; Match level="QueryCoverage =87%, HitCoverage=76%, E-value=5e-08, Identity=28%"; Hit description =UPI00006A2939 related cluster
QRTTRLTSEDYTSSPSEDYASSLRGLHVLTFRGLHVLTFRGLHALAIRGLHVLTFVGLHALTFRGLHVLTNRGLHALTLRGLHVLTIRGLHALTSRGLHVLALRGLPALALGLHALATRGLHVLTFVGLHALTFRGLHVLANRGLHALTFGGLHVLTIRGLHVLTIRGLRALTSEDYTSSPSEDYASSP

SEQ ID NO: 116391 - protein, 123 aa, Glycine max
  Coding DNA Sequence Number=SeqID_24706
  Subcellular localization annotation: CTP_CleavageSite=36; ConfidenceScore=5.10e-01
MTSGGIDPPRPPSHDSSGKAIIAKKRRYMVRLLPPRDSLTSSTHPRLLCLSQLGLPMLDLHHLHLGLKLDHLHLMLMHVNHLRYLHPHHLHPLLMHVDCLQYLYPHLPHPRLFHPSKFKGLNG

SEQ ID NO: 116392 - protein, 154 aa, Glycine max
  Coding DNA Sequence Number=SeqID_24707
MPRADKARQGASAGVGGCRGWLNYAASEQIVLRVRHMRCEIPHRCVRRKCRFRRHSPFRLRMCWEGRSVRASSLLRQLAKGGCAARRLSWVTPGHMATPLSSPPFELALSPSTSKRTRKATLLRSLSARPVGLERPPIHVDPNTRKVVGPYNDN

SEQ ID NO: 116393 - protein, 90 aa, Glycine max
  Coding DNA Sequence Number=SeqID_24708
  Homolog annotation: Hit_ID=UPI0000ECBAF8; Match level="QueryCoverage =45%, HitCoverage=48%, E-value=1e-16, Identity=100%"; Hit description= UPI0000ECBAF8 related cluster
MAGFATMKGVGNYGGVNGSNGELSPCINGLKNQSRPAGMQAWHWPSFYNVVTGKTLALPNLIALQHIPLSPAGVIAKRPAPIALPNSCAA

SEQ ID NO: 116394 - protein, 147 aa, Glycine max
  Coding DNA Sequence Number=SeqID_24709
  Homolog annotation: Hit_ID=A5BXJ6; Match level="QueryCoverage=87%, HitCoverage=15%, E-value=9e-14, Identity=39%"; Hit description =Putative uncharacterized protein
MMSYVSSGEENYEDFLDNINHQPLNESSIEHNQSPKVTSEVVAIAEDINDMSFISAQSAEVTSHTTDKGHDGLLEEDENGAEQRKEYVRKSICSVCECWEKAENEVTSLKNQVQTLTLRNSILEDRVTHLDSALKECVRQLRQTRCL

SEQ ID NO: 116395 - protein, 229 aa, Glycine max
  Coding DNA Sequence Number=SeqID_24710
MITSDDEGEVGDVLGDTNTNFSFSPELPNQKLSPSRTQRAEGGTDVRCCDLRPLGNIQADVTPKEKSKGTVEGMLGSSFGKLNLGDSFAGTEEEAANTKEVTCYNTLHDDRRHRNHIEGKYLNGGAKVAADQTFIGEEEGHVTQSLSPSLSGQIQQGIGPGCIKGPISTQGGCNKEDIHPVELLGVQAVQNQKEGGLSNDLGPILKTDGCHKKESLPVIQSIKRLQTVF

SEQ ID NO: 116396 - protein, 65 aa, Glycine max
  Coding DNA Sequence Number=SeqID_24711
MACLDHNNIWKGGTCLLRLLIGGSSHLSHETWDPQQMYLLLEKHNWNPLRCSHSLRPLTRCKVES

SEQ ID NO: 116397 - protein, 138 aa, Glycine max
  Coding DNA Sequence Number=SeqID_24712
MGKAEEVQEKMKADMEAMKEQMATMMEAMMSMKKIMEANAVIVAATSAVAKVNPMLPSSLKQMNHPNLKYADFEPCLGYAAEGQAVGGVPLQNTLEGPQYHPQPQPSCSTTSKNPRAMAEMEKLDHLEERLRAIEGIL

SEQ ID NO: 116398 - protein, 88 aa, Glycine max
  Coding DNA Sequence Number=SeqID_24713
MKSVTCGVPYGYPHLCQQGTNEAVDAQRLTSSSAPSVILTHEVRFLLSSSGDIQAQRRTRFLYVGWGAIKFDGVEKCPGCPTLSLSRH

SEQ ID NO: 116399 - protein, 100 aa, Glycine max
  Coding DNA Sequence Number=SeqID_24714
METFQVSRVIQNYVGHVTCTLVSSRGGGPDDTRRYLTVIRTLLSSRGGGPDDKQRPKAAGPMTSRDQVWSFCTHDTRRYLMVIRTLLSSRGGGPDDKQRP

SEQ ID NO: 116400 - protein, 204 aa, Glycine max
  Coding DNA Sequence Number=SeqID_24715
  Gene Ontology: Mol. function=transporter activity; Cellular component= integral to membrane; Biological process=transport
  Homolog annotation: Hit_ID=Q5PDB3; Match level="QueryCoverage=99%, HitCoverage=23%, E-value=2e-55, Identity=54%"; Hit description=Outer membrane usher protein
  Subcellular localization annotation: CTP_CleavageSite=90; ConfidenceScore=5.12e-01
MTANGASQDSRYNYSVTTSYSQSTAENLSQVSAYGSYNSDYGPLSLSASSDSQNSQQYSASYSGGAIIHGGGVTFTPGSIGENDALALIKASGAKGAHVSNSRGEISDSGYVVMPYLSAYRENRITLDTSTLTEDVAVENNSTVEVPRNGAVVMVDFKTNEGRSAVLELTRSDSGFIPLGADVMNEKGDIIGSVGQAGQAYVRG

SEQ ID NO: 116401 - protein, 809 aa, Glycine max
  Coding DNA Sequence Number=SeqID_24716
  Gene Ontology: Mol. function=metal ion binding
  Homolog annotation: Hit_ID=Q0WM72; Match level="QueryCoverage=79%, HitCoverage=88%, E-value=8e-94, Identity=37%"; Hit description =Putative uncharacterized protein At2g27950
  Subcellular localization annotation: CTP_CleavageSite=54; ConfidenceScore=5.01e-01
MAVAGVHNVAVQSTFLRESHSQSSGRQGDGGRGGTRSPSVLQMWREIEDEQVVRQVQGRPGEVQRSDGLVVDLSQENVPNSSNQREEHMIEDAVLGENDSETWSQSQNEFHDEQEELNNSSRETSSDFGVVERERVRQIFREWMNSGSRGHASNNSQGNNSRGEWLGETEQERVSATREWVQMSSHQRGVSSGENREEQSSENGTQIECVRDGFVVNQNEGQCQTEHTRRGIRKLWGRQVFLDMLKKAEMERQREVQELLDHRVVSHFPHRNRIQALLRGRFLRNDRSIDNNRSTSIAESELGLLRQKQTVSGLREGFVFRKDNFGCSHATSNTSDTSSENDIDVNTIEDTGASSSQAVPTVHSQQSEPNNRVSDGLEISGDQICSKGTICENLDWQGSTAHVEARDLESSFSTRVERGDGTGGNVDMMPTENPSNDCSQLSLQIEDTEHDNMHEFSEVHTEQSQRGDINNDESNFSNHDDRVYSNIVDDVDLIESIALEGEQQEEVIIENDGSDWHQSVDDIQLSSTTNEWPQNILGSEDGENSRMQEQEVPEVWQEDGGFQEAVEIWLGGPSDNEVAPVGRIHGFYFPEDDNVYSVELRELLSRRSVSNLLRSSFRESLDQLIQSYVERQGHAHVEWELQETTPSSPLAEQVSGQRSRGPIVGPQATVNSSLNRPLPPTPPPQPLWDRHSRHDNWSQSDINNQRLGIVRSFAGHNCFSLADEWDIVNDLRIDMVRLQQRMNNMQRMLEACMDMQLELQRSIRQEVSAALNRSTGSSDVGTCAHVQNVPMICSKVEESVQCVKHQWWK

SEQ ID NO: 116402 - protein, 102 aa, Glycine max
  Coding DNA Sequence Number=SeqID_24717
NSYDHDYEFELGTRFTVRITSEKPESFATLIHCDALSLVGLEWPVPHSESVKVLVPKWKKRAMPPSCHWSWKVVGRGKIGRGGGFWGQDAGTQKENLNWEIG

SEQ ID NO: 116403 - protein, 112 aa, Glycine max
  Coding DNA Sequence Number=SeqID_24718
  Homolog annotation: Hit_ID=Q1SN17; Match level="QueryCoverage=91%, HitCoverage=26%, E-value=1e-12, Identity=32%"; Hit description =Transposase, putative
MADSKKCGCPFKLQAKPILGGERWMVTLIYEKIIIGDMTKSMIKPKNILLTLKEHNVNSFTTMKQVYNARYAYRSSTRDSNSEMQQLMKLLKHDQYIHWYRLKDEDVVCDTF

SEQ ID NO: 116404 - protein, 287 aa, Glycine max
  Coding DNA Sequence Number=SeqID_24719
  Homolog annotation: Hit_ID=A2Q4P8; Match level="QueryCoverage=55%, HitCoverage=88%, E-value=2e-18, Identity=31%"; Hit description=IMP dehydrogenase/GMP reductase, related
  Pfam annotation: Domain name=DUF1723; Domain location=147-196; Score =58.7; E_value=1.9e-14; Accession=PF08330.1; Description=Protein of unknown function (DUF1723)
  Subcellular localization annotation: CTP_CleavageSite=22; ConfidenceScore=5.60e-01
MRRKRWPSIANRATKPATFTTKATTTSTSKKQTPIITSITSPMWNHIWGPRTSARRQWVATTVVVDVEHVDHAADEVHEEPREPVTNHVGADTKGFLGGSHDTSMLTSYVDHVIAKKVKKFGRFAPEIEGIMATTGLSYLITCSLENGDKGLLSTFVERWHKEISSFHLPIGELTITLDDVTSLLYLPITSAFHTFYGIDVEEVIDLLVELLEVSRQKEKDEIEQCYTLFANKSVIHINVVFLDALRDLSQFEGYSWGVAALVHMYDNLNVAFKHMIKHIAGYITLL

SEQ ID NO: 116405 - protein, 1046 aa, Glycine max
  Coding DNA Sequence Number=SeqID_24720
  Gene Ontology: Mol. function=nucleoside-triphosphatase activity; Cellular component=integral to membrane; Biological process=transport
  Homolog annotation: Hit_ID=Q9ZUU9; Match level="QueryCoverage=63%, HitCoverage=85%, E-value=0.0, Identity=64%"; Hit description=White -brown complex homolog protein 3
  Pfam annotation: Domain name=ABC2_membrane; Domain location=519-682; Score=15.5; E_value=0.00061; Accession=PF01061.15; Description=ABC-2 type transporter
  Pfam annotation: Domain name=ABC_tran; Domain location=136-363; Score= 68.4; E_value=2.4e-17; Accession=PF00005.18; Description=ABC transporter
  Pfam module annotation: Pfam domain module=ABC2_membrane::ABC_tran; Domain location=519-682::136-363
  Subcellular localization annotation: CTP_CleavageSite=17; ConfidenceScore=5.29e-01
MEEIQSQSDNYRSSSSSASSPASRVPSSNFFYLRKPGSLRHPISFEDSPEWEDTDIDARVEEGGDSINVATTPASPSLSKLNSGSLPSPHLPEGAVIPRKIAGASVAWKDLTITIKGKRKYSDKVIKSSTGYAIPGTMTVIMGPAKSGKSTLLRAIAGRLHPSARMYGEVFVNGAKSQMPYGSYCYCIVEFLGTAIATPSTIAAAMGVVVAVAADAACILHPLGYVERETTLIGSLTVREFLYYSALLQLPGFFCQKKSVVEDAIHAMSLGDHANKLIGGHCYMKGLPSGERRLVSIARELVMRPRILFIDEPLYHLDSVSALLMMVTLKRLASTGYTLIVTIYQSSTEVFGLFDHICLLSNGNTLFFGETLACLQHFSNAGFPCPIMQSPSDHFLRAINTDFDRIIAMCKNWQDDNGDFSSVNMDTAVAIRTLEATYKSSADAAAVETMILKLTEKMILLKYGTCTSHDSVRKEDQVRTVRQLFLLEEVGLRSIKGSLLGQGGEGPVLKSKGKASNATRIAVSTWRSLLVVSREWKYYWLHLILYMLLTLCIGTVFSGLGHSLSSVVLLSSIPFLFLISISSSLVFYFLVGLEDQFSLLMYFVLNFFMTLLVNEGLMLVVATLWQDVFWSVLTLLCIHVAMMLSAGYFRVRNALPGPVWMYPMSYIAFHTYSIQGLLENEYLGTSFAVGQESVCCVVVLLHCMRDLILFPRKTRFWWRPSMTTSFLNGERAVVVFFICRILYSLTFSLLSHGLALSLLALASFSLDISFDSSNSPSLFRTRPGASSGILLGAVTLPSLLLSKLVQLSREFSLAQLHLEEIQYLTLQYWATSASACSVVLFLAFARRRRAPSSPSHWGVRFSLCSIFFQALVSVAALATTSQIGLHPALKLMWALCHGLASVKLIQHFLRTFPSCASIGETFLVTSGIVLYFGDMLLLTIKKLHGLLMSSELVTAEYEISRSEISIIIQGLVLGLLLYPIALKYILQIWEWFISTASAEARRYCEIGRSLMFVASLGIVLILIVPSWMQFVHEFRMHPFFWYLINI

SEQ ID NO: 116406 - protein, 100 aa, Glycine max
  Coding DNA Sequence Number=SeqID_24721
MNRNPRSTKRDPSYWEYVDAFHSVQNSNSSVRRSASSSDQPNPRKDFIDNIVDVKPDGNCGYRSVLFGGMDKFEELRMSLLIDGLTKWMDITDMGYVIAS

SEQ ID NO: 116407 - protein, 1126 aa, Glycine max
  Coding DNA Sequence Number=SeqID_24722
  Homolog annotation: Hit_ID=A7PQP5; Match level="QueryCoverage=95%, HitCoverage=96%, E-value=0.0, Identity=55%"; Hit description =Chromosome chr6 scaffold_25, whole genome shotgun sequence
  Subcellular localization annotation: CTP_CleavageSite=44; ConfidenceScore=5.77e-01
MEPRNPSPSPSPVRVLIRPPSSSSSSPSSSSDHPSPAPAPSLPRSSDGVVVVGFIARRHDDSAQLLNRVIDSNVFASGNLDTPLLVDDEEAREWFERRRISYFHDHDKGILFLQFSSTRCPVNHAAAAPSGFDSAVEEHEFGDLQGMLFMFSGSHFGTGILRNFRVLQAAKHAMAPFVRYQTMGPLPSRSHPSPSSQPVSSVNNSSPGRGGGNLGRNMSAISLMSGLGSYASLFPGQCIPVTLFVFIDDFSSLSNSSANGEESLDGSSLNQSSSLSSAAKENLPAKGSGSVVVLARPASRSEGGFRKKLQLSLEAQIRFLVKKCRTLSGSEITHSGVRTGGTSTSAPLFSLDASRTVVLLDRSSNQRGVSLEFASGLIDDVLNGKATSDSLLLESHSQSASKEDLISVKEFVYRQSDILRGRGGLINTSSGSAAGAGMVAVAAAAAAASAASGKTFTTPDLPNLEVWSSSSRHILSGVLCAKGGCLDEFEIIKRKPRPRNTVSSTVEGSSKSTNPFDVAVSWLQSGRGLNTKFSTLWCQRAIPAAKEIYLKDLPACYPTSQHEAHLDKALHAFRSMVKGPAVELFAKKLEEECTSIWKSERQLCDAVSLTGKPCMHQRHDVETSNSDLGAPPMPHSSGYSFLHACACGRSQQLCPDPFDFESSDASCFSDCDKLLPAVKLTEIEVAGPVQSSAWSLLRIGGSKYYESSKGLLQSGFCATEKFLLKWTIYLEKKKIPNGSTEGIVKQVEDQGTSLDILKADDKKISFGSGFPIFKMRKPFSEVVAGSAAGDSGFPPLQQRKLLAPGSEKGMKQSRSSSQTVEQVSAVIDHEISQKSQHVSSTQGPLDVNANNICRDGDPFLRIGSNVVPLFLNGGEMNISHSLKHAIVYVGFEHECPCGHRFLLNAEHLTEVGSAYSLSEESHISSMEPAGRNQAFHTKVSKNASWNQVHRSSNEILSAISNKERDVNKSNQMIPNSDMNSDGDLQAISMDGDDLAFSMLNQNLPIYMMCPHCKHSRNNKDTPKVTPAFPVILATCPVVQFETSCLPPSVPDREQKLQFSLGCEVILPPESFLTLKLPFVYGVQLEDGNKHPLNPFEQQPEMTAWITKGTVLQILSKGNNDEGYQTQ

SEQ ID NO: 116408 - protein, 1006 aa, Glycine max
  Coding DNA Sequence Number=SeqID_24723
  Gene Ontology: Mol. function=metal ion binding; Biological process =metabolic process
  Homolog annotation: Hit_ID=Q6JJ55; Match level="QueryCoverage=99%, HitCoverage=100%, E-value=0.0, Identity=41%"; Hit description =Putative PHD zinc finger protein
  Pfam annotation: Domain name=PHD; Domain location=621-700; Score =16.5; E_value=0.00016; Accession=PF00628.20; Description=PHD-finger
  Pfam annotation: Domain name=PHD; Domain location=746-804; Score=6.7; E_value=0.0022; Accession=PF00628.20; Description=PHD-finger
  Pfam module annotation: Pfam domain module=PHD::PHD; Domain location =621-700::746-804
MAKGADSDEFVVLSRVRTGLKREFAFAMKAQSEICGGSLGRTRASKNRVEAPVQPPSARKRSRKSEEAKTLEDAMSEEEVKSDVVDLQSDDEPKNNNHVGESESAAMQVCEEEPKSDVVLETLISEEQPKMLEPESVISEEEPKVLDDVINEEEAIVAETLKEQEPIVPETLKEEVVDEMAEQPLCIEESEEKDSNGVALALVNDGAKGKKSMKKRLERPQSERRFTRSALKVKSEETNDGEHVGVAGISDGVKRETEAGASLVMTTPSSVKFSNRGKLKKFPAKLRDLLATGILEGLPVMYMKGVKAGWKDGEKGLQGVIQDSGVLCFCKICKGVEVVTPTVFELHAGSANKRPPEYIYIHDGNSGKTLRDVMNACCCCDFPLESMDEAVQKLLGDFTMKKSSICLNCRGACKGVSRLVCDSCLVSPAQTAVASNKGISQPVQPRSPEPVVIQKSLDNEVQPNSLHNEVQPNKLDTGMQPNSLDNGMEPDSLNNSMKPKSFSNGMKHSASRGKSQGRLTRKDLRLHKLVFEADVLPDGTELAYYAHGQKLLVGYKKGYGIFCTCCNEQVSASQFEAHAGWASRRKPYLHIYTSNGISLHELSISLSKDHRRFSNNDNDDLCIICEDGGDLLCCDGCPRAFHIGEIVKLHEVNMTSKLDTKTEPATGWQVPTVSYFTISDCVPLPCIPSGTWYCKYCQNVFQKDRHGQHEVNALAAAGRIAGPDILELMNKRCIRVVRTLEVDHGGCALCSRPNFSKSFGPQTVIICDQCEKEYHVGCLKDHNMENLEELPVGNWFCSGNCSQIHTALMDLVASKEKDVPDPLLNLIKKKHEEKSLDIGAGLDVKWRVINWKLDSDSVETRKLLSKAVAIFHERFDPIVDSTSGRDFIPAMLFGNIRGQDFSGIYCAVLTVNGDIVSAGVFRVFGLEIAELPLVATTADHQGQTLLGSLNVKNLVLPAADEAESIWTGKFGFTKLPQDEINKYKKFYRMMIFQGTSVLQKPVAEAL

SEQ ID NO: 116409 - protein, 91 aa, Glycine max
  Coding DNA Sequence Number=SeqID_24724
  Gene Ontology: Mol. function=catalytic activity; Biological process =biosynthetic process
  Homolog annotation: Hit_ID=A7PU86; Match level="QueryCoverage=56%, HitCoverage=17%, E-value=1e-12, Identity=66%"; Hit description =Chromosome chr7 scaffold_31, whole genome shotgun sequence
MWIPYMLPNTYIISVLPPNILRSPLIDHLEECGGGNVNSFQDPVCGSAHCALASYWSKKLGKCDFNAYQITSEQASPRGGVLNIHLDEQIQ

SEQ ID NO: 116410 - protein, 407 aa, Glycine max
  Coding DNA Sequence Number=SeqID_24725
MSVDPSSSLSRHVKWKMARTKRYGQMTSTAAQEISDKIILPFYELMLNPLQFQAKRRKGLVAGVSLSEAYGLTKYSVLTILYYLRDLVHFPISLPKSEQQALRGSNTSSSSITKQQLAKIINNLKEEWRKEVEEENKNLQEAWRRKVEEENKHSLEIIKQELKEAIKIELTQIASQHSPPVEAPNIQVLATRVSTKGSCVGAYTNPLGKEPSDVHVATVGLYVVGDQCTRLVALGKVYDNASIIHNVPCSDDVVRDSHMRGMGNAVDGVDPLGELVNNLFDVYQKPIELSWDGTKFGIPNVKGDFFITHADVMVHCMVSLSLSLYTTQKDRHQECQHYIETWVKESYWQVYLGPYLNHAMKTLTTSLEGKAHQPVPHWIEPKWFYDGIALDSETITTLRKKWAAYFL

SEQ ID NO: 116411 - protein, 274 aa, Glycine max
  Coding DNA Sequence Number=SeqID_24726
MVMDEIDVQTGLVVNVIEAVSEICGDLHSRHPRGEDGEVHVVFVAEAVGEGGAVVDEVVDEVDVVAGDGGAEELDDADVVAAADDGEELLELWSLELAAELALEDNDIGAAEGAAPARGGGGVAFGEEVVGGGTDFGEVIDVRVFGESVTEGEAIAGGAAVGCAVAAVGGGGVVGERDENAKLVKYRLKAQVEKDEGPSGEGQSPRVEKDEGPNLSSFTGSGVYPDLSSLTGSGVYPDLSSFTGSGVYHDLSSFTGSGVIQTFVACIKRSAPTQ

SEQ ID NO: 116412 - protein, 197 aa, Glycine max
  Coding DNA Sequence Number=SeqID_24727
MAHAQPEPIDGSLLRLQDNHISNQVLEDQERMIHQRYNFVWAFIHLDWIDSRVKNIITLAGFYHVINDGKVNINQHLLGLKIDGLSVTDIITDDQLPVDANDVFIAQHVRAHIMMLIGNYLRPDTLVLASLFRALDRVVKLDQIEIDGCHENEEDDDDGDDDDDNGGDHVLQQQHTIIREHPRTRGGRDRRPIGQQT

SEQ ID NO: 116413 - protein, 93 aa, Glycine max
  Coding DNA Sequence Number=SeqID_24728
MQRMKVNRRMESYELLAQRVLRANHGAFNELSGNECNGGGCLAHEHAQCNFHHKEAFRLNELEVLIPIRVKVHTKRRFCTQCIGTLSKETLAA

SEQ ID NO: 116414 - protein, 146 aa, Glycine max
  Coding DNA Sequence Number=SeqID_24729
  Homolog annotation: Hit_ID=A5AGU0; Match level="QueryCoverage=64%, HitCoverage=17%, E-value=2e-18, Identity=52%"; Hit description =Putative uncharacterized protein
MCRTSEELKSQDTEESSSSGNPKCVPQSVKASLTKQLPSECMRSPVSDGSRNSMDKTDGSGISPVPSNGSSKRITEPSSGFGRKQSKRVDSFREEERDLGVSSYSFQSLIDEFDFNSTGLLQELGLLFTAWGARSACGPNGPLLIL

SEQ ID NO: 116415 - protein, 132 aa, Glycine max
  Coding DNA Sequence Number=SeqID_24730
DGDYDGDNSGSVSVDDDNGEGKIVVATMVECGGGGMVVATATSMVGWNSGSDKDDNGGGGSNNGCSSGGDNDSGMNGGGGGGMMMVRELGQEMKLGLHHLSMTCCALKRREEVIVEGVDMPCSNTSLEQGEP

SEQ ID NO: 116416 - protein, 305 aa, Glycine max
  Coding DNA Sequence Number=SeqID_24731
  Homolog annotation: Hit_ID=A2Q4L4; Match level="QueryCoverage=21%, HitCoverage=9%, E-value=1e-08, Identity=39%"; Hit description=RNA -directed DNA polymerase
MLNELYVEGVWEDDPYRLKDEVFKFYDERFKEEVKEAGTLRGTLMSFMPMGSFQGVAIGPLYLSLQKWTFPRTWVNIGLSPLWVACINALMANEVVKKAKRRRKSCMIFKVDYEKVYVFVNWNILFYMLGSPTKEFKILKELRQRDPIAVFLFNVVMKGEGTYGGWKGLVGDVEHSSTWWKDLRKICRDLHESRWFDECVEWKEGRERRRRSKTWGSGMVRCRSGFLVGEEDLGFIENLVGVIRRYGGVKAREDTLSDLHIMVRKALPTGDNLGRRNIEGQESGCNCPFCWGIEESLDQILLCCE

SEQ ID NO: 116417 - protein, 1121 aa, Glycine max
  Coding DNA Sequence Number=SeqID_24732
  Gene Ontology: Mol. function=carbonate dehydratase activity; Cellular component=chromatin; Biological process=one-carbon compound metabolic process
  Homolog annotation: Hit_ID=A7NZL8; Match level="QueryCoverage=12%, HitCoverage=23%, E-value=1e-36, Identity=58%"; Hit description =Chromosome chr6 scaffold_3, whole genome shotgun sequence
MKFDNQELPVLTNEFHYPVKKGIICALYNFCIADNQGVPLLTKASPSRKGYTTFVLLSGPHRDLDQFKSFGYEDLAISAKSLLDYGCLESILIPPSDRFEGFNPSINEAINLIQEKMMDYIAIKITTCPNNFTVENYPCHVMRKEKKDKEIYEASGCHGQQTPPFPSTDFSMEDSSDIFCSGDIKDEEDVTPMLNCKYESHYGSAKQMVNGTCSSHNAKDEENNNRRVTRNSEKGKIKSHRNVSDTTGVRRSPRETSSKKNIPSPSSSTRKSGRLENRPPPAPVNKRKSERVEKKKPSPLRRSGRTRSQSSTGYSDSKSSGSVSSDPKPKKEKSVKQLIFEAKEVNGTEQHDLGTPQVKVKRMNARMYRSLFQLPKEEPNRIDNLNQGGNNGGGKIDECSGECHDFEEISKNGALPSEDGKSKEMRVDTGLSGSVKDLVENNMTLGSLAPSNVALPSEDGKSKEMRVDTGLSGPVKDLVEDTMTLDSLAPSNAATYETGLAPESIHPDYCREETLQVLVSSNSILDEDSIRNSVGDDRGENLIPSKSKEITVDVDSDVSAMLAKGDNCNLTPDASSLSRLGGYIMGTDCPSNATLYETGLLPERVQPDCCREETLPSSNSKNGVLPSEDGKSKETRVDSGLSVPVKDLVENTVTLGSLAPSTAATYVASLAPESFQTDYRREKGNSILDEEDLISNSVGHDSSGETLVPSKRKGIMVDMDSDVSAMLAKGDNCNLVPDSGSPSQLGGNIMGIDGSCSKRISEGELAIDPDFVLHGQKLKRREELDEKVRILMKGWDEGDCVEGEVGFGEDKVGLVEEEEELDMTTIQLTAESDYNPIDSESCIPSATELQDGDYIDASMLQKDSQIDNEKEPGLINNSNNSVTQLKERLSSHIGYRCKFVEYWVPVQISNLQLEQYCSILLSNASILRSSSKVDSVEAVRDVLISTRKCCSHPYLVGPELQPSLNKGLKPIEYLDFDLKASGKLQLLDSMLEELRKNDLRVVILFQVCKQRAERSGCWRAMGLLEILGLAVNNGCELGQITAVYMFVGYLAPAEVAQNCWKKWRDSTIQLPCLTHRQVKTIGIQKKNKEHVQLTEIAANRSTVQMMQDEHQLSANPQEMAE

SEQ ID NO: 116418 - protein, 122 aa, Glycine max
  Coding DNA Sequence Number=SeqID_24733
  Gene Ontology: Mol. function=identical protein binding; Biological process=negative regulation of catalytic activity
  Homolog annotation: Hit_ID=Q2HV70; Match level="QueryCoverage=68%, HitCoverage=19%, E-value=3e-15, Identity=36%"; Hit description =Proteinase inhibitor I9, subtilisin propeptide
MACPHAFGVVVLLKVVQPQWSPTAIRDYGYPSQYASPLSIGPGQMEPNKALVSALYNNKRRPIVHKFRRTMTNVGSGIATHRAKDSTRANPAIKYLRLRSLGANVVLLSLVMQGIFRGFSFV

SEQ ID NO: 116419 - protein, 190 aa, Glycine max
  Coding DNA Sequence Number=SeqID_24734
  Gene Ontology: Mol. function=calcium ion binding; Cellular component =mitochondrion; Biological process=protein amino acid dephosphorylatio n
  Homolog annotation: Hit_ID=Q9XGR4; Match level="QueryCoverage=84%, HitCoverage=49%, E-value=3e-32, Identity=39%"; Hit description =Protein phosphatase 2A 62 kDa B'' regulatory subunit
MVGSPARNLEEEVEDDFKPVLCELLATHPGLEFLQSTPKFQERYGLSSILVITLHLGFISGNGRLTLRELKCQNIIDVMLHADEEEDINKFWELDTDHDFLIDNENLIRYAFVEDAYFDSLQYYLKFPEGLPLFENILCQIIDMIGPEDESYITLRDLKGSKLSERENPTLAEWDALLVENILGFQWKKM

SEQ ID NO: 116420 - protein, 79 aa, Glycine max
  Coding DNA Sequence Number=SeqID_24735
MACDHGQSNSLTHPQGKNQVEDIGGGGCHISGRAHEPGQCITQKNSSREVNYMGAQNHHGFQGYNQGGPSGFNQGRNFT

SEQ ID NO: 116421 - protein, 55 aa, Glycine max
  Coding DNA Sequence Number=SeqID_24736
  Gene Ontology: Mol. function=hydrolase activity, acting on glycosyl bonds; Cellular component=beta-galactosidase complex; Biological process=carbohydrate metabolic process
  Homolog annotation: Hit_ID=Q6X0N7; Match level="QueryCoverage=56%, HitCoverage=3%, E-value=3e-09, Identity=90%"; Hit description=Beta -galactosidase
  Pfam annotation: Domain name=Gal_Lectin; Domain location=2-46; Score=- 6.0; E_value=0.017; Accession=PF02140.9; Description=Galactose binding lectin domain
MDASYKGQVTTHQHVKACQGKRSCSIKISDSVFGVDPCPGVVKTFSGSKMHITIE

SEQ ID NO: 116422 - protein, 237 aa, Glycine max
  Coding DNA Sequence Number=SeqID_24737
  Gene Ontology: Mol. function=protein disulfide oxidoreductase activity; Biological process=cell redox homeostasis
  Homolog annotation: Hit_ID=Q2HVR5; Match level="QueryCoverage=87%, HitCoverage=53%, E-value=7e-20, Identity=32%"; Hit description =Thioredoxin fold
MTFRSPKQFNSLYFHVNVNRHVDADPPLNDNGNDLRKLIAIANFDGGPQQKQNSMDSKWHSIDETTDQSWCYFFIQQMIENGIEWEGKMRKDNVVLYLTTLRGMTNTYKDCCHIRHILKGFGVEGWDCRQCLLRGTMLVELRKLSKRMMRGNIENLVNSCEKIEDDVDCEGPCQAYGDVRFQPCETCYGSCKIDYEVNKEEEYDGEANEEKVKAADDSLSKMHPLSEASAYLADRKP

SEQ ID NO: 116423 - protein, 179 aa, Glycine max
  Coding DNA Sequence Number=SeqID_24738
MTLHLLCTEFLKGSMDFKPMLVKGLMLWNDKWTRDSTKWTQGSQRIVIIKKGEIVEAMSFKIILMMPKNQELSKFQRFKNQVSRIKIQDSRFKNQVSRIKIQEQSRSRFKTQNSRIKRRLNSDKYQKKFFKTLSSTRIFHKIFYQRVLLSGNRLPERSNRLPVASIVFKTDLQSCNRLP

SEQ ID NO: 116424 - protein, 197 aa, Glycine max
  Coding DNA Sequence Number=SeqID_24739
MVIEQSLFFDLTQLSSDGVPFEGSLDDEWKFDFSVSDARWMVCTNQEDMTGRLLASSLAFECRIMHYLIVRILLLRSSNLAQPFVKVKRSFSIGANVVSSFGYRKERDGSWVKKDAPVQAAEDRSPSPHSQRNDSSSLMHRILERFDGLQTYVGERFDALERQVDTRFDKMDSRITKVEEDVVIIHDCLYLPPPPSV

SEQ ID NO: 116425 - protein, 761 aa, Glycine max
  Coding DNA Sequence Number=SeqID_24740
  Homolog annotation: Hit_ID=A7NZK6; Match level="QueryCoverage=97%, HitCoverage=99%, E-value=0.0, Identity=72%"; Hit description =Chromosome chr6 scaffold_3, whole genome shotgun sequence
  Pfam annotation: Domain name=DUF1336; Domain location=546-752; Score =403.0; E_value=4.5e-118; Accession=PF07059.3; Description=Protein of unknown function (DUF1336)
  Pfam annotation: Domain name=PH; Domain location=17-124; Score=38.0; E_value=3.3e-08; Accession=PF00169.20; Description=PH domain
  Pfam annotation: Domain name=START; Domain location=169-367; Score =16.1; E_value=8.2e-06; Accession=PF01852.10; Description=START domain
  Pfam module annotation: Pfam domain module=DUF1336::PH::START; Domain location=546-752::17-124::169-367
MASSGAATAALQSDASSRMEGWLYLIRFNRIGLQFSRKRYFVLDGNLLRSFKSVPVSNNQDPVRSAIVDSCIRVMDNGRESVNRKVFFIFTLYNTSNHNDQLKFGASRPEEAARWIQSFHEASLRGAPDGGDDAVGCSKRRWQSFRLSGSSSSISHPNSVDWTLSSADVIAPSPWTIFGCQNGLRLFKEAKDRDSNGKKWDDHPAIMAVGVVDGTSEAIFQTLMSLGPSRSEWDFCFYKGNVVEHLDGHTDIIHKQLFSDWLPWGMKRRDLLLRRYWRREDDGTYVILYHSVFHKKCPPQKGYVRACLKSGGYVISPVNKGKQSVVKHMLAIDWKCWRSYLKSSSAHSITIRMLGRVAALRELFKARLGNCSSSDYSSGELTRNSELHIKEEVIINSDTEIQADENNHDNSVGEVDQTQSEHACLVTLNDADDEFYDVPEPSDCDESENGWMTECSQQKSQGKKASLILGVGGGLFHSCMFYAYNNDIRHQKLSTAANFVKRLHDLAVQKRGYVDLQEMVREDSITCSYGSTLPQDPTCTLPCSLTETDPYTFLIRGENYLEDRQKVKAKGTLMKMVAADWVRSDKREDDLGGRPGSIAQKYAAQGGPEFFFIVNIQVPGSTTYSLALYYMMNTPVEDAPLLESFIKGDDAFRNSRFKLIPYISKGSWIVKQSVGKKACLVGQALEINYFQGSNYLELGVDIGSSTVARGVVSLVLGYLNHLVIEMAFLIQGNTREELPEFLLGTCRLNHLDASKAVCLTL

SEQ ID NO: 116426 - protein, 854 aa, Glycine max
  Coding DNA Sequence Number=SeqID_24741
  Gene Ontology: Mol. function=protein phosphatase binding; Cellular component=cytoplasm; Biological process=regulation of phosphoprotein phosphatase activity
  Homolog annotation: Hit_ID=A7NZK1; Match level="QueryCoverage=98%, HitCoverage=98%, E-value=0.0, Identity=65%"; Hit description =Chromosome chr6 scaffold_3, whole genome shotgun sequence
  Pfam annotation: Domain name=SAPS; Domain location=130-492; Score =497.1; E_value=2.1e-146; Accession=PF04499.6; Description=SIT4 phosphatase-associated protein
MAESFKRTTESATQVETILDKENFTLEELLDEEEVIQECKALNSRLINFLRDQAQVEQLLRYIIEEPPEDAENKRAFKFPFIACEIFTCEIDVILKTLVDDEELMNLLFSFLEPNRSHSTLLAGYFSKVVVCLMIRKTVPLMKYVQAHQNVFRQLVDLIGITSIMEVLVRLVGADDHMYHNFIDVMQWLAESNLLEMIVHKLSPSSPPEVHANAAETLCTITRNPSSTLAIKLSSPSFVAKILDHALEDSQSKSSLVNSLSVCVSLLDPKRSAISSPLFHSFRSQHMYEPPIPVNPDTIGAMLPKLSELLMLLNVSSDEKVLPTTYGELRPPLGKHRLKIVEFIAVLLKTGNEVAEKEMVNSGTIQRVIDLFFEYPYNNSLHHHVESIILSCLESKTNAIVEHLLQECNLIGRFLQADKRSTLSADINMPTVPAAGKQVPRAGNIGHITRIVNKLVHLAHNRNLILTCLQENSEWNEWQASVLQERNVVENVHRWACGRPTALQDRMRDSDDDELHDRDYDVAALANNLNQAFRYKIYGNEDNEEERGNLDRDDEDVYFDNDSAQVVISSLRLSDDQGSSLFTNSNWFEFQDDRIGDATGGTTSSEMMDEINLNGAANGGNSSDDEVVVGEDEELDESKNNLNGTSSSSTNLNGITGSDSMNGDTLNFESKKTSASHDMGFFRFEASDNEELFGDRPLPDWVGWGEPSDMQDAGSSKNPFIDHDDSSGSNLCTTKPQIDSPTPSPPSNGESVPSNRSPTKEDSIDGGVDSSQRAVPVPSLFEEDVEFVGVELEGTEKAMEQALKEGIVGEAGPLKRNMVSKVPEKESTDEGGPGIKEFNDANYWRVDQEVAVLE

SEQ ID NO: 116427 - protein, 287 aa, Glycine max
  Coding DNA Sequence Number=SeqID_24742
  Homolog annotation: Hit_ID=A5BSR3; Match level="QueryCoverage=56%, HitCoverage=43%, E-value=1e-09, Identity=32%"; Hit description =Putative uncharacterized protein
MLQVDSRGSTRAGRKSCCSEGLIWEDIQAEFEIPEAFDSRTKKKVFRLSASGGGRCAEKGTGHSEAKHHPHVLSRGGYDYLEQKFMAEKTKKRLEKVAQSGSTEGVIDPPSPIRRHVKWKMARTKKNGQMTFEAATEIVEKIDSLEEQASQGSFVCHRRQDLLTTTIGQPKHPGCVRATGAGVTIKQYFGSAPRSSRSSSFMPPEELEQLTQQIRDQLEESIIEKPDAILVAITDPIIGLALPPELEVGPSATCVSTKGSCVDPSPTDQRQVTQTNAGCTSKTILPS

SEQ ID NO: 116428 - protein, 846 aa, Glycine max
  Coding DNA Sequence Number=SeqID_24743
  Gene Ontology: Mol. function=hydrolase activity, acting on glycosyl bonds; Cellular component=beta-galactosidase complex; Biological process=carbohydrate metabolic process
  Homolog annotation: Hit_ID=A7NZH6; Match level="QueryCoverage=99%, HitCoverage=99%, E-value=0.0, Identity=72%"; Hit description=Beta -galactosidase
  Pfam annotation: Domain name=Gal_Lectin; Domain location=768-845; Score=128.1; E_value=2.5e-35; Accession=PF02140.9; Description =Galactose binding lectin domain
  Pfam annotation: Domain name=Glyco_hydro_2_N; Domain location=458 -579; Score=-50.9; E_value=0.019; Accession=PF02837.9; Description =Glycosyl hydrolases family 2, sugar binding domain
  Pfam annotation: Domain name=Glyco_hydro_35; Domain location=32-329; Score=599.4; E_value=3.5e-177; Accession=PF01301.10; Description =Glycosyl hydrolases family 35
  Pfam annotation: Domain name=Glyco_hydro_42; Domain location=54-353; Score=-238.8; E_value=0.01; Accession=PF02449.6; Description=Beta -galactosidase
  Pfam module annotation: Pfam domain module=Gal_Lectin::Glyco_hydro_2 _N::Glyco_hydro_35::Glyco_hydro_42; Domain location=768-845::458 -579::32-329::54-353
MRPAQIVLVLFWLLCIHTPKLFCANVEYDHRALVIDGKRRVLISGSIHYPRSTPEMWPDLIQKSKDGGLDVIETYVFWNLHEPVRGQYDFDGRKDLVKFVKTVAAAGLYVHLRIGPGFPVWLHFIPGIKFRTDNEPFKAEMKRFTAKIVDMIKQEKLYASQGGPVILSQIENEYGNIDTAYGAAGKSYIKWAATMATSLDTGVPWVMCLQADAPDPIINTWNGFYGDEFTPNSNTKPKMWTENWSGWFLVFGGAVPYRPVEDLAFAVARFFQRGGTFQNYYMYHGGTNFDRASGGPFIATSYDYDAPIDEYGIIRQPKWGHLKEVHKAIKLCEEALIATDPTITSLGPNLEAAVYKTGSVCAAFLANVGTKSDVTVNFSGNSYHLPAWSVSILPDCKSVVLNTAKCIGSQKHFCYLLVQEINSASAISSFTTESSKEDIGSSEASSTGWSWISEPVGISKTDSFSQTGLLEQINTTADKSDYLWYSLSIDYKADASSQTVLHIESLGHALHAFINGKLAGSQPGNSGKYKFTVDIPVTLVAGKNTIDLLSLTVGLQNYGAFFDTWGVGITGPVILKGFANGNTLDLSSQKWTYQVGLQGEDLGLSSGSSGQWNLQSTFPKNQPLTWYKTTFSAPSGSDPVAIDFTGMGKGEAWVNGQRIGRYWPTYVASDASCTDSCNYRGPYSASKCRKNCEKPSQTLYHVPRSWLKPSGNILVLFEERGGDPTQISFVTKQTESLCAHVSDSHPPPVDLWNSETESGRKVGPVLSLTCPHDNQVISSIKFASYGTPLGTCGNFYHGRCSSNKALSIVQKACIGSSSCSVGVSSDTFGDPCRGMAKSLAVEATCA

SEQ ID NO: 116429 - protein, 276 aa, Glycine max
  Coding DNA Sequence Number=SeqID_24744
MTFLGETSSQTIVNSIFDFILPNGSIVHNDNGVYFQTSTPVPFRVPNACNFQTLKTTIHNTLQLIDGQYFDEIYYRQPFTDIGNHLCFQRMQLKNDDDVNTMLICNHQFSSVGPIELLCTIGRTPEGLLNILEATMTLTHDALLYYNGKWNMRRQNEFVGYSFTRKNPKKFDIPFGCTMDKLKDLIKEVVPHGIPPYGIRETQTVRRLFFRQPSHYEYSDKIIKFEIIELKINDDVLKVLVHSNYWKKFEPIEILAAFSKHVIEMEDNMSMSLSQN

SEQ ID NO: 116430 - protein, 152 aa, Glycine max
  Coding DNA Sequence Number=SeqID_24745
  Homolog annotation: Hit_ID=A5B3H3; Match level="QueryCoverage=59%, HitCoverage=12%, E-value=2e-07, Identity=31%"; Hit description =Putative uncharacterized protein
  Subcellular localization annotation: CTP_CleavageSite=46; ConfidenceScore=5.24e-01
MGTPPASPSPSNVHLEAASRNTRRLTRLRRLTLRTLDQPRLTVNIDAATGQGLGPNKEIFHNYLRVVAREKIPIVHNSWKEVPDSLKELVWNDILAKFDIPEALNAKKKLMSSVATRWRPFKSSLTTKFVYSNYEGEQQEDPSLKYGLDPQA

SEQ ID NO: 116431 - protein, 54 aa, Glycine max
  Coding DNA Sequence Number=SeqID_24746
MAITITSIPDAAVYLQFIPPLPTDPENLFRYLDLVLTPLPLSKTSQASAFGKRG

SEQ ID NO: 116432 - protein, 210 aa, Glycine max
  Coding DNA Sequence Number=SeqID_24747
  Gene Ontology: Mol. function=metal ion binding
  Homolog annotation: Hit_ID=A5BSH1; Match level="QueryCoverage=87%, HitCoverage=24%, E-value=2e-32, Identity=44%"; Hit description =Putative uncharacterized protein
MSAHQKEKHNAPSSKPTVSHSLHKVDDPMKVTDENETLRASNNQWKRPNLQLEIPTRTSEESSQDLVRIRMPLTPSPTPSQKKVNFLATSRSVDAPRPTSSSTRAKSSMRNILPKFGFRNRAPSPDVEKVVTTAAQEGSFSGHQEKPSIPRSVSLTKMFTPKIKRTSSLPVEELGRANVESVLCGTLGASPCVRSLAYSCHYYTSVIQHR

SEQ ID NO: 116433 - protein, 152 aa, Glycine max
  Coding DNA Sequence Number=SeqID_24748
SCASRFLFFVPHCLWFLGVAALSAAVKVPASNVAVVGGGKRDEWMYEIMSKRADMDYENAESCGANEPHVDCSDAFKTSQVFECREDVLRWARSVAHENGFVAMILRSNTNTGVTSISVGKKNLSEEILRLGNVGVPSSFVASQWLEEKAGW

SEQ ID NO: 116434 - protein, 97 aa, Glycine max
  Coding DNA Sequence Number=SeqID_24749
MNEDQLMYDSIMSKEVDMNEQNGDEAVLATRDDVLHWAQSVTYEIGFVAVIMRSDTNSDSKQQPLKRRRKLTSTPKMARRWWRHPQRRQWKQRTAAT

SEQ ID NO: 116435 - protein, 443 aa, Glycine max
  Coding DNA Sequence Number=SeqID_24750
  Gene Ontology: Mol. function=DNA binding; Cellular component=nucleus; Biological process=regulation of transcription
  Homolog annotation: Hit_ID=A7NZJ4; Match level="QueryCoverage=26%, HitCoverage=76%, E-value=2e-25, Identity=52%"; Hit description =Chromosome chr6 scaffold_3, whole genome shotgun sequence
  Pfam annotation: Domain name=DUF584; Domain location=9-125; Score =120.0; E_value=6.8e-33; Accession=PF04520.4; Description=Protein of unknown function, DUF584
  Pfam annotation: Domain name=Myb_DNA-binding; Domain location=322 -368; Score=42.4; E_value=1.6e-09; Accession=PF00249.22; Description =Myb-like DNA-binding domain
  Pfam module annotation: Pfam domain module=DUF584::Myb_DNA-binding; Domain location=9-125::322-368
  Subcellular localization annotation: CTP_CleavageSite=34; ConfidenceScore=5.15e-01
MDTDSFSDSNFEFQESDLYNSARANSPEFRKSVRASRFHNYSSSGGRVGTPVSLPVNVPDWSKILGDEFGRNQRRNYDEAQSDEEDGDGRVPPHEFLAKTGIASFSVHEGVGRTLKGRDLSRLSDWTDYYAVMKIEMVNWLCYCGSRHSSRCSMQSSAYASFAKAVGKIIVIRFCPFDWRYSNRQGDVAHMQGSQAPERSRVAGKLFRRWEGTLICLPPDLSSLSNNFVPKVLPLSMSPPSETIATRVPPMLSPVEDATYVQPNLQDQLLALQNINSGNNTYDHPQTQFVNSATNQVAPMWPGSQINHSLSRKGSSSKSNECRRWSEEEHRLFLHELQKYGKGDWINISRIIKTRNPTQVASHAQKYFLRQASSNKGKRRSIHDMVLPDGPVPHRIYQQNGVSFPNLDGPITHHIDHQNEVPFQNLTMQELYEIHLAVPHYIN

SEQ ID NO: 116436 - protein, 241 aa, Glycine max
  Coding DNA Sequence Number=SeqID_24751
  Gene Ontology: Mol. function=catalytic activity; Biological process =cellular metabolic process
  Homolog annotation: Hit_ID=O64438; Match level="QueryCoverage=39%, HitCoverage=40%, E-value=2e-39, Identity=83%"; Hit description=ARG10
  Pfam annotation: Domain name=RNA_pol_III_C17; Domain location=6-115; Score=52.0; E_value=2e-12; Accession=PF09417.1; Description=RNA polymerase III subunit C17
MLCHSLEGNAGALTNFEVLDFLRAKEASKDPTRGIAKVAQSEYKVYDYLVDSAASVQTRESINEFLTSVKQHDLTKTEVLNILNIGPAADFELYPVIYYQTVFDKSTFTLFVASDQAGKVPLYWGITADGYVAFVDDAALLKGSCGKSLASFPLGCFYSIAVGGLRCYENPKNKIVAIPAKEEEIRGAFFKNRESVISPNSNIRLMSIETALGTKGKCEVILELKKLELNIHYVTRIANCN

SEQ ID NO: 116437 - protein, 468 aa, Glycine max
  Coding DNA Sequence Number=SeqID_24752
  Homolog annotation: Hit_ID=A2Q4S5; Match level="QueryCoverage=61%, HitCoverage=57%, E-value=8e-21, Identity=26%"; Hit description=IMP dehydrogenase/GMP reductase, putative
  Pfam annotation: Domain name=DUF1723; Domain location=114-163; Score =58.8; E_value=1.9e-14; Accession=PF08330.1; Description=Protein of unknown function (DUF1723)
MVRIRGLSRALGNVIGRVLGKEDVHDMDHADDEIHEQHEEIAADDVADAKGFSGEPHNTSVLQDYVYHVAAKERPEVKLSSHGRKVEKFGKPALGTSLVAATGLSPLITCSLDTRDQGLMSAFMERWHKETSTFRQSVGEVTITLDDVASLLHLPITGAFHTFEPLHMDDVMLLLVELHEVSVEEARAKTVQCHGAYVRLSWLQDVYRSKCDTVQWTLAAQAYLLHLLGCTLFVNKSATHVHMCCIYEHFPSIGSAVAAEDYERKPRTCHWKSGKTLLVLTYRRCLDRLMSNIVCWIPYGDHRAFREFETISPHSAAPSLCIEDIDDRWIQFFEYIALVGQICVALGKCSLDYMDWFYLISHPFMSPAQPGDPPIHPSVQHHDTFVEQDVAQHLVAAMAMDEAPEDAHVDVEQPRHVVEACQAIVERLERLLNLRIVTEGIEATLSPKNARGSQEVSLHNEMSTFDRD

SEQ ID NO: 116438 - protein, 37 aa, Glycine max
  Coding DNA Sequence Number=SeqID_24753
MELELLARLIVHKTTQAKRREGQAASISLSEAYALSE

SEQ ID NO: 116439 - protein, 439 aa, Glycine max
  Coding DNA Sequence Number=SeqID_24754
  Gene Ontology: Mol. function=4 iron, 4 sulfur cluster binding; Cellular component=cytoplasm; Biological process=metabolic process
  Homolog annotation: Hit_ID=A7P0Q1; Match level="QueryCoverage=17%, HitCoverage=7%, E-value=2e-33, Identity=94%"; Hit description =Chromosome chr19 scaffold_4, whole genome shotgun sequence
  Pfam annotation: Domain name=Aconitase; Domain location=129-439; Score=-184.3; E_value=2.9e-05; Accession=PF00330.11; Description =Aconitase family (aconitate hydratase
MNLQVSPTRKKHCQGRHLGVQLSKLCEVDVTTIIRIYLADHFMKLFLAHVLPKAFRHGTQNVTQERRTFSIEKFSTEDKIEFLPNGCDGRNYDGSDDGDDGNDEILHLGNRSSCNFGGIISVELAMDRTVNLPKGYGYVQFKTRGDAERHYSTWVAQIDGNVMKARYTLPPRQKVSPPPKAFAVAPKRDTPRTDNASADVNKDGPKRQRECIYVEVSSMLLEKLVAAGIGNRPVVFVTHSASRPCSCASDEFLRIIRHYNVAYRFMIVRLGLIVAASIAALTVEQLNVNNTRSATDLVLTVTQILRKHGVVGKFVEFYGDGMGELSLADRATIANMSPEYGATMGFFPVDHVTLQYLKLTGRSDETLEHQAISDHLCMICFLAFEKVKTRSLLSMTHVPIFARLCSGDLNSSNDVKMSVWEIHVNDFVLGTLTSAMISG

SEQ ID NO: 116440 - protein, 98 aa, Glycine max
  Coding DNA Sequence Number=SeqID_24755
MIPAQEVWARHPQLDYEFLNDNESDNHSPLILLKPRTERLANTDAFVSTVKGSSKSGKANIDASDKACFNCSKVVCAGVVHWKRSSVVILTKGAAMVA

SEQ ID NO: 116441 - protein, 79 aa, Glycine max
  Coding DNA Sequence Number=SeqID_24756
MARRKHSRQQQRGRSCNTDKEEDAATDSGEAIGEEEGEGHFCPFTHVAGAPAKILGAPSNCRDIVQMAPRVNWFGLEVG

SEQ ID NO: 116442 - protein, 88 aa, Glycine max
  Coding DNA Sequence Number=SeqID_24757
MAARPSELRLTPEVTGSPRLAGSFTLKIKARTLSPVKDKSKDIESCKIKGRTLSPVKDKSKDIESCKIKGRTLSPVKDKSEDFESYER

SEQ ID NO: 116443 - protein, 98 aa, Glycine max
  Coding DNA Sequence Number=SeqID_24758
  Subcellular localization annotation: CTP_CleavageSite=48; ConfidenceScore=5.53e-01
MSAWWLQQKTSLQVTYCCSSTPANESLRSSRTPITWKARQQVSRSPYRAQATSPYRDLPEFQGSSKLGDMSQSTSIFPHEKLRVLTNKVYTISMQYEV

SEQ ID NO: 116444 - protein, 57 aa, Glycine max
  Coding DNA Sequence Number=SeqID_24759
MERSMVDAASGGALGWRNHPNLRWTSPPQKQQQPVPLFQNAAGLSKPYVPPPIQQQQ

SEQ ID NO: 116445 - protein, 73 aa, Glycine max
  Coding DNA Sequence Number=SeqID_24760
MITKDDDKGDDKKLKGQSKNEYKIFKIESRILQDSRGKLNSRIKIQEIKIQDSRIKIQEIKIQDSRFKNQEKA

SEQ ID NO: 116446 - protein, 146 aa, Glycine max
  Coding DNA Sequence Number=SeqID_24761
DVRSKAQAIQKQNTAPHVLSRGGYDYLEQKLLVEKTKKKLQEAAQSGNVDGVIDPPSPVRRHVKWKMARTKKTEEMTTEATKEIAEKIGSFVPHGRQDVLAAAIGCPEHPGRVRAAGAGVTIKQTLDRLHEHPAALPPSLLTNYSS

SEQ ID NO: 116447 - protein, 320 aa, Glycine max
  Coding DNA Sequence Number=SeqID_24762
  Homolog annotation: Hit_ID=UPI00006A16D8; Match level="QueryCoverage =68%, HitCoverage=58%, E-value=6e-15, Identity=30%"; Hit description =UPI00006A16D8 related cluster
RIPIRGLHALTFRGLHVLGIRGSGTHTFRGLHALAFRGLHVLAFRGLHVLHFRGPYVLAFRGPYVLAIRELYAPTLKGLHVLDIRGLPTLTFRGLHVLTIRVLHALTLRGLHVLAIRGLHTLTFRGLHVLAIRGLHALAFRGRHILAFRGLHVLHFRGLDVLAFKGLDVLAIRWLYALTVRGLHILAIRGLHTLTFRGPHVLAIRGRHALTFRGLHVVAIRGLGTLTFKVLHALAFRGLHVLAFRGLHVLHFRGLDVLAFRGQYVLAIRGLYALTLRGLHVLAIRGLHALTFRGLHVLTISGLHALTFRGLHILAIRGLH

SEQ ID NO: 116448 - protein, 36 aa, Glycine max
  Coding DNA Sequence Number=SeqID_24763
MAFVDNWVEWQSQHGFLAHPHPLHLPQFSHSSKQDD

SEQ ID NO: 116449 - protein, 310 aa, Glycine max
  Coding DNA Sequence Number=SeqID_24764
  Gene Ontology: Mol. function=motor activity; Cellular component=cell projection
  Homolog annotation: Hit_ID=UPI00016621D1; Match level="QueryCoverage =58%, HitCoverage=41%, E-value=2e-14, Identity=32%"; Hit description =UPI00016621D1 related cluster
GIPGLHALAFRGLHILTIIGLHVLYFRGLHALTFRGQHVLTIEGLHLLAIQRAACPRLHRATYPHHQKAARPRLQRTTRPRQERAARPHLQRTTRPHLQRTARPHLQRVARPHHQRIARPSLQRATRPHLIGLDVLAYIGLHFLAFKGLHVLAIRGLHTLAFGWLHVLTFIGLHALTFRGLEFLTLRGPNVLAFKGLHALAFRGLHILPFRGMHALAIRGLHALAFRGLHVLVIRGLHVLSFRGLHVLTFIGQHVLTFRGLHAFAFRGIHVLAIRVLHVLAFRALHVLTFRGLHVLTFRGLHVLPIQRTT

SEQ ID NO: 116450 - protein, 103 aa, Glycine max
  Coding DNA Sequence Number=SeqID_24765
  Subcellular localization annotation: CTP_CleavageSite=61; ConfidenceScore=5.41e-01
MSIVVQCTSFTKLKATSPPPPHGDQPESQGSSKSSDTPPSTSISPHEKLQVLAGQVTLFPCQMRYETWAPSSAMTMDKLKILSHPPQEMLRLFNRSISPTRDI

SEQ ID NO: 116451 - protein, 109 aa, Glycine max
  Coding DNA Sequence Number=SeqID_24766
  Subcellular localization annotation: CTP_CleavageSite=45; ConfidenceScore=5.13e-01
MERDGAGTKNAGLRPAFSQFMCQPTVGTHRSGGRSAGQRQIVHHRAQEAGGFTTRSRAVVEGDRQRDHLVRFHAAHHRGHLVAGTAGTDDGHARRYHDRGRIAAGEHAE

SEQ ID NO: 116452 - protein, 178 aa, Glycine max
  Coding DNA Sequence Number=SeqID_24767
MWMDRFALTLNGSQELPRLLAKAKAMADTYSAPEEIHGLLGYWKNTITKRAARDPYRTRSKSRTMGDQEETQEQMKADMSALKEQMASMMEAMLSMKQLIEKNAATAAAVSSAAEADPTPLATTHHPPSNIVDGEGTHWGTMAALTWDTTERLTLMDCRPTIHTHLARRCGPHCFSRP

SEQ ID NO: 116453 - protein, 51 aa, Glycine max
  Coding DNA Sequence Number=SeqID_24768
MEKSERKIFNDKKTKKAYITWEDNDMNSSEDSENEVMNLSLMAKKYESEEE

SEQ ID NO: 116454 - protein, 135 aa, Glycine max
  Coding DNA Sequence Number=SeqID_24769
  Homolog annotation: Hit_ID=B0HC01; Match level="QueryCoverage=24%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTPPRKALEILSLSTKSSEMRRALFKYENPNFTAIFLEQNANINIQNQFPTNLSFPAIKPLGIL

SEQ ID NO: 116455 - protein, 55 aa, Glycine max
  Coding DNA Sequence Number=SeqID_24770
MFSKKEGMMRILKLAKYRTYQGNPCGVYPHLSSFTGSGVYPDLSSFTGRGIIQTL

SEQ ID NO: 116456 - protein, 240 aa, Glycine max
  Coding DNA Sequence Number=SeqID_24771
  Homolog annotation: Hit_ID=A5B5V0; Match level="QueryCoverage=89%, HitCoverage=48%, E-value=3e-08, Identity=23%"; Hit description =Putative uncharacterized protein
MYLKLPVYFDLVKAFYSNLEIQEGTLMSDVYGIKMVIDQSLFYDLTQLPSEGVPFEGALIDDWKFDFSMHDSRRLVCTNQADMTGRLLASSLAFESNILHYLIVHILLPISSNLAQVFEEDLIVMWAFHKGLQIDWAHLVRYRMHKALRLNAPLPYLHLVTLFLQHFNIPLDSEPYVPIKRSFLIGASVIASFGYQKEHDGSWVKKGARHVGEDGHDGEDSSLLSKILDRFDGLQTFVGK

SEQ ID NO: 116457 - protein, 125 aa, Glycine max
  Coding DNA Sequence Number=SeqID_24772
MRQIALGRRRRSMGQLQGLLVKRVPLCHINKRFVSAGWMCEGRITMIHKETPQEQPNWVRPCPPEFELGNWRIAKQPGISVASSISNNESCEGNDTEDLDVDFEQLMNQAEEVEDKDWGLPPELK

SEQ ID NO: 116458 - protein, 52 aa, Glycine max
  Coding DNA Sequence Number=SeqID_24773
MSSLSACGALSEFTLAQRLCAAHPSSRFFCALSQRMVRLADGWPSEWPGSAG

SEQ ID NO: 116459 - protein, 250 aa, Glycine max
  Coding DNA Sequence Number=SeqID_24774
MDMNISALISGQIYYIAQSNSFRLGFPVLITALCRARGVTSDRLTYESLSLAINMAYIKKNCWNVDDMTVNFRGAMKARAQLADVPSFSTPPAPSTSVTPTPAPPGPSSQDFQHFEFMLQSLYQRQILLMLSMQFIEKVAWPGTRPSLVREGGGPSSQEATTPERSPHITPDPPSPVVDHCSPQQLADHPSPVHEMPADPSTPLLKIPEDPATLVLGLTTTPPATPVLHFTDEEGTQDQDTQQDDQSQEF

SEQ ID NO: 116460 - protein, 330 aa, Glycine max
  Coding DNA Sequence Number=SeqID_24775
  Homolog annotation: Hit_ID=Q6WAY6; Match level="QueryCoverage=59%, HitCoverage=36%, E-value=1e-10, Identity=30%"; Hit description =Putative uncharacterized protein
PTVEEFEEILGCPLGGRKPYLFSGFLPSLSKIAVVVRDSARGLDRVKQTRNGVVGLPQKYLECKARDIANQEEWVPFMDVLALLIFGVILFPNMDGLVDLATIDAFLAYHHSKESPVVAILADLFDTFDRRVPHEGAPMEESLSPFLVRYFSAQSFKIIQRVHKAWESPLRKDKELRGIHNGIIGGYHEWLKVHTQGLDWLSKLKIINEENFEAPEEDEEVRALKTELGKARLAKEKFKLVATDVRKECAGNNELKLRREERDQSRAHSMVLKEELTACSRSKRNLSQRLCETETNMLAIVSKYQEELNLATTHEHKVADEYAQVYAEKE

SEQ ID NO: 116461 - protein, 127 aa, Glycine max
  Coding DNA Sequence Number=SeqID_24776
MSVPSLRSESSIVKELNRESSSTEVILICRSSNSPSSGFPAKEAVFNNSVERACMKKYEDAASGGALGDMTPAEARNLIEKMASNSQQFSARNDAIVIRGVHEVVTNSAASSETKKLEGKLDALVNL

SEQ ID NO: 116462 - protein, 58 aa, Glycine max
  Coding DNA Sequence Number=SeqID_24777
MRSARFPKGERRTGGRSLWKNASNAAFLRFLAFCWPFAHMFFPALSPDSVDNRITAFE

SEQ ID NO: 116463 - protein, 107 aa, Glycine max
  Coding DNA Sequence Number=SeqID_24778
  Subcellular localization annotation: CTP_CleavageSite=19; ConfidenceScore=5.33e-01
IAYPDHNSMCPPPSKVNTKGATKKPMKRSQRSTKRDPSYWEYVDALYSVQSSNSSVKHSASSFELPKPTRIIPMLDQFVPFIQDFIHNVVDVKTGDNYGYQSIAALL

SEQ ID NO: 116464 - protein, 164 aa, Glycine max
  Coding DNA Sequence Number=SeqID_24779
VPPVQLLTGWCVTAKAPPDISAGKCSGHAARRVPFAIQAAQLLGRAIGAGLFAITPAGERGMCCKAIKLGNARVFPVTTLNSIHRIAYGSVTEAPRLGFSSQKQFFSPKQLKCTTKGVRDPLEQPPLAYLSEKGEEVAAQLAQASWVASSISNPASKMFWKAQI

SEQ ID NO: 116465 - protein, 137 aa, Glycine max
  Coding DNA Sequence Number=SeqID_24780
MTRTKKIGQMTSKAIKEIAEKIVRFFGGAGITGFLCPHGREDVLTAAIGRPEHPGRVRVAGADVTIKQYFGSTPRTSGTSSSMAPEELEQLTQQIRDQLKELITKKSDSEADGILQPDAVQVSVTDGITGTCTTSRV

SEQ ID NO: 116466 - protein, 152 aa, Glycine max
  Coding DNA Sequence Number=SeqID_24781
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=56%"; Hit description =Putative uncharacterized protein
  Subcellular localization annotation: CTP_CleavageSite=46; ConfidenceScore=5.25e-01
MTMITPSSKLTLTKGNKSWYRAPPRERASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 116467 - protein, 253 aa, Glycine max
  Coding DNA Sequence Number=SeqID_24782
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLYHVKAQAVYFLAAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 116468 - protein, 119 aa, Glycine max
  Coding DNA Sequence Number=SeqID_24783
MPISPCGSISWSVSSRHRDHAHKTPSRPGEVQQGPGVSSFGYGHLDRTRKTPSGPREVQQGPGVSSSDYEPLSVLQSACHPPTRSLGPALTGLSSRSTVPPGRHRARHHSSIGMAGSGQ

SEQ ID NO: 116469 - protein, 115 aa, Glycine max
  Coding DNA Sequence Number=SeqID_24784
MGEVEEVQEKMKADMEAMKEQMATMMEAMMSMKKIMEANAVIVAATSAVAKVNSMLPSGLKQMNHPTSNMVGKDLGSTGGPHDVQIQNEHAFPSYGLPLNYAPPNVAYTPNKNVK

SEQ ID NO: 116470 - protein, 110 aa, Glycine max
  Coding DNA Sequence Number=SeqID_24785
MGEVEEVPKQMKADTEAMKEKMATVMEAMMSMKKIMEANAVAVAATSIVAKVNPMPPSGLNQMNHPTLAMVGKDLGSMSGPYYVQIQNKHAFPSYGLPPNYTPLNVAYTP

SEQ ID NO: 116471 - protein, 82 aa, Glycine max
  Coding DNA Sequence Number=SeqID_24786
TLVSTTTPLGLEVIPQVKELLDEGLVRKSLNPCALLVSKIGIIRHQIAKIGGVEERIPEFQEPLDLRSNPFQGGGNDAILPP

SEQ ID NO: 116472 - protein, 228 aa, Glycine max
  Coding DNA Sequence Number=SeqID_24787
  Subcellular localization annotation: CTP_CleavageSite=31; ConfidenceScore=5.34e-01
MSGLLRRGFGTCAHGKTSSVNSARGGARQMVSMRKRSPNYCAYQGNVLPSDHNFDLPLPKCQLVYAILTQMSVHMAQVIADAIYLFTGMAPTRHLLDPEKSNRALGFPALITGLCQSYGVPITPSKVIRPLITRAFIEKYCTPRQAQGNAHQDAGAPPPPRQADSVGPLRVERYIYHLVRQQAAKHHGQVQIHECLYRFSLSQQGQGSAPFVCRTLEQFGAEVAWPGD

SEQ ID NO: 116473 - protein, 115 aa, Glycine max
  Coding DNA Sequence Number=SeqID_24788
MTLLLSNILPNYRNADLPLRKYHAHKTPSGPRRVQQGPGASSSGYGPLLVLPGARPPQQGIVPARHPMDPKKSNRVLGFPALMSACRPQQGRHRVRHHSSLGMPGNGQQAHHHHL

SEQ ID NO: 116474 - protein, 173 aa, Glycine max
  Coding DNA Sequence Number=SeqID_24789
GAGTFLVRKYGSRTIHLKFVDHVFFRFFRRFPQINVGGDSAHFPFLEDAPVSLAPPSRRRGSRPQDTQWTRRSPTGPWGFQLWLRASVSPTGCSFPPARIAPARHPVDPKKSNMVLGFPALITGLCQFYREPVAPTRSSGPLLTGLSSRSIVPPGRCRARHHSSGQQAHRHHL

SEQ ID NO: 116475 - protein, 73 aa, Glycine max
  Coding DNA Sequence Number=SeqID_24790
  Subcellular localization annotation: CTP_CleavageSite=54; ConfidenceScore=5.32e-01
MTGLSRHCGCLTGLAPSSKSILCMQVDRLIPGMSAKVHPMAFLCFLSTSNNFSSCSTAREAEMITGNFSLSSK

SEQ ID NO: 116476 - protein, 94 aa, Glycine max; identical to SEQ ID NO: 107670
  Coding DNA Sequence Number=SeqID_24791

SEQ ID NO: 116477 - protein, 114 aa, Glycine max
  Coding DNA Sequence Number=SeqID_24792
  Homolog annotation: Hit_ID=A5B4U1; Match level="QueryCoverage=70%, HitCoverage=17%, E-value=3e-21, Identity=50%"; Hit description =Putative uncharacterized protein
MDIEYAIRKDEPPHEKVRDLLKAIDDQFITSDKTLASTLIMKFSSLWLTSVKGVREYIMTMQDISTQLKKLEVDMFESFLEEERLDMKIVEAKFHDESTMIQRCFDDNNDDNKR

SEQ ID NO: 116478 - protein, 113 aa, Glycine max
  Coding DNA Sequence Number=SeqID_24793
MRPNLKGKNYNSQLQIMGGIIPLVSLELSRSIGVATYPSAGGRRETRGIRVPRKEYVRSRHQRLFEENIGKTGKDAIYELLSERFGSCIYARGRVFPFAPTYSSIWDEKISPT

SEQ ID NO: 116479 - protein, 77 aa, Glycine max
  Coding DNA Sequence Number=SeqID_24794
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=90%, HitCoverage=64%, E-value=2e-32, Identity=97%"; Hit description =Chromosome undetermined scaffold_79, whole genome shotgun sequence
  Pfam annotation: Domain name=Complex1_49kDa; Domain location=1-77; Score=-139.2; E_value=0.0033; Accession=PF00346.10; Description =Respiratory-chain NADH dehydrogenase,
VDSRGSPPSTYTAVEAPKGEFGVFLVSNGSNRPYRRKIRAPGSAHSQGLDSLSKHHMPADVVTIIGTQDIVSGEVDR

SEQ ID NO: 116480 - protein, 44 aa, Glycine max
  Coding DNA Sequence Number=SeqID_24795
MEGGIGASVTRNAANSDSKFLSAFSMVPPFEEFFRDFNRCRDAS

SEQ ID NO: 116481 - protein, 68 aa, Glycine max
  Coding DNA Sequence Number=SeqID_24796
MGGQVQLNNGAGNGYCSRTDFHYLLHAHRGSIIVVIFSFMASMSAFIYSCTSSTSPITLTLAQVRTWG

SEQ ID NO: 116482 - protein, 217 aa, Glycine max
  Coding DNA Sequence Number=SeqID_24797
MGDQEESQEQMKADMSALKEQMASMMEAMLGMKQLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPAIEERRKLDLLEERLRAVEGFGDYPFADMTDLCLVPDVVIPPKFK

SEQ ID NO: 116483 - protein, 83 aa, Glycine max
  Coding DNA Sequence Number=SeqID_24798
MVKKPAHLGELIASALSFSSPGRAATAPKGSKGQKVRELREERKEKKKEEETRPKRYRIAIAIIPYFVSCSMFFVRAPISFIF

SEQ ID NO: 116484 - protein, 258 aa, Glycine max
  Coding DNA Sequence Number=SeqID_24799
  Homolog annotation: Hit_ID=Q2HW90; Match level="QueryCoverage=73%, HitCoverage=57%, E-value=2e-15, Identity=27%"; Hit description =Putative uncharacterized protein
MGQLQRQAFRKANGKIWDLARVEVSMEPIASLSQYYDQPLRCFTFEDFQLVPTMKEFKEILGCPLGGKKPYLFSGKGQRPWKIKANGLSFIDILALLIFGVVLFPNMEGLVDLAVIDAFLAFHYGKESSVVAILAMYDTPVYPLQGHRSCVEKGKANWDQLLASIEGRLGCINYNPVLAIRQLGYPMRGVPSNESITPFIARGFGDHNARDRELRGSSNGIIDGYHKWLRVQTQGLDWLPNLKTVRDNEVNASEESDE

SEQ ID NO: 116485 - protein, 75 aa, Glycine max
  Coding DNA Sequence Number=SeqID_24800
MGLRIRLENGELANSARQSIRGARDSMGSRLDGGGRMNSARQSIHGSLNKIENGDLANSAQQSIRGAPDSMVEDA

SEQ ID NO: 116486 - protein, 65 aa, Glycine max
  Coding DNA Sequence Number=SeqID_24801
MATNCASTTRGGGYRAATVHTNEDRAHKTPSGPGGVQQGPRVSSSSYGPLSVLPGARPPSKGSRP

SEQ ID NO: 116487 - protein, 150 aa, Glycine max
  Coding DNA Sequence Number=SeqID_24802
MSNHKSTESALKNLKVQVGQLAKQIADKSSNSFVANTEKNPKEECKVVMTRSKRFMEAKDEDSVVYKKKDAEKKGTDEKKDDVIGESNQEKEKKCGSTISCGTFQEGEGPPFGEIRRYFQETGNNHALRRSFTGDATLLQVLKGYVDKET

SEQ ID NO: 116488 - protein, 37 aa, Glycine max
  Coding DNA Sequence Number=SeqID_24803
MGKKKLEMGIEDQKNVCLEVKESEEKVLKERTKLDPC

SEQ ID NO: 116489 - protein, 252 aa, Glycine max
  Coding DNA Sequence Number=SeqID_24804
  Gene Ontology: Mol. function=motor activity; Cellular component=cell projection
  Homolog annotation: Hit_ID=UPI00016621D1; Match level="QueryCoverage =91%, HitCoverage=41%, E-value=2e-18, Identity=31%"; Hit description =UPI00016621D1 related cluster
MSSTSKDYTFSPLEDYIGLHVLGFRGLHVLTFRGLHVLTFNRLQALAFRGLHVLTFKGLHVLAFSGLQALAFVGLHAPTLKGLLILTFRGLHVLTFSGLHALALTGLHVLTYRGLHNLAFRGLDALAFRGVHILPLRGLHALTFVGLHTLTFKGVHILNFRGLYIVAIRGLHILAFRGLHVLPFRGQHDLPFRGMQALALTGLHVLIFRGLHNLAFRGLDALAIRGVHILPLRGLHALAFVGLDTLTFKGVH

SEQ ID NO: 116490 - protein, 195 aa, Glycine max
  Coding DNA Sequence Number=SeqID_24805
MSALKDQMASMMEAMLKIQKSIEDNAREAEPVLQPAMNSGWDRSATDFTPRTAPDDLSQAPTFEGQLPPHADYHLEEDDEGDAHLGPLLPPRESTPHELPQPNIIRHAPSQSAPVKEPIPISKDKGKIDLLEERLRAVEGLGNYPFSDLVDMCLVPDIIIPPKFKVPDFDKYEGTTCPKESSSDVLSKDGGIFHG

SEQ ID NO: 116491 - protein, 101 aa, Glycine max
  Coding DNA Sequence Number=SeqID_24806
  Subcellular localization annotation: CTP_CleavageSite=33; ConfidenceScore=5.04e-01
MTQTNRYFRKGRSALQSLGRMFLSSNVIYICVRVVMLVRMIRTRLFAAAWVESCPSMHSSYVIASLFGCARTVGRPPLSGCGPGTDKRKLLAPLTGSASLG

SEQ ID NO: 116492 - protein, 68 aa, Glycine max
  Coding DNA Sequence Number=SeqID_24807
MASKKRKAPATPSQVRYGQSRFTSPKAWERYTNIVVPRKILPERNVVIYHTEFESSKKNWREENGTRS

SEQ ID NO: 116493 - protein, 203 aa, Glycine max
  Coding DNA Sequence Number=SeqID_24808
ASEPVDTQRLTSSSTPLSSRDDESEDMRGYLMVIRTFCHPETVRPMTCGGASEPIDTQRLTSSSAPLSSRDEEFDDMRGYFVGYLTVIRTFCQPEESEPVDKQGQTSSSAPFVNLGQASPDDESDDMWGYLMVIRIFCHPETTSPMTYGGASKPVHMQRLMPSSAPLSSRDDESNDIWGYLSVIGTSCQLEASESIDTQRLTS

SEQ ID NO: 116494 - protein, 167 aa, Glycine max
  Coding DNA Sequence Number=SeqID_24809
MQIIISVPPITCDFCRREHYQDNCYMYSTNNSRWRQELTPYNQYEEERALDLDIVFAEFMAYHASCKANHNAIQKQEIQWEPESQFFYQNEAKKSFNLEILFMQFKDTIGFIQRAFKSAEIQVGKLVEEVTQAMSRREEEIVKVDTQEESPVNEHDLEEEDEEKAQQ

SEQ ID NO: 116495 - protein, 44 aa, Glycine max
  Coding DNA Sequence Number=SeqID_24810
MEASIPFSLRRFGILSEQSKEKIEKSQETVKDAAIVVTMHTCEL

SEQ ID NO: 116496 - protein, 23 aa, Glycine max
  Coding DNA Sequence Number=SeqID_24811
MACLDQQHSGKEGKAVHKLQVAH

SEQ ID NO: 116497 - protein, 100 aa, Glycine max
  Coding DNA Sequence Number=SeqID_24812
MIVLSNSQIPRQIQDKDESRYLGMGTNGGQAHDQQIVVPRPAPDKREALLGGSLEMAPKKLSTKRSRRDATGEGSSGASEFDSHCFQSAEHQQRFEAIRG

SEQ ID NO: 116498 - protein, 62 aa, Glycine max
  Coding DNA Sequence Number=SeqID_24813
SLGSVGALSHGPWGNLIGIGCIVRRSLPPAFKNDEDEVRGAAGTMDPLTPNRVAFPGLAGLA

SEQ ID NO: 116499 - protein, 195 aa, Glycine max
  Coding DNA Sequence Number=SeqID_24814
  Gene Ontology: Cellular component=membrane; Biological process=toxin biosynthetic process
  Homolog annotation: Hit_ID=Q8U5E3; Match level="QueryCoverage=100%, HitCoverage=100%, E-value=6e-89, Identity=87%"; Hit description =Colicin V production protein
  Pfam annotation: Domain name=Colicin_V; Domain location=5-158; Score =130.8; E_value=4e-36; Accession=PF02674.7; Description=Colicin V production protein
MPITIFDGIVIAVVLFSAILAMVRGFSREILSIASWAGSVAAAYYLYPVLLPYARNYTDDDKIAIAGSAGVVFLVSLIVISFITSRIADFIIDSRIGALDRTLGFLFGAARGILLLVVAVAFWNWLVDVKTQPEWVTQAKSKPFLDGLVGKLEAVLPDDIEPQIRARILGKPQEQTTTQAPAEDVPATNPPATNN

SEQ ID NO: 116500 - protein, 64 aa, Glycine max
  Coding DNA Sequence Number=SeqID_24815
MLALPHEHGRSMLSRRASKLTGIQLSIRSPPLVLLTKATLSPMCEILEPTLATSTLTRDNSRFY

SEQ ID NO: 116501 - protein, 80 aa, Glycine max
  Coding DNA Sequence Number=SeqID_24816
MGAKYLEVVKRGSHPNKQMAQNDHNLSPSALGHDRAWVARRRMTIICLCVQPNTIASGWRKGVGNDHNLSLPTSRLIVPE

SEQ ID NO: 116502 - protein, 81 aa, Glycine max
  Coding DNA Sequence Number=SeqID_24817
MVFFGGKFGSECFGLSLFLFLFSAGRESRQRTGFWLAIKGKGPLQFVVLAQKACITTGRDVCQGVGLASGSGIKECPTLFP

SEQ ID NO: 116503 - protein, 48 aa, Glycine max
  Coding DNA Sequence Number=SeqID_24818
MGEEEKKPEENKVEEKKANEEKKKEEEKKSEESKDDKESKEKSARPEI

SEQ ID NO: 116504 - protein, 50 aa, Glycine max
  Coding DNA Sequence Number=SeqID_24819
QFRAEVAWPRDWLEAQAGEAPAEAPGDADEACMDEEMSDLLGFLGGSGAT

SEQ ID NO: 116505 - protein, 214 aa, Glycine max
  Coding DNA Sequence Number=SeqID_24820
MEAMKEQMAAMMEAMMSVKKIMEANAVAIAATSVVAKVNLMSPSGINQMNHPTLDMVGKDFGSRDGLHDVQNPNKHAFPPQGLPPNYTPPNVAYTLNEDVNNSTPIPIESRQPQTVHAHVSQPMGETHEMPHHNQADFEPCLGYATKRQTIDGIPLQNPLEGPQYHPQLHLLHSTTKERLRAFKGGEDYAFANLEESFLVPNIITPPKVQGVGL

SEQ ID NO: 116506 - protein, 107 aa, Glycine max
  Coding DNA Sequence Number=SeqID_24821
  Homolog annotation: Hit_ID=A7QGD2; Match level="QueryCoverage=45%, HitCoverage=17%, E-value=2e-10, Identity=68%"; Hit description =Chromosome undetermined scaffold_91, whole genome shotgun sequence
MVMQWNDGDDDGGGGGKNVMMIVTTDEKNIGALFTLPAKVDSMIGQRTRIGEHEAMRKRMKDMEKKQREAEGQSSQDASNNKDKEEQEIKARPLNMEDMRQAKSQVG

SEQ ID NO: 116507 - protein, 89 aa, Glycine max
  Coding DNA Sequence Number=SeqID_24822
  Gene Ontology: Mol. function=aspartic-type endopeptidase activity; Biological process=DNA integration
  Homolog annotation: Hit_ID=A5AGS2; Match level="QueryCoverage=97%, HitCoverage=11%, E-value=2e-10, Identity=37%"; Hit description =Putative uncharacterized protein
MTLTRDVHFNEGQKWDWNNSQIDGSFLNNGDNHPGEQTIELMQNELEDDLPIRGKRPEDRKVIGVKWIFRIKLNVDSSVNKHKTRLVVK

SEQ ID NO: 116508 - protein, 75 aa, Glycine max
  Coding DNA Sequence Number=SeqID_24823
MVDERKEEEGCLCHMSPFEWSKKGPPFSLDVTHTQPHEEKNLTFWNAKILPRFACRFSGSSSLCFSAPVDASFRK

SEQ ID NO: 116509 - protein, 58 aa, Glycine max
  Coding DNA Sequence Number=SeqID_24824
STKFRALLSLSLHSSPSSSKLLSMASYGEAKESIDEEDPRPTSSNGAYIMWYQEHLHL

SEQ ID NO: 116510 - protein, 139 aa, Glycine max
  Coding DNA Sequence Number=SeqID_24825
MVERGHGMYYTPQTFAQYPTQMYQYHFQGHHTDTSASQHSFDGVAETQPHFSWPTMTPSQQYYGPIPTPNAPSGTQWNVPGPIPNMSDLLGVDLRHEFSAEADEEEAGRHRGRRNPDCQARRWDRPCGTSSRHHGHQNE

SEQ ID NO: 116511 - protein, 234 aa, Glycine max
  Coding DNA Sequence Number=SeqID_24826
  Homolog annotation: Hit_ID=A1FWX2; Match level="QueryCoverage=100%, HitCoverage=52%, E-value=1e-128, Identity=96%"; Hit description =Peptidase U62, modulator of DNA gyrase precursor
  Pfam annotation: Domain name=PmbA_TldD; Domain location=4-214; Score=- 79.4; E_value=0.057; Accession=PF01523.7; Description=Putative modulator of DNA gyrase
MPAIGKQSYRASPTFSESTAAIDPAFRAKVAADSIAPCRGHGLIAAGFLEDGQGFQATANSNGNFAYQRTTNFDYTCTVRTEDGRGSGWVGRNLKDAADFKADQDIRIAMRKATESAEAKALEPGKYTVILEPAAAAGLISFMMNFFSARSADEGRSFLSKKGGGNKLGEQVYDPRVTMIADPWHPDAPVLPWDGEAMPRERLTIIENGKIANQDYSRFWAQKQCKTAKATPGN

SEQ ID NO: 116512 - protein, 175 aa, Glycine max
  Coding DNA Sequence Number=SeqID_24827
MGTNQTGKRFYQVKVKGLDTTNIKELGRLMEPLQMQAFRKTYGKILELTIAEVSIEAIASLTQYYDQPLRCFTFGDFQLGKKTIPFLRVSPLFEQNCNCGQGFSKRFGPHKTDSKRHSGPTTEVPRRQGEGYGQSRRLGPVYGCVSFANFWGRPLSKRRWFGGPSSNRCFPCIPP

SEQ ID NO: 116513 - protein, 151 aa, Glycine max
  Coding DNA Sequence Number=SeqID_24828
MGEVEEVQEQIEAGMEALKEQMASMMEAMMSVKEIMEVNAVAIAATNTIAEVDLTPPPYGLNQINHPTLDMVGLEGKELGGTGDPHLVQKTSMPSRHIACLPTIHHPMWRTLPVRMSITPLPYSLKADNLKLIMHMSLNPWGRRMRYPTAI

SEQ ID NO: 116514 - protein, 124 aa, Glycine max
  Coding DNA Sequence Number=SeqID_24829
MVKEECKETLVRIATPLRLEFIPQVKELLDEGLVRKSLNPCALLVPKIGIIRHQIPKMGGMMNALGGATLICKITRAPNIFMICVHWDSLGVPMNPKRIKVIPEWPAPPSVLRKKAQSFKNLGI

SEQ ID NO: 116515 - protein, 140 aa, Glycine max
  Coding DNA Sequence Number=SeqID_24830
MEIHVRHPFAVAHGEIHAGKSRVIGADPAAQRHLDQQQDEAADHPGPETPRRGGHRMVRAFTRRQPGHQRQHRQAEHQVRRDHGGHQLVRHGPGAERALHAHRHQRGHRQGRRAAQFAAVAPGHVDDADDQHAQDRADVA

SEQ ID NO: 116516 - protein, 86 aa, Glycine max
  Coding DNA Sequence Number=SeqID_24831
MVNSMLSYSGLSEGFWGEAMLTTCYLLNRIPNKRNKRLEHILKVSQKVCVRFCARKKRTTYISIKFSRFKKLGLGFDMLMKDRDTG

SEQ ID NO: 116517 - protein, 96 aa, Glycine max
  Coding DNA Sequence Number=SeqID_24832
MIMRGQDIYSSQEETTSLPSSSGSEDEVRGEESSEEVYPHEEGDLLMVAKDQLTTKDKMDEEEKQKKKKDSKALSSKAKGKEKEEKNSSKKIVVIP

SEQ ID NO: 116518 - protein, 57 aa, Glycine max
  Coding DNA Sequence Number=SeqID_24833
MPNFSALSAHPPPSAALARLAQRGIWQSIRIKVARNARDQCAERNNCLQLGSAHDWR

SEQ ID NO: 116519 - protein, 258 aa, Glycine max
  Coding DNA Sequence Number=SeqID_24834
  Homolog annotation: Hit_ID=Q6WAY6; Match level="QueryCoverage=31%, HitCoverage=14%, E-value=3e-15, Identity=50%"; Hit description =Putative uncharacterized protein
MTPLTEDVRRAVQGLSAVLLLFIYGWFHTFFAKREGAFVNWFPQWKEGRIGVLISCGGFLNVPLMGTRGCINYNPVLAIRQLGYPMKGAPLEEELAPVISRGFNKTNMETLQKVRKAWEVVQKKDKEKLRTAEEVESPRARTELEQAQTAKEMFKSMALRIQKENAKLRDVNVATTKALEQEIKRARREEHGRNKFRGALWGSNNELKLRREERDQSRTNMLAIISKYQEELSLAMAHEHRVADEYAQVYAEKETRGR

SEQ ID NO: 116520 - protein, 138 aa, Glycine max
  Coding DNA Sequence Number=SeqID_24835
MILSLEDKSAKVDVSLSKLNVLSECHLLSEASTRLADRRNLEGNMSHRHTLSASSARSMSHLSPSRLSASLALSENSLTRAKHENGTKCDLEYFIIACLWLDHPYVCTVRGFSIERCIVSLELDRAGLGYRMSGHGVR

SEQ ID NO: 116521 - protein, 124 aa, Glycine max
  Coding DNA Sequence Number=SeqID_24836
  Gene Ontology: Mol. function=protein kinase C binding; Cellular component=cell projection
  Homolog annotation: Hit_ID=UPI0000F2ADE5; Match level="QueryCoverage =65%, HitCoverage=15%, E-value=4e-10, Identity=43%"; Hit description =PREDICTED: similar to PDZ-LIM protein cypher3s isoform 1
YPRLQRTARPRLQRATRLHLQRTTCSHLHRVTHPHLQRTIRPPLESATRPHPQRTTSSPPEDYMSSPSEGYTPSPSEGHVPSPSEDYTSSPSEGYTPSPSKDYTTSPLEGYTLSPSVDYTSSTS

SEQ ID NO: 116522 - protein, 279 aa, Glycine max
  Coding DNA Sequence Number=SeqID_24837
MLGMKQLMESNAATAAAVSSAAEADSTLLTATHHPIPNMMGGERSTSGHISNPHPGYNRGTYPYGLPPNYTPPAIRDDAGHVPPLILEGEPPRHPDEVHEDHREHAQGDVDSYSPFPTEGPVPNALPQPNITGEPRSHPTQPMFLSVGGPPPAAEGKGKLDLIEERLRAIEGFSDYPFTDMTDLCLVLDVASLQSSRDEKLLMHFFQDSLAGAAFISFADLVFAEERIEVGLKRGKFDYVSPVGASSRRTRIAGAKKKEGDAHTVTLTPAWPKPPQTPH

SEQ ID NO: 116523 - protein, 225 aa, Glycine max
  Coding DNA Sequence Number=SeqID_24838
  Homolog annotation: Hit_ID=UPI000166267D; Match level="QueryCoverage =58%, HitCoverage=29%, E-value=6e-07, Identity=36%"; Hit description =UPI000166267D related cluster
DGPLGTNALTFRGLHVLAIRGLHALTFRGLHILVIRGLHAFRGLHVLAVRGLQVLTIRGLHVLAVRGLHILTFRGLHALSFKGLHVLAIRGLHVLHFRGLHILHFRGLHILAFRGLHALAFISGPPPDIEGRPTMQAQPEREAITQLLCILGQDFTHAVGKRQVWIMRTNMTTLTQIWMTLLLSNVLLSDRNADLPLRMDRARKTPSGPGEVQQGLGVSNSDYGL

SEQ ID NO: 116524 - protein, 134 aa, Glycine max
  Coding DNA Sequence Number=SeqID_24839
  Subcellular localization annotation: CTP_CleavageSite=35; ConfidenceScore=5.36e-01
NFRGARKARVRLADVPSSSTLPAPSTYATPTPAPRSSSTQDSQCYEAMLQSIHQGQILLLQSLQVVAPPGSIVLVEQFIEKVSWPRTLPFVVRKGEGPSAQAGRAQVRHEATTSERSPQISPDPPSPVVDQSSL

SEQ ID NO: 116525 - protein, 196 aa, Glycine max
  Coding DNA Sequence Number=SeqID_24840
  Gene Ontology: Cellular component=mitochondrion
  Homolog annotation: Hit_ID=A6H594; Match level="QueryCoverage=40%, HitCoverage=90%, E-value=3e-28, Identity=79%"; Hit description =Putative 23S ribosomal RNA
MDVDKILPSSSTLGWHSLKVKGEVQTKKGLWWIPRHPETRKGVVSDEMLRGVENKRRSGDSRYRSTFRTAADPRAGKRQPELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 116526 - protein, 214 aa, Glycine max
  Coding DNA Sequence Number=SeqID_24841
  Gene Ontology: Mol. function=motor activity; Cellular component=cell projection
  Homolog annotation: Hit_ID=UPI00016621D1; Match level="QueryCoverage =98%, HitCoverage=40%, E-value=1e-22, Identity=36%"; Hit description =UPI00016621D1 related cluster
LHVLIFRGLHVLAFRRLHVLAFRGLHVLAFKGLHVLTLRGLHVLAFRGLHVLAFRGLHVLSFRGLHALAFKGLHALAFRGLHVLAFRGLHVLAFRGLHVLIFRGLHVLAFRKLHALAIRGLHVLAFRGLHVLTFRVLHVLAFRGLHVLPFRGLHTLTFRGLHVLAFKGLHALSFRVLHALTFRGQQVLTFRGLHVLAFKGLHICAFRELKVLCP

SEQ ID NO: 116527 - protein, 22 aa, Glycine max
  Coding DNA Sequence Number=SeqID_24842
MTDDVVYHGYCAKCHHPAADDE

SEQ ID NO: 116528 - protein, 123 aa, Glycine max
  Coding DNA Sequence Number=SeqID_24843
MDEIEKVQEQMKADPEALKEKMAPMVEAMMSIKEIVVVSAAYQTRARAKIMGEVEKVQEQMKADMEAMQEQIAPPAMAKKGKVDHLKERLRAIEGDEDYAFANLEELFLIPKHGHPQVQGAGL

SEQ ID NO: 116529 - protein, 130 aa, Glycine max
  Coding DNA Sequence Number=SeqID_24844
  Gene Ontology: Cellular component=chloroplast
  Homolog annotation: Hit_ID=Q49KT9; Match level="QueryCoverage=65%, HitCoverage=92%, E-value=1e-25, Identity=63%"; Hit description =Putative uncharacterized protein ORF113
ALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQDQELRRSPLSFWGDGGIVPFEPFSCFPGGLENCNQ

SEQ ID NO: 116530 - protein, 169 aa, Glycine max
  Coding DNA Sequence Number=SeqID_24845
MRGAPLEEELVPVITRGFNKTNVEALQKVPKAWEVVQKKDKELRGSNNGPIGGYRKWLKAHVQGLDWLPSLRTAKGEEVEAPEEDEEVQALRAELEQTQTVKERLKSASLKIQKENAKLRDINIATTKALEQETKRAHREEHGRNKFRGALWAVTASLSSGERKGTNHK

SEQ ID NO: 116531 - protein, 193 aa, Glycine max
  Coding DNA Sequence Number=SeqID_24846
  Gene Ontology: Mol. function=phosphoprotein phosphatase activity
  Homolog annotation: Hit_ID=A7PHV0; Match level="QueryCoverage=49%, HitCoverage=28%, E-value=4e-15, Identity=37%"; Hit description =Chromosome chr13 scaffold_17, whole genome shotgun sequence
METENTYFSHEMRRVYYYSSRCLCFIRSPCRWVTVNNLSWVDLCEELLGVKSEEGELQDLNNHNDNLEQVERFTRAWILRFIGGVLFVDKSSNKVSFVWEPYSANVMLVLPPICLVGSVAWCAVVPLIYFLVIEWHQPDRVLRQFGMQQPIPSSPSQPFNIHGITLRGKHEENWGQLLGPMINQWNNHADFRA

SEQ ID NO: 116532 - protein, 229 aa, Glycine max
  Coding DNA Sequence Number=SeqID_24847
GVHEVATNPSASSETKKLEGKLDALVNLVTQLVLNQKFVPVARVCGLCSSADHHTDLCPSMQQPGAIEQPEAYAANIYNRPPQPQQQNQPQPYIPPPIQQQQQPQKQPTVEAPPQPSLEELVRQMTMQNMQFQQETRASIQSLTNQMGQLATQLNQQQSQNSDKLPSQAVQNPKNVSAVSLRLGKQCQGPQPVAPSSSANEPAKLHSTPEKGDDKNLPNNFCAGDLLPQ

SEQ ID NO: 116533 - protein, 263 aa, Glycine max
  Coding DNA Sequence Number=SeqID_24848
  Homolog annotation: Hit_ID=Q84VH5; Match level="QueryCoverage=100%, HitCoverage=41%, E-value=2e-96, Identity=69%"; Hit description =Envelope-like protein
  Subcellular localization annotation: CTP_CleavageSite=21; ConfidenceScore=5.34e-01
MATSPKETSAPGSPSVPSSPSSTKAPSNQERPEFNIQPIQMIPGSAPVPEKLVPKRQQGVKISENPSLATSPREVDTEMDKKIRSIVSSILKNASVPDADEDVPTSSTPNVSVPDVDKDVPTSSAPNAERRLSAPRAPEPAPGDLIDLEEVESDEEPLANKLAPGIAERLQSRKGKTSIKRSGRIKTMAQKKSTPITPTTSRRSKVAIPSKKRKEISSSDSDDDVEPDVPDIKRAKTSGKKVPGNVPDAPVDNISFHSIGNVE

SEQ ID NO: 116534 - protein, 204 aa, Glycine max
  Coding DNA Sequence Number=SeqID_24849
MIMRSQDIYSSQDEATTSPSSSESEEAKGEESSEEIYPQEEGKPLMVKEECKEVSVSSKRLAKKERHFEIKTNIKEISPLKQPPHFLLYKKTLVRIATPLRLEFIPQVKELLDEGLVRKSLNPCALLVPKIGIIRHQIPKIGGMMNALGGATLICKITRAPNIFMICVHRDSLGRNNQHENTEKGVPMNPKRIKVIPEWPAPPS

SEQ ID NO: 116535 - protein, 137 aa, Glycine max
  Coding DNA Sequence Number=SeqID_24850
MTSWSGMCGSSVRCFEKRRAYSRRVSPDFYLHLLRSHEFPGRISSSHRRAVSERKSGNCLMMARSSPQAPPSWQANLKSASHNSGLVSPLYFAMLVGGRNGLGRGVLRIALLNTRGPGGSGATRSSSLSYLPPRCAL

SEQ ID NO: 116536 - protein, 63 aa, Glycine max
  Coding DNA Sequence Number=SeqID_24851
MTQSPPRERTLREMVAPDFTYESLCIQYPDEDVPYKAKSKPRLIRWMLWFQEFDLEIRDQSGA

SEQ ID NO: 116537 - protein, 105 aa, Glycine max
  Coding DNA Sequence Number=SeqID_24852
  Subcellular localization annotation: CTP_CleavageSite=55; ConfidenceScore=5.40e-01
MCPPPTSLKPANSLPSAVRQFSILNLIRSPRIHCLALFMCPPPSSLEPRELSAIRQFSILNLIRSPMNSLPSAVHVSSTNESGAPRIDCLALFANSPFSILFGDP

SEQ ID NO: 116538 - protein, 163 aa, Glycine max
  Coding DNA Sequence Number=SeqID_24853
MTTLTQIWMTLLLSNILPSDHNSDLPLPKCQLVYAILTRMSIHMAQLIADAIDLFAGMAPTRHPMDPDKSNRALGFPALITGLCQSFGVPVAPTKVIRPPITRAFIEKYCTQRQAQGDAPQAAGAPPPPHQAGPAGSFDMEHAYIFVWIVALMLISLLSMMFI

SEQ ID NO: 116539 - protein, 91 aa, Glycine max
  Coding DNA Sequence Number=SeqID_24854
MSSSQSISINTQALCNIYTKTQSYMQCGTMSVKNHVEHLGVHDKTNHTLASQVTLTRNAPTIWDQHRLKGALKPRDPQGLHFKESVRASPS

SEQ ID NO: 116540 - protein, 82 aa, Glycine max
  Coding DNA Sequence Number=SeqID_24855
  Subcellular localization annotation: CTP_CleavageSite=4; ConfidenceScore=5.22e-01
MKVHCNQASRRPSMTTDSPPLLMFPWTQSSVESPTVTAYPSAGGRHEGSRVHLPRKENARSRHQRLFEENVGKTGKGVVYEL

SEQ ID NO: 116541 - protein, 198 aa, Glycine max
  Coding DNA Sequence Number=SeqID_24856
  Homolog annotation: Hit_ID=A8ARS5; Match level="QueryCoverage=48%, HitCoverage=79%, E-value=3e-17, Identity=51%"; Hit description =Putative uncharacterized protein
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRTIKIPGVSPWKLPRALSCSDPAAYRIPVRLSPFGKRGAFLIAHAVGISVRCRSFAPSWAVCTNPPFSPTAAPYP

SEQ ID NO: 116542 - protein, 107 aa, Glycine max
  Coding DNA Sequence Number=SeqID_24857
  Gene Ontology: Mol. function=protein kinase activity; Biological process=protein amino acid phosphorylation
  Homolog annotation: Hit_ID=Q2QZ78; Match level="QueryCoverage=88%, HitCoverage=21%, E-value=2e-09, Identity=31%"; Hit description=AT hook motif-containing protein, putative
MPYPEDADCTSYLDNSLILAELNYNNDNTISEFLQLFSSMTGTGKTFIWRTLATSLRANNQIVIIVASSDIASLLLPDGRTTHSKFKISVPIYENSTCNIHQGSELA

SEQ ID NO: 116543 - protein, 114 aa, Glycine max
  Coding DNA Sequence Number=SeqID_24858
MIMRGQDIYSSQKEAIYSPSSNGSEGETKGDEHIEEVYPYEEGVLMITMMTTKDDDKGDEQKAQRSNNNSSESGTSQEFKNQGEFKTQEEILESRIKIQDLKNQDQDSRLKIQE

SEQ ID NO: 116544 - protein, 234 aa, Glycine max
  Coding DNA Sequence Number=SeqID_24859
  Gene Ontology: Mol. function=electron carrier activity; Cellular component=cytoplasm; Biological process=electron transport
  Homolog annotation: Hit_ID=Q5PF19; Match level="QueryCoverage=61%, HitCoverage=30%, E-value=2e-80, Identity=98%"; Hit description =Anaerobic nitric oxide reductase flavorubredoxin
DAGSRQARQGASAGVGGCRGWLNYAASEQIVLRVHHMRAIGAGLFAITPAGERGMCCKAIKLGNARVFPVTTLSTLEDPLVETPMLHWPDSMMTYMTGDAVLFSNDAFGQHYCDERLFNDEVDQTELFEQCQRYYANILTPFSRLVTPKITEILGFNLPVDMIATSHGVVWRENPTQIVELYLKWAADYQEDRITIFYDTMSNNTRMMADAIAQGINEVDPNVAVGTELEFVIM

SEQ ID NO: 116545 - protein, 26 aa, Glycine max
  Coding DNA Sequence Number=SeqID_24860
MRRIQIWGSHGHVAPHATELLGHSNK

SEQ ID NO: 116546 - protein, 275 aa, Glycine max
  Coding DNA Sequence Number=SeqID_24861
MERSMIDVASGGALGDMTPAEARNLIEKMASNSQQFSARNDAIVIRGVHELALNQKSVPVTRVCGLCSSADHHTDLCPSMQQPGAIEQPEAYPANIYNRPPQPQQQNQPQQSNYDLSNNKYNPGWRNHPNLRCSSTQQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKNVSAISLRSGKQCQGPQPVAPSSSANEPAKLHSILEK

SEQ ID NO: 116547 - protein, 403 aa, Glycine max
  Coding DNA Sequence Number=SeqID_24862
  Gene Ontology: Mol. function=signal transducer activity; Cellular component=membrane; Biological process=signal transduction
  Homolog annotation: Hit_ID=A0TT40; Match level="QueryCoverage=58%, HitCoverage=39%, E-value=6e-51, Identity=49%"; Hit description =Putative uncharacterized protein precursor
MNLNALFSRFSIRTRIFSTLGLVAVLLVVSGLIGLAGMQSSNRALDEAYTRQLAAKTALSAASLNLTIVRTTLDRALLHPEAPDVSELVKKAEGYLAKADTAWRSYAAMPHGDDEGPLASRLDAARQALIGQALKPMIDAIRGRAARRSRPLADDRRAAVVGRAHAGDRRARCVPGRARQGRVRHCADLLRLDADGRDRGDRIRAGRVPRLRDRPAFRDHAAGESSAVAFPPPVGRRPHVGSALVVARRDGRTGQRRDRHAAQPRGHRAPGQPGFRGDFDGDAPDRGRQHRPVAAYRGTGVRIAGDGREHGAAHRDREAERGQRGGGAGLRGHRERDRHARRDRGRRGDRHDERDRPELAEGRRHHRHDRGDRVPDQHPRAECGGRGRACRRAGPRLRGGRGR

SEQ ID NO: 116548 - protein, 76 aa, Glycine max
  Coding DNA Sequence Number=SeqID_24863
MAAEWRRKRERRRHFKEKMSLEEAHHHRRPWIRAWRKKEMNEGRGREEHEILCSKRALKSELTNPRSIPRFSTKCA

SEQ ID NO: 116549 - protein, 127 aa, Glycine max
  Coding DNA Sequence Number=SeqID_24864
GSPPPKTPSGPRREPQQGPWGFPGGEIAPARHLVDPEKSNRVLGIPTLITSLCQFYRVPVTSSKGQGSASFVCPTLEQFGAEVACPGDWPDAQAREESAGSPDEADEFHMDEDMTDLLGFLGGSGAT

SEQ ID NO: 116550 - protein, 64 aa, Glycine max
  Coding DNA Sequence Number=SeqID_24865
MPIGWTFHKCGANIEEEEPTDLRSNPLQGEGDDAILPRKGPITRAMSKRLQEDWARAAEEDTRD

SEQ ID NO: 116551 - protein, 307 aa, Glycine max
  Coding DNA Sequence Number=SeqID_24866
  Gene Ontology: Mol. function=unspecific monooxygenase activity
  Homolog annotation: Hit_ID=Q9AVH2; Match level="QueryCoverage=66%, HitCoverage=78%, E-value=1e-61, Identity=57%"; Hit description =Putative senescence-associated protein
GKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESLDCSTPGEEAPKGPFPIRPPTGTRRPALAAEAARAVHRQPTGSGLGPPCPALRANPFPEYDRAWEALGPPDFQGPPGAHRTPRDVRCSSSRWTLPPAEPFP

SEQ ID NO: 116552 - protein, 99 aa, Glycine max
  Coding DNA Sequence Number=SeqID_24867
  Homolog annotation: Hit_ID=UPI0000ECBAF8; Match level="QueryCoverage =41%, HitCoverage=48%, E-value=1e-16, Identity=100%"; Hit description= UPI0000ECBAF8 related cluster
MATLDITLHQDVTRRVSPVTCGGPYGSTEDITSPTRKLHLEFNSRGCMQAWHWPSFYNVVTGKTLALPNLIALQHIPLSPAGVIAKRPAPIALPNSCAA

SEQ ID NO: 116553 - protein, 82 aa, Glycine max
  Coding DNA Sequence Number=SeqID_24868
  Subcellular localization annotation: CTP_CleavageSite=62; ConfidenceScore=5.07e-01
TYQGNPCGVYPDLSSFTGSGVYPDLSSFTGSGVYPDLSSFIGSGVYPDLSSFTGSGVYPDLSSFTESGVIQIFVTCIKRSTP

SEQ ID NO: 116554 - protein, 108 aa, Glycine max
  Coding DNA Sequence Number=SeqID_24869
SSGRARLPESSRKRFSGSLPEEVFFRKTFGYFRKNTSSKGYYPKVTILRFHCYNNVVSYKQRGVRETNLVHGEEEDKVRACLAEKKKQFAEKGEEAVRGEGEEVSRKE

SEQ ID NO: 116555 - protein, 241 aa, Glycine max
  Coding DNA Sequence Number=SeqID_24870
  Homolog annotation: Hit_ID=Q84VH5; Match level="QueryCoverage=83%, HitCoverage=29%, E-value=9e-70, Identity=71%"; Hit description =Envelope-like protein
  Subcellular localization annotation: CTP_CleavageSite=21; ConfidenceScore=5.18e-01
MATSPKETSAPGSPSVPSSPSSTKAPSNQERPEFNIQPIQIIPGPAPVPEKLVPKRQQGVKISENPSLATSPREVDTEMDKKIRSIVSNILKNASVPDADKDVPTSSTPNVSVPDAEKDVPTSSTPNAEVLSSSSNERSTEEDDQATEETPAPRAPEPTPGDLIDLEEVESDEEPIANRLAPGIAERLQSRKGKTPITRSGRIKTMAQKKMQQKIQNQMMMILKPPHDHQTFIFASHFYWL

SEQ ID NO: 116556 - protein, 161 aa, Glycine max
  Coding DNA Sequence Number=SeqID_24871
MDNILGRHILPERKVEIYHTELDKFKAELERRNFHKRLTNLVDNNIDLALVKEFYANLYRSEDPPPKHAKVRGHLVKIDADNLNTFLETPVILVEGETLPAYSRYCRLLTNYKEIEAALCIPGRGFVLNSEGHPGKILRNDLMTLAQVWKGLLLTAWFSSA

SEQ ID NO: 116557 - protein, 205 aa, Glycine max
  Coding DNA Sequence Number=SeqID_24872
  Homolog annotation: Hit_ID=A7ZVH7; Match level="QueryCoverage=90%, HitCoverage=40%, E-value=5e-79, Identity=76%"; Hit description =Putative uncharacterized protein
MSGMAELQGDNRQAGCQLLCMDMNNMKRKTLPLVLGCTLSLSTLAAQPPTERYSVTFPQGTRVSYSGAFASAFPEGLPVGIGSGLLFTGRQGDTLNFVTVTDRGPNADSPDMGKQESKIFVTPDFAPLLMNIQVKNGKAQATDARPLHDAKGNINGLPLQNGVIGSTNEIALSDKLKVLQGDNRGLDTEGITLDGKGGYWLCDEY

SEQ ID NO: 116558 - protein, 54 aa, Glycine max
  Coding DNA Sequence Number=SeqID_24873
  Gene Ontology: Mol. function=metallopeptidase activity; Cellular component=vacuole; Biological process=proteolysis
  Homolog annotation: Hit_ID=A7QLJ4; Match level="QueryCoverage=90%, HitCoverage=9%, E-value=4e-17, Identity=83%"; Hit description =Chromosome undetermined scaffold_119, whole genome shotgun sequence
MDKHEELHRPKLQRVLVIKHNANQRYATSGITPFLFKEAGKIHNLPTQQRPFGN

SEQ ID NO: 116559 - protein, 163 aa, Glycine max
  Coding DNA Sequence Number=SeqID_24874
  Gene Ontology: Mol. function=chlorophyll binding; Cellular component =integral to membrane; Biological process=photosynthetic electron transport
  Homolog annotation: Hit_ID=Q2MI75; Match level="QueryCoverage=43%, HitCoverage=13%, E-value=4e-36, Identity=100%"; Hit description =Photosystem II P680 chlorophyll A apoprotein
MTTISDKSHYISTQDASSSPGLRKGTLGTPMGIKWRNNKIIYLTLVWKRILNIKKGILNKVKLLRMGHWGDKGIFMGLPWYRVHTVVLNDPGRLLSVHIMHTALVAGWAGSMALYELAVFDPSDPVLDPMWRQGMFVIPFMTRLGITNSWGGWNITGGTITNP

SEQ ID NO: 116560 - protein, 256 aa, Glycine max
  Coding DNA Sequence Number=SeqID_24875
  Homolog annotation: Hit_ID=Q6WAY6; Match level="QueryCoverage=92%, HitCoverage=39%, E-value=3e-20, Identity=32%"; Hit description =Putative uncharacterized protein
MFGSKARTLASQDEWALFMDVLVLLIFGVVLFPNVDGLVDLAAIDAFLAFHDRKESPVVAILADLYDTFDRRCEKNSARIACCTPALYVWLVSHLFCQEVKHVCPLEDHRSCTEKKEANWDRLLASKEGAFVSWFPRWKEGRTKILISCGGFPNVPLMGTRGCINYNTVLSIRQLGYPMRGVPLEEGLTPFIAQGFNSTNVGVLRRVCKAWEMVQKKDEELWGSSNGPIGGYHKWLKAYAQGLGWLPNLRATKEVE

SEQ ID NO: 116561 - protein, 86 aa, Glycine max
  Coding DNA Sequence Number=SeqID_24876
MIHVYEGQEFEVRLSQARYDVALSVGESQLTPLNPIEEQRLMTRCWVAAAGPKHKGCLYGIGDLAYTYKCGDDNFMQHTQGSSRHT

SEQ ID NO: 116562 - protein, 104 aa, Glycine max
  Coding DNA Sequence Number=SeqID_24877
MRSFNGDFPPWRCSGRQRRRGERRRHPLGNKPWKKEFHHQDEPWIRSLEGCFNGGKERGRERGGEHEIEGIKEGEKWNFKVASFRSFLEKTSLRSFFEKTSLRS

SEQ ID NO: 116563 - protein, 256 aa, Glycine max
  Coding DNA Sequence Number=SeqID_24878
  Pfam annotation: Domain name=Transposase_23; Domain location=49-119; Score=-4.1; E_value=0.0033; Accession=PF03017.5; Description =TNP1ENSPM transposase
  Subcellular localization annotation: CTP_CleavageSite=32; ConfidenceScore=5.03e-01
MASFSHLQSQMQSQGLAVPLEPLVGLGPSGPRVSTKGSCVDPSGNDPETGDSDRCGLYIEADPARLVSIGRVYEGSTVVHNTPLLLGQVKVSVEEVRDVDAPVPVPTDEVSLVGQALHTFLAWPTHLVKSLSQQVTWDATVFGVFNLDFPSYIKYEDLSEIAHGGQCLSISLLQLWILHLTETSMRAGNSDIYGFLEPQSIQRSGQSQFESESYIKTWMQSSPMRCLSWSLPKWRTLADGGHPAQGTPSCLVLFIA

SEQ ID NO: 116564 - protein, 68 aa, Glycine max
  Coding DNA Sequence Number=SeqID_24879
MAHFIPLYGFNPLTPLDLLPLPNISDFKHKDAQAKVAKKVMILNIEGQMLSKKERMMRIVKLPKYKDL

SEQ ID NO: 116565 - protein, 90 aa, Glycine max
  Coding DNA Sequence Number=SeqID_24880
MTAEQVTYNILILHPMSVNTLISVKQHHELLHFSVTPYERTAYTHHSFRKLLTKMRPFCRNLPFGGRATRDSRDACSMKGIRAESPPTFI

SEQ ID NO: 116566 - protein, 136 aa, Glycine max
  Coding DNA Sequence Number=SeqID_24881
  Gene Ontology: Mol. function=helicase activity; Biological process =viral genome replication
  Homolog annotation: Hit_ID=Q2A9E0; Match level="QueryCoverage=61%, HitCoverage=5%, E-value=2e-11, Identity=48%"; Hit description =Putative uncharacterized protein
MARDRLTHSEVHNIRLKLIADREKDGRIYNVPTVSEVVALITGDFDTHSKRDIILETQNGQSQRIDELHSSYLGQMKHKLCCTLGNSSSNLSLKGILWLNPKDFPSSDTTKKNLELTSFPACNSHWMLVPPKAYKK

SEQ ID NO: 116567 - protein, 38 aa, Glycine max
  Coding DNA Sequence Number=SeqID_24882
MTSRVFPPAGDSFSLVRSYKNTFLASQPFHGLPGDLPL

SEQ ID NO: 116568 - protein, 165 aa, Glycine max
  Coding DNA Sequence Number=SeqID_24883
MREVPSDESITPFIARGFSDHNARVLQGVSQGHRMRREERTESLGEAVMGSSEAIIKWLRIRTQGLDWLPNLKTMRDMRVKASKESDEVQALKAELERAWVVEEKFKSIAIKGSNSKLKLRRGETEGYMWAIIDKCKEKLILAATHAQRLEDEYAKISAEREARE

SEQ ID NO: 116569 - protein, 415 aa, Glycine max
  Coding DNA Sequence Number=SeqID_24884
  Gene Ontology: Mol. function=amino acid transmembrane transporter activity; Cellular component=integral to membrane; Biological process=amino acid transport
  Homolog annotation: Hit_ID=A8GEZ7; Match level="QueryCoverage=52%, HitCoverage=90%, E-value=1e-104, Identity=76%"; Hit description =Putative uncharacterized protein precursor
  Pfam annotation: Domain name=DUF1471; Domain location=1-83; Score =0.9; E_value=0.007; Accession=PF07338.4; Description=Protein of unknown function (DUF1471)
  Pfam annotation: Domain name=DUF1471; Domain location=145-223; Score =3.7; E_value=0.0038; Accession=PF07338.4; Description=Protein of unknown function (DUF1471)
  Pfam module annotation: Pfam domain module=DUF1471::DUF1471; Domain location=1-83::145-223
APEVSKTPKYRVFNGVNELPKEEAYLLEPYDTVSVSGFYRSQPDINDAISKEAKKKGAASFFIVRQVDANSGGNQFVTAYIYKADAPKRRVQSPDAIPADSDAGRAALAAGGAAAAKVEIPGVASSGSPSREVGRFFETQSSTGQRYTVTLPNGTKIQEVNNVTAAQMVPFDSVTFTGHFNSMTDVSTEVAKRAAEKGAKYYHVTRQWQNKSGGNLTDPSLEKKLGLTALTALVLSSMLGAGVFSLPQNMAQVASPAALLLGWGITGVGILFLAFAMLLLTRLRPDLDGGIFTYAKEGFGELVGFCSAWGYWLCAVIANVSYLVIVFAALSIFTDRGGSVILGDGNTWQALIAESALLWIVHALVLRGVQTAASINLAATLAKLLPLGMFAVLAAIAFKMDVFTLDFKGIALGKP

SEQ ID NO: 116570 - protein, 108 aa, Glycine max
  Coding DNA Sequence Number=SeqID_24885
  Pfam annotation: Domain name=G-patch; Domain location=1-42; Score =19.4; E_value=0.00086; Accession=PF01585.14; Description=G-patch domain
MVARVMLRHGYEPGMGLGKDSHRNADVVDIRGNPHKYELGYEPGKPGRRNAPSRLREDRAWPDHEEVAAIGEEAPQDPPSFVRPCHPNFQLGNWHVTSQSKVYTADSM

SEQ ID NO: 116571 - protein, 151 aa, Glycine max
  Coding DNA Sequence Number=SeqID_24886
  Homolog annotation: Hit_ID=A5ARL5; Match level="QueryCoverage=96%, HitCoverage=8%, E-value=7e-14, Identity=31%"; Hit description =Putative uncharacterized protein
  Pfam annotation: Domain name=zf-CCHC; Domain location=52-69; Score =12.0; E_value=0.023; Accession=PF00098.14; Description=Zinc knuckle
MDSLITRLLRVPHLSKDENPTDSVETSAMVASRGRGGGRNSRGGRNGRGGRPHCTYCKRMGHTQENCYSLHGFPDKVAQVSRSEKAESKFSDEEYQEYLKLKSERPSNQAQSSSVPCFSTACISQSIEGPSPWILDSSASDHIFWNMGRGD

SEQ ID NO: 116572 - protein, 47 aa, Glycine max
  Coding DNA Sequence Number=SeqID_24887
MPPRILIVTDSGALSTSSVSRPSKDGRSSGRGGGSSEAMDSTCITYG

SEQ ID NO: 116573 - protein, 116 aa, Glycine max
  Coding DNA Sequence Number=SeqID_24888
  Homolog annotation: Hit_ID=A4DID9; Match level="QueryCoverage=54%, HitCoverage=88%, E-value=7e-19, Identity=53%"; Hit description =Putative uncharacterized protein
GKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVNAG

SEQ ID NO: 116574 - protein, 108 aa, Glycine max
  Coding DNA Sequence Number=SeqID_24889
MKESRPKLKKGMRAMLDKQTKAQKGYFPTRRLGLGSHEKGEVSRAKKIQASTKRGWSISNGEADLRTNPFEEGESDEDMARTKGKEPLERLRGPMPRTSTKKAKETLQ

SEQ ID NO: 116575 - protein, 103 aa, Glycine max
  Coding DNA Sequence Number=SeqID_24890
SPVDAKRVNNESVWWQDLMAVIHDQQFNNVLQEGTIWRPLFDNEVASAVGFLEDISHTALQQHAADSSVWKPEPNGYYSSRSAYILLQGNSEEGNMDDIFKDL

SEQ ID NO: 116576 - protein, 220 aa, Glycine max
  Coding DNA Sequence Number=SeqID_24891
  Homolog annotation: Hit_ID=A5BKB8; Match level="QueryCoverage=72%, HitCoverage=39%, E-value=5e-34, Identity=54%"; Hit description =Putative uncharacterized protein
MGGGAWPFLVGGAICLVNSVNERDLSLLNSYVEVCDALRCSGPTRATLMYQRVYSLGRQIIAIVGLQRGIPSKRESSARVDYVPALCTHRPSLLPIEWSGEVFGLRRREPAEGSLSMPHNQIDPRTCLFIYRREGGDDHGAPNSNLLSATPGGPETVSRGSRHDTTFTYNDSRQTDISALASMKNVAKCDTWCELQNPVNHRVFERKLRPKPLGRGHACL

SEQ ID NO: 116577 - protein, 193 aa, Glycine max
  Coding DNA Sequence Number=SeqID_24892
MDNEEGVKEQMKADLSAVKDQMASITKAMLKLQKIIEDNATATASNTAREAEPVLQPAINLGRDRNTTGFNRRYSPQAYPYGLPPDFTPRTAPDNLSQAPTFEGQLPPHADYPLQKDDEGDAYLGPLLPLKEPGPHELPQANIVCHVPSPSTPVKELVPIAKDKGKIDLLEERLRAVEGHDNYPFSDLANLCL

SEQ ID NO: 116578 - protein, 177 aa, Glycine max
  Coding DNA Sequence Number=SeqID_24893
MGCHQFGLFNPDFPLYIKHEDLSEIAHSDQCLSISVLQLWILHLTETSMPAGNSDIYGFLEPQSIQRSGQSQFETGSYIKSWMQSSKRNVYLGAYLNGGHWQMVVIMPNEHLVVWFCSLHNKPDNYLKRIINSALKGLDDAPQPKSKAPARWIVIKTIGAREIKGVADLVGTVLSPS

SEQ ID NO: 116579 - protein, 58 aa, Glycine max
  Coding DNA Sequence Number=SeqID_24894
MSEEVDMDFQDEQDYGVNERHVDCSDAFNTSQVFATREDVLKWARTVAHENGFVAVIM

SEQ ID NO: 116580 - protein, 73 aa, Glycine max
  Coding DNA Sequence Number=SeqID_24895
MAPPLTSFPLSSAASPCDQGVPTDPKRIKVIPDWPPPPSVEGRSLEYEEPQDLRSNPFQGGGDDAILPPKGIG

SEQ ID NO: 116581 - protein, 606 aa, Glycine max
  Coding DNA Sequence Number=SeqID_24896
  Gene Ontology: Mol. function=oxidoreductase activity, acting on the aldehyde or oxo group of donors, disulfide as acceptor; Cellular component=mitochondrial alpha-ketoglutarate dehydrogenase complex; Biological process=metabolic process
  Homolog annotation: Hit_ID=A1FZK3; Match level="QueryCoverage=100%, HitCoverage=83%, E-value=0.0, Identity=85%"; Hit description =Transketolase-like
  Pfam annotation: Domain name=E1_dh; Domain location=1-223; Score= -129.4; E_value=0.013; Accession=PF00676.11; Description =Dehydrogenase E1 component
  Pfam annotation: Domain name=Transket_pyr; Domain location=266-450; Score=57.0; E_value=6.3e-14; Accession=PF02779.15; Description =Transketolase, pyrimidine binding dom
  Pfam annotation: Domain name=Transketolase_C; Domain location=476 -596; Score=81.2; E_value=3.3e-21; Accession=PF02780.11; Description =Transketolase, C-terminal domain
  Pfam module annotation: Pfam domain module=E1_dh::Transket _pyr::Transketolase_C; Domain location=1-223::266-450::476-596
MAERSRQVPGIDPLRDAALSFAASADDPASGGRHKVWGSKPLWVLPQTSTIASHLPKALGTALAIESGKRLGQALPLPAPILFVCEDNGLGISVKTPDGWIAERFSRQPGLDYFFADGLDLATGHAQVQAAVEHCRRTRRPTFLHLRTTRLMGHAGTDFEVEWRALPELCAAEAQDPLLRSAQIAMESGWMDAAAIEVAYETMRARCMAAAADAEGHPTLQSLQDVMAPLAPYTPAAVQAEACREVPAETREALYGGAETLPERQAPRHLAIQINHGLQELLAKYPQSLLFGEDVAQKGGVYTVTKDLLRRFGPRRVFNTLLDETMILGMAQGLANMGMLPIPEIQYLAYLHNAIDQVRGEACSLQFFSNDQYRNPMLVRVAGLGYQKGFGGHFHNDNSITALRDIPGLVVGCPSRGDDAVMMLRTLAALARVDGRVAVFLEPIALYMSKDLHEPGDVQWLFDYPAQGQALVPAEGRVYAPEAVDLVVYTYGNGVPTALRAARAIEQQLGWQVRVVDLRWLLPLDAGFIASQAASARRVLVLDEGRHSGGVGEGVVTALVEAGFGHLPLRRVCGADTYTPLAGAAMFGLPSDTALIGAALELAQEP

SEQ ID NO: 116582 - protein, 147 aa, Glycine max
  Coding DNA Sequence Number=SeqID_24897
  Pfam annotation: Domain name=Transposase_23; Domain location=47-117; Score=15.0; E_value=2.7e-05; Accession=PF03017.5; Description =TNP1ENSPM transposase
  Subcellular localization annotation: CTP_CleavageSite=30; ConfidenceScore=5.29e-01
MASFSQMQSQMQSQRLALPPKPLVGPLGPRVSTKGSCVDPSGNDPKMGDSDRCSLYIEANPDRLVALGRVYEGSTIVHNTPLLPSQVKVGVEEVKDEDAPVLVPTDEVSVVGQAIHTFLAWSTHLVKSLSQQVVVSPAKPAPKPNPE

SEQ ID NO: 116583 - protein, 78 aa, Glycine max
  Coding DNA Sequence Number=SeqID_24898
MAFLGETSTQTIVNSRLAFIYPNGSIIHNDTGVYFQTSTPVPISSTQIAIPTNNFWMKFTTGSHSPIQVIKFALSVSN

SEQ ID NO: 116584 - protein, 209 aa, Glycine max
  Coding DNA Sequence Number=SeqID_24899
  Homolog annotation: Hit_ID=Q2HW90; Match level="QueryCoverage=87%, HitCoverage=36%, E-value=3e-20, Identity=31%"; Hit description =Putative uncharacterized protein
MAEVSTKAITSLAQYYDQPLRCFTFEDFQVTPTVEEFKEILGCPLGGRKPYLFSGFYPSLARIYKIVKISTQELDRGKQVENGVVGVPRKCLEAKARTLASQDEWAPFMDVLKLLIFGVVLFPNVDGLVDLTSIDALLAFHDRKESPVVAILADLHDTFNRRCEKNSARIVGYTPALYIWLVSHLFRQEVRHVCLLEGHRSCTEKNEAN

SEQ ID NO: 116585 - protein, 127 aa, Glycine max
  Coding DNA Sequence Number=SeqID_24900
MARAGDNGGVYHQLDESQRLFLDAWTTQMQRLLNRNKEEPYRRIAKSSSFTLKPLSPREVCDDQIRMREKREQEKENSEAPQRNMKKKSDTPEEKSDTQERESDNSNQNLKMSFARRFLMDCHLQEA

SEQ ID NO: 116586 - protein, 321 aa, Glycine max
  Coding DNA Sequence Number=SeqID_24901
  Gene Ontology: Mol. function=unspecific monooxygenase activity
  Homolog annotation: Hit_ID=Q5CEG7; Match level="QueryCoverage=32%, HitCoverage=99%, E-value=2e-43, Identity=83%"; Hit description =Senescence-associated protein
  Subcellular localization annotation: CTP_CleavageSite=52; ConfidenceScore=5.30e-01
MIGRADIEGSKSNVAMSAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVSTGQKITLRQHPQGPSQCFVLIKQSDSPLSGTSSELTVPTPGEEAPKGPFPIRPPTGTRRPALAAEAARAVHRQPTGSGLGPPVPSPSEPILFPRGCSPWRPDAVMSTTGRGRHSVLRIFKGRRGRTGHHATCGALPAAGPYLRLSRFQGGQAVKQKR

SEQ ID NO: 116587 - protein, 91 aa, Glycine max
  Coding DNA Sequence Number=SeqID_24902
MASMMDAILGMRQLMENNTATAAAISMAAEADPTLPAAAHHPIPNVVGRERSTLGHISNPHPGYNRVAYPYGLPPNCTPPIIRDDYRSKAS

SEQ ID NO: 116588 - protein, 118 aa, Glycine max
  Coding DNA Sequence Number=SeqID_24903
MDLSFPDFHKLPNDGCQAPHKDQRKVACHQAKQKNVYTDNHSGISAYHRARRLWMIQGCRMTKFGLCLSSGPPPLDDKRVRITVRYLRVSSGPPPLDDTRVQNDQTWSLLVIGPAASG

SEQ ID NO: 116589 - protein, 66 aa, Glycine max
  Coding DNA Sequence Number=SeqID_24904
MAKGCGMTKFCLRMSHDLRVSADNCKVSPRVTSSWVMATKGGVVDKSEALAPTYPPMRNSDLRSSG

SEQ ID NO: 116590 - protein, 54 aa, Glycine max
  Coding DNA Sequence Number=SeqID_24905
  Gene Ontology: Mol. function=RNA-directed DNA polymerase activity; Biological process=RNA-dependent DNA replication
  Homolog annotation: Hit_ID=Q0ZCC0; Match level="QueryCoverage=88%, HitCoverage=2%, E-value=2e-09, Identity=64%"; Hit description=Gag protein
IVQPSRKDWSTRLDDALWAHRTAYKAPIGMSPYRVVLLELGSGLPVEIDKGTLS

SEQ ID NO: 116591 - protein, 100 aa, Glycine max
  Coding DNA Sequence Number=SeqID_24906
  Gene Ontology: Cellular component=mitochondrion
  Homolog annotation: Hit_ID=A8IFJ1; Match level="QueryCoverage=74%, HitCoverage=45%, E-value=9e-22, Identity=64%"; Hit description=S1 ribosomal protein
IDNSRASTRRSSPMLALQSEVLRLGEEMFLVDAGPGTPRICMQDEPTGVPINRATRFENKVGSLDLVADVVAGEPLLLLHEDSDKPSLDGTEQDLANEYK

SEQ ID NO: 116592 - protein, 134 aa, Glycine max
  Coding DNA Sequence Number=SeqID_24907
LCQSFGVPVAPTKAQGDAPQAAGAPPPPHQAGQAGAFDMEQYLRHLVRQQAANHRAHVQTHDCLYQMSLSMQSQGFASFSCPTPDQFRAEVAWPGDWPEAQAGEAPPEAPGDGEEAHEDEEMVDLLDLLGGSGD

SEQ ID NO: 116593 - protein, 91 aa, Glycine max
  Coding DNA Sequence Number=SeqID_24908
MAVSGGIDGGGGCYGNDGSSGDGGGGDNGKSGGSNGDGDGGGDGGGDDDGCGGGSNDNDGVVVVAMAIVTMMMIGLVAITMVMTTMMVVVA

SEQ ID NO: 116594 - protein, 78 aa, Glycine max
  Coding DNA Sequence Number=SeqID_24909
MENSSLTVNHLIQPYFNLLSENQLRVVNTRLGTTYTRKTARKPHYKRNLKESWASSSKGNNTRKSSLPWIQTENANET

SEQ ID NO: 116595 - protein, 170 aa, Glycine max
  Coding DNA Sequence Number=SeqID_24910
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=2e-13, Identity=30%"; Hit description= UPI00006A17C9 related cluster
  Subcellular localization annotation: CTP_CleavageSite=70; ConfidenceScore=5.48e-01
MLVRMVRTLLFAAARVKSCPSMHSSCVIASLSGCARTVGPPPISGGGPGTVWMSSTLKMRTRSPLKVRACSSLKARMCSPLEVKVCNPLLARTCSPLKVRACSPLLVRTCSPLKVRACSPTKVRTCSPLMARACSPLKVRTCGPLMARACSPLKVRMCGPLKVRACSPTK

SEQ ID NO: 116596 - protein, 143 aa, Glycine max
  Coding DNA Sequence Number=SeqID_24911
RGLHVLAIRGLHALTFRGLHVLALRGLHALTLGTSYPHQGLHVLAFKGSCTFNVRGLHVLAVKGSCTFTFVGLHALTFRGLHVPHFQGGMPSPLEDCTSSHHRTTLPRFERRTRPELRGLHALALEDYASSLSVGSISTLKII

SEQ ID NO: 116597 - protein, 138 aa, Glycine max
  Coding DNA Sequence Number=SeqID_24912
  Subcellular localization annotation: CTP_CleavageSite=9; ConfidenceScore=5.12e-01
GSHPQRHPVDLKKSNRALGFPALVTGLCRPYRAPVPPSKFMSSWHRDCARKTPSGPEEGQQGLGVASSKYGSLSGLGSACRPQQGHQVPPTNRAFIKKFCVSRQAQGETPQQPGDGRQRATDAHGRHHNRRRAKHHHL

SEQ ID NO: 116598 - protein, 118 aa, Glycine max
  Coding DNA Sequence Number=SeqID_24913
MAAQLIHDRVVMDSTHCYFASTSGATRTPVEWILPTPTPYRLVEHVQLIEVSSSEEDLEEDPKELSPEPAMDALDLPEDDEDPLLDVDSPEDIMPASEADSTEESDPGGTMNSDDSSS

SEQ ID NO: 116599 - protein, 56 aa, Glycine max
  Coding DNA Sequence Number=SeqID_24914
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1JR80; Match level="QueryCoverage=64%, HitCoverage=14%, E-value=3e-10, Identity=83%"; Hit description =Phosphoprotein phosphatase
MDHIHSQCIKNLEKSSMVDCFDWWVGTWRVGGVLVIFRAFGDRLLKQYVVADPEIQ

SEQ ID NO: 116600 - protein, 46 aa, Glycine max
  Coding DNA Sequence Number=SeqID_24915
MKKQQWKRRFYGGWIFELQLGPSMVIFHHGDAAEGKGEEERGGTIH

SEQ ID NO: 116601 - protein, 282 aa, Glycine max
  Coding DNA Sequence Number=SeqID_24916
  Gene Ontology: Mol. function=4 iron, 4 sulfur cluster binding; Biological process=thiamin biosynthetic process
  Homolog annotation: Hit_ID=P30140; Match level="QueryCoverage=85%, HitCoverage=64%, E-value=1e-128, Identity=91%"; Hit description =Thiazole biosynthesis protein thiH
  Pfam annotation: Domain name=BATS; Domain location=137-242; Score =144.9; E_value=2.2e-40; Accession=PF06968.4; Description=Biotin and Thiamin Synthesis associated doma
MGFEHLLLVTGEHQGKVGMDYFRQHLPAIRREFASLQMEVQPLSQDEYAELKSLGLDGVMVYQETYHEATYARHHLKGKKQDFFFRLETPDRLGRAGIDKIGLGALIGLSDSWRVDCYMVAEHLLWLQQHYWQSRYSISFPRLRPCAGGIEPASLMDERQLVQTICAFRLLAPEVELSLSTRESPAFRDRVIPLAINNVSAFSKTQPGGYADDHPELEQFAPHDGRRPEAVAAALTAQGLQPTLRKDKTGRLSAIVRFFIVIRSARDAGQGEKLLPRFALPP

SEQ ID NO: 116602 - protein, 233 aa, Glycine max
  Coding DNA Sequence Number=SeqID_24917
EKPQLLVVFVVIAAAAVALEEEHMACLDQQHYGREGQAVVVVEDLPISDLDDSSNLDCICCLKDHNYSAVVGFAAEEIAAKSDKDLYDEDESVATSWTPLRTIASFLALNCWERLSPVINLAYIRKNCWNPEDLTVSIRGARRAGARPAELPSTSAAPTPTSTLVAPSVPVVEPSGSIPSMEQFTEMARLTSALSKGGKMHGVATNEGISTSHVDKSGALAPTYPPSKRKSDL

SEQ ID NO: 116603 - protein, 200 aa, Glycine max
  Coding DNA Sequence Number=SeqID_24918
MAEPLKKRKGSSSQSQRHSETQEMQIPSSISSSSLFSSEEQRIRYTNLFSFGSIIDPKFIDMDFFSNEIFECIQAFENSNLIPFMSLKLPVYTELVKAFYSNLEIQEGTLISEVYGIKMVIDQSLFYDLTQLSSEGVPFEADMTGRLLAGSLAFESRILHYLIVRILLPRSSNLAQVFEEDLIVMWAFHTGRQIDWVHLV

SEQ ID NO: 116604 - protein, 53 aa, Glycine max
  Coding DNA Sequence Number=SeqID_24919
MYIVVVLKDERKRGWGHDRPIVALLCAKQAGNVAARQPRILCILQLSFTICLF

SEQ ID NO: 116605 - protein, 96 aa, Glycine max
  Coding DNA Sequence Number=SeqID_24920
MQRRSTVGDLIPINLEINATCRSRNSARIRKFLQDLEAAATPEEEPQSSEASSSFPIAGHSHIEPIEDTIMAEEPRKVTLEDYSSSTVPQFFTSIA

SEQ ID NO: 116606 - protein, 111 aa, Glycine max
  Coding DNA Sequence Number=SeqID_24921
MEAIPHLGYNRAAYPYGLPPNYSPPVLQRRSREHIAWFSPERELQMLVPTKVQKKIVSERLCPRPDRDQHMLAHPIIAVPQIELGLPRKPPSNEEIGMKLMPKYMTERLEA

SEQ ID NO: 116607 - protein, 141 aa, Glycine max
  Coding DNA Sequence Number=SeqID_24922
  Subcellular localization annotation: CTP_CleavageSite=53; ConfidenceScore=5.21e-01
MLISPCGSISWGRAHKTPSGPGGAKQGPGVSSSGYGPLSFLQGARPPQQGIAPARHPVDLEKPNRVLGFPALITGLCQFYGVHVAPSKVTRPPTNRAFIKKYCALRQAQGETPQQPEDSRQRAINAPPPLLEFTSAHPQKG

SEQ ID NO: 116608 - protein, 49 aa, Glycine max
  Coding DNA Sequence Number=SeqID_24923
MLQLRFLTLLSRPQRNGTHIFGILDILRRTRPSKVGMIPPPGIVPIARE

SEQ ID NO: 116609 - protein, 101 aa, Glycine max
  Coding DNA Sequence Number=SeqID_24924
  Subcellular localization annotation: CTP_CleavageSite=54; ConfidenceScore=5.15e-01
MPPTRHPLDPDKSNRALGFPALITGLCQSFGVPVTPSKSQGFAPFVCPTPDQFRAEVAWPGDWPEAQAGEAPAEAPDDGEEAGMDEEMSDLLGFLGGSGAT

SEQ ID NO: 116610 - protein, 25 aa, Glycine max
  Coding DNA Sequence Number=SeqID_24925
MAMDGYTLVYDQKTNMLWLGGGSKG

SEQ ID NO: 116611 - protein, 179 aa, Glycine max
  Coding DNA Sequence Number=SeqID_24926
MELLFLRSGLREEERTSIARFLSGLNMEVRDKVELLPYRDLDELVQLFKDKLTMKDKRDEEEKLENQKKKKDSKALSSKAKGKEKEEKDSSKKIVKKENHFATKCDIKRALLLKQSFYLLLSRATSLSTAITLELEVIPQVKELLDEGINEALGLNLALGLNLALGLNLELGLDLKRAD

SEQ ID NO: 116612 - protein, 99 aa, Glycine max
  Coding DNA Sequence Number=SeqID_24927
MDTARWALKHPVYGIVILRLGIYTDRPNDDVPKWKTLHDSGISKNTIDNNEVNTNVTVQTTSSHATGLLGHGNKKWGGRQKQGFCSYVSSMCDEELRPT

SEQ ID NO: 116613 - protein, 100 aa, Glycine max
  Coding DNA Sequence Number=SeqID_24928
MKKQQWKRRRRGEGRHHPLGNKPWKKELHYQECAMDKKLEEDALMEEKKERRGEHEIEGIKEGEKWNFEVCLIRLSFIKVTTSVTHASIYRLGSFLEKHS

SEQ ID NO: 116614 - protein, 119 aa, Glycine max
  Coding DNA Sequence Number=SeqID_24929
  Gene Ontology: Mol. function=aspartic-type endopeptidase activity; Biological process=DNA integration
  Homolog annotation: Hit_ID=A5C3F7; Match level="QueryCoverage=70%, HitCoverage=8%, E-value=1e-12, Identity=40%"; Hit description =Putative uncharacterized protein
MHIHGEDHKGKGDGNNEDFHIDEIKANVDLPREWRASRYHPLDNIIDDISKGQTKNGIFVNQSKYCKELIHRFGMENAKHMATPMNTACYLDKDETDQSIDIKQYRGLWYPKNSILVLF

SEQ ID NO: 116615 - protein, 236 aa, Glycine max
  Coding DNA Sequence Number=SeqID_24930
DLGAQSLKAIQRVHKAWRSPLRKDKELRGIRNGVIGGYHGWLRIHTRGLDWLSKLKVIDEEDFEAPEEDEEVRALKLELGKARLAKQKFKSAATHIRKECTELQEENAATAKALEQETKRARKEEYGREKFRGALSKRSLVQHLEATEQSMLAIIGQYKEELNQSVAHEQKLVEDFARVYAKKEARGRVIDALHQEATLWMDRFALTLNGSQDLPRLLAKAKAMAEVCTAPEEIMG

SEQ ID NO: 116616 - protein, 136 aa, Glycine max
  Coding DNA Sequence Number=SeqID_24931
  Subcellular localization annotation: CTP_CleavageSite=43; ConfidenceScore=5.34e-01
MPQQKGPVPPPSLIVIVSGAPSTNNASRPSKDGRSTKRRVQLREDEYTDFQEEIAHRRWTSLVTPKAKFDPEIVLEFYANAWPTEEGVKVSSVSSARGGTGPMGSMRKPLPSCCAHRGRISPGPPQGGGCGSCAPA

SEQ ID NO: 116617 - protein, 94 aa, Glycine max
  Coding DNA Sequence Number=SeqID_24932
CTICGEAHETGQCIPIEENTQEIHYMRNQQRQGYTPGGFSGFQHGPYNQQGQWRSHPGNQFNKDQGGLSNRPIQQGPNIFQRTTKLEETLTQFM

SEQ ID NO: 116618 - protein, 167 aa, Glycine max
  Coding DNA Sequence Number=SeqID_24933
  Gene Ontology: Mol. function=transporter activity; Cellular component= outer membrane-bounded periplasmic space; Biological process=transport
  Homolog annotation: Hit_ID=A8GKL9; Match level="QueryCoverage=67%, HitCoverage=33%, E-value=2e-42, Identity=84%"; Hit description =Taurine ABC transporter, periplasmic binding protein precursor
MAGKLFSLRNAALLALALSAASAYAVDVTVAYQTSAEPAKVAQAENSFAKRSGATVDWRKFDSGSSVLRALASGDVQIGNIGSSPLAVAASQKLPIEVFLIASQLGSSEALVPAGLAQALGHQAAGGVAGESADGGAGKRGAGACAAAGHPGADRAGRACGDRHCAG

SEQ ID NO: 116619 - protein, 166 aa, Glycine max
  Coding DNA Sequence Number=SeqID_24934
MGEVEEVQKQMKADMEAMKEQMATMMEAMMNMKKIMEANAVADTATSAVAKVNPMPPSGLNQMNHPTLAMVGKDLGSTGGPHYSQIQNKHAFSPYGLPPNYTPPNVAYTPSENVNNSTPILIESRQPQTDHSHVSQTVGETHEIPHHNLADFEPCLGYATEGQVVG

SEQ ID NO: 116620 - protein, 100 aa, Glycine max
  Coding DNA Sequence Number=SeqID_24935
MHMTQMQFTNTGAREIVPFLGYNVWAAWHPTYVFKKATRTLRRFAKVRGSRQNPCAMHMRKAQHGDVSRGIIPFEEHIAAVGTTSNDIFSKRKTLDEGSL

SEQ ID NO: 116621 - protein, 135 aa, Glycine max
  Coding DNA Sequence Number=SeqID_24936
MSGVRGGRGVGRGGGRIAAAQRVGQIGVELVGTDAQVGVKSRLRQHAGLRDQHGQVVAHARLVAIDGQFIGRLDGFARLALLRSFLFQQAQAVERVGDLVHGIEHGLVVVGHGQVGVGAAAGQVGVQFSAVEDRQ

SEQ ID NO: 116622 - protein, 75 aa, Glycine max
  Coding DNA Sequence Number=SeqID_24937
  Homolog annotation: Hit_ID=A6FJQ2; Match level="QueryCoverage=50%, HitCoverage=84%, E-value=3e-11, Identity=92%"; Hit description=50S ribosomal protein L5
MTVKTSDTCSSGDGHSLSMRKEKIPHQAPFAIQAAQLLGRAIGAGLFAITPAGERGMCCKAIKLGNARVFPVTTL

SEQ ID NO: 116623 - protein, 44 aa, Glycine max
  Coding DNA Sequence Number=SeqID_24938
ENEGGACHPARPSELGCFLQKAVPSGELPGRPKWAWLLFAPSVY

SEQ ID NO: 116624 - protein, 91 aa, Glycine max
  Coding DNA Sequence Number=SeqID_24939
VCIHRSSAGELVPFDLDIEATFRRNNAKRKRKLLHDRTVASILEEAHFSESSSSNSPTSRESQTTEFEAEVMAKEQPNQCDLGNHSSTSVS

SEQ ID NO: 116625 - protein, 81 aa, Glycine max
  Coding DNA Sequence Number=SeqID_24940
  Subcellular localization annotation: CTP_CleavageSite=31; ConfidenceScore=5.13e-01
MHEIRRPNSLKIVPSGVANGRNLPFGGRATRGSRVRLPWEENARSRHQRLFEENVGKTGKVWTTNFKCERFGSCIYTRGRY

SEQ ID NO: 116626 - protein, 56 aa, Glycine max
  Coding DNA Sequence Number=SeqID_24941
MMMIIICVSNSYVEKSLDEDDSVDGISDTDDEFTDIIQLVTIVHPTEGAEGIQNPF

SEQ ID NO: 116627 - protein, 1004 aa, Glycine max
  Coding DNA Sequence Number=SeqID_24942
  Gene Ontology: Mol. function=zinc ion binding; Cellular component =cytoplasm
  Homolog annotation: Hit_ID=Q9SB64; Match level="QueryCoverage=87%, HitCoverage=98%, E-value=1e-115, Identity=43%"; Hit description =Putative uncharacterized protein F22K18.110
  Pfam annotation: Domain name=PB1; Domain location=34-119; Score=46.8; E_value=7.4e-11; Accession=PF00564.15; Description=PB1 domain
  Pfam annotation: Domain name=UBA; Domain location=820-857; Score =21.6; E_value=0.003; Accession=PF00627.22; Description=UBATS-N domain
  Pfam annotation: Domain name=UBA; Domain location=867-904; Score =26.4; E_value=0.00011; Accession=PF00627.22; Description=UBATS-N domain
  Pfam annotation: Domain name=ZZ; Domain location=487-524; Score=31.7; E_value=2.7e-06; Accession=PF00569.8; Description=Zinc finger, ZZ type
  Pfam module annotation: Pfam domain module=PB1::UBA::UBA::ZZ; Domain location=34-119::820-857::867-904::487-524
MRLKRLTVFSLPSVSLLRFPSSVLACAPRAMDSALVIKVKYGDTLRRFSAHVDENNRLDLDMVGLRAKICSIFSFSADENLILRYVDEDGDLVTLVDDDDLRDVMRQQLKFLRIDVHMNNDGGDKSNAGSSGSATPSETCPVTSPFLLRNAMVREHLSKKAASSSPVVDNLANSILKMGLNSHFQPPDTAGKSSKTGVPEEPITKAMGPQSSHVDSASNASVNSDSATPIRSPIPNPYLSGNAVKVDVSCSVPEPVRQFFSKSSSSNAAASSSQLPANLADLISLVPEPVREFLSNLSHSNAASSNQLPVNLTDLVSLLGQSILNSHCQPHVATGPFAKNGVTEEPITSEARGQQIPSADSASNATQQVEAGVATIDLNAPPFDPFLAQFTCENKAPLSSEAPNGHGKKGKMPTVDSSAGKGDSSGISSSFAAPNNSTQTTSLTSGAFIECPFAGTYINSWTPLPGNSQMPPFKRSHSHTDAMSGMFHKGVRCDGCGVYPITGPRFKSKVKENYDLCNICFNEMGNGTDYIRMDRPASARAPRYLHGHTKNFPTLPPHIFKKGAILKHAKPKLDSRFILDVNVIDGTMMAPSTAFTKIWRMRNNGTIVWHKGTQLVWIGGDKFSDSHSVDLEVPEDGVPLEKELDIAVDFTAPPLPGRYISYWRMTTPSGHQFGQRVWVLIQVDASLKDSFYDNSQGLNLNIPLDISGSKGPHIIDINVQPTEDDTVLQTRKPNAPIEPLNQMVDEEPRLELENEFPINEATFVAPVASAPAATSVASSSVPCPIIDLSETTPAVPSNQQSPTVDVPSSSMGTGGGINSVEENLLKELEEMGFKQVDLNKEILRKNEYDLDQSLDALCGVDVCGVSEWDHMLEELQEMGFRDKEMNKRLLEKNNGSLKRVVMDLINGETTTPTYQKLIGQSVLTDVPRYPNGHLAFNNQHSHHKILSNARVGYDETTPAETEGGEVVDVERDQCTNKKIRVALNCTSGRPIGLKKLIATSLVCY

SEQ ID NO: 116628 - protein, 281 aa, Glycine max
  Coding DNA Sequence Number=SeqID_24943
MPSSYSNSSMGLIVNATAPASVLLLDEEHRQGEGAMAETNEAGVKHRLHLVFEFHFLTVRVSRWWNFSKRMVRSGGGGWLSGRRGGARGTSARNWIGLPRWVKVMEREVNGEAMPLYLKLDLRVAAGALKNTTVTNHYGDWRDWCGGEVEKLGQTQLHKIVRTATVNENGETMAADRAVDMKGSVDGGGDSGGLGLRVRGRSSSGMRRAISSGESRRTGNLEEGEEGEVGNEDEGWGGGVDGYGGDLKAYLPRASPGPWPEVNTWVAGPAPRGGGQGSSPI

SEQ ID NO: 116629 - protein, 590 aa, Glycine max
  Coding DNA Sequence Number=SeqID_24944
  Homolog annotation: Hit_ID=A7PCQ6; Match level="QueryCoverage=32%, HitCoverage=82%, E-value=4e-55, Identity=53%"; Hit description =Chromosome chr17 scaffold_12, whole genome shotgun sequence
MASTRQALRRPILGIRSQTDDAFYVARVVGDSEKMERRLGRETKGSLSLQKRMAETRRREKPAPDLTDFMNDMFFGAADMDHKTYDLTGSTGVHDDDYDDEGFDDSTRSNSARLTQEWLREARQIVASSPSRCDSPARPLGSPRFGATQPPSPLPSSSDRRDALSRTRSARRYRAMEGISDEILSKTAKHTRNKSDTFAQPSSDGDGSPATAVHNWFANILKPTNNNSNTQPSPSPPDSPKSSLPPRQPHPRKSRFKTEPSAAPHPQGIQPPNSRRTFKTSTPSPENSPSDSAPLSPPRNLVESAHRRTISSSTCSRERIAPRHAFPKGEEASLNGFLKEQRILLQKISRGELHAANAQIVLSGPSNSTASMVAAICHAWLLGYRQKENDGGSERVVVVPVMNVKRGSMWKLKQAAWLFHHAGLDANSLLFIDEVDMESLLMTGQLSVLVVGQDVLNTTGEVGSQCTVVTDNYCEDAYDLLQNYMLKKLLLAGILLDTQNLKASAAISMTRDAEAVQLLLVGSAPNYRYALFDQLMQDQKTASFVEALNHNYGKPHVESRGHIPFNLSRNLVNEIAKYMNLRNFIVTRNL

SEQ ID NO: 116630 - protein, 449 aa, Glycine max
  Coding DNA Sequence Number=SeqID_24945
  Gene Ontology: Mol. function=metal ion binding
  Homolog annotation: Hit_ID=Q2PEZ5; Match level="QueryCoverage=67%, HitCoverage=64%, E-value=1e-146, Identity=83%"; Hit description =Putative uncharacterized protein
MEVWDRRALKPSQSVERTVRRERLKKVNNVSEYVIINQSKRKRKRELGKEDELAQGIEFSTGLGCTHFPFVLHSLPRSQARSQSLFFLVAAEYKPTMLVVFHMGTNIIECASFCFNWRWNDGRVLVNKLPKRITRQFKVGPTFRLKLEWVIFLPLWMFHGVVARGRFSLPAPSAPRNRNWAPCHAVVATPLLIAFELLLCIYLESLYDRGYAAVGLKIVFLPLLTFEIIILIDNFRMCKALMPGDGENMSDEAIWETLPHFWVAISMVFFVAATVFTLLKLSGDVGALGWWDLFINFIIAECFAFLVCTKWSNPVIHRNSREASSSSSTTIGYLDWNSGLVVSTDENQPQGRICSLQDIGGHFMKIPIIVFQVLLCMHLEGTPACAVYIPLPVIFSPLFLLQGAGVLLSASKLGEKLVLLLRSGAGGGIYFRFSSRAHDCLGFLCHGSR

SEQ ID NO: 116631 - protein, 470 aa, Glycine max
  Coding DNA Sequence Number=SeqID_24946
  Gene Ontology: Mol. function=O-sialoglycoprotein endopeptidase activity; Cellular component=nucleus; Biological process=proteolysis
  Homolog annotation: Hit_ID=Q93YU6; Match level="QueryCoverage=92%, HitCoverage=96%, E-value=1e-140, Identity=55%"; Hit description =Putative uncharacterized protein At3g56120
  Pfam annotation: Domain name=Met_10; Domain location=94-280; Score =150.7; E_value=3.9e-42; Accession=PF02475.7; Description=Met-10+ like-protein
MLDESKFEVHFKLWALRIPCQHCKLATRILNGYLLDKPRVKPITEDPTCDKNRYLILSDNVHNQDLSDIPKQKLDELKGLCEIEVVPYSLTLGYSYWSADHVLKQILPTGVEKNYPRIKTIVNKVGTITNEFRVPEFEILAGEHNMITEVKQYGATFRLDYSLVYWNSRLEHEHKRLVSMFQAGETICDMFAGIGPFAIPAAQKGCIVYANDLNPDSIHYLRINAKINKVGDCIYAYNMDARKFISQMMEVPNTEVTLENSHEVPILDTRDNAESNSKNELLTVDTKDLGDSNNSGLEDVNGSTRHTATSVIAGKRSSTSYHEGNGEAHGTDILEGGRRKGSANKRMRGSEISVTKTWEHVDHIYRQISDSRYALPDAFRGLIQKKYWKGCLPWIHCYCFIRATETPETIIAVAESALDAHIQDSRFHRVRDVAPNKNTITSTIPYSWLLLFTYCAGNVLFKLQVARSMP

SEQ ID NO: 116632 - protein, 78 aa, Glycine max
  Coding DNA Sequence Number=SeqID_24947
MQAKTQQHDEKQGRRRRKRMSMKDEEKVNKLRDKISRIKRDGLEEYEVRPCYRSSDIGHLGCVEFKSSQNILKPYSII

SEQ ID NO: 116633 - protein, 54 aa, Glycine max
  Coding DNA Sequence Number=SeqID_24948
MGRERKKKKKKKKRDRGGKVKSEERKMAFDPKKNARFGKWMEREHFDASRWIPP

SEQ ID NO: 116634 - protein, 169 aa, Glycine max
  Coding DNA Sequence Number=SeqID_24949
  Gene Ontology: Cellular component=integral to membrane
  Homolog annotation: Hit_ID=A7PEW1; Match level="QueryCoverage=70%, HitCoverage=40%, E-value=2e-38, Identity=68%"; Hit description =Chromosome chr11 scaffold_13, whole genome shotgun sequence
MEVTVTLTVVVKAIQWWGWGIGGARSLRVDFQFVKKGTNGGVTKRGLLAAAAAGSVIGLSFVLLGISATRCEGKGSTVLKQLPVIPVATLAGLCGSVIDSLLGATLQFSGFCSIRGKMVGKPGSTVRRISGANILDNNAVNFVSIMLYSHSSIGKVDFTNIIIKTVFGS

SEQ ID NO: 116635 - protein, 373 aa, Glycine max
  Coding DNA Sequence Number=SeqID_24950
  Gene Ontology: Mol. function=oxidoreductase activity; Cellular component=integral to membrane; Biological process=electron transport
  Homolog annotation: Hit_ID=A5BVE3; Match level="QueryCoverage=61%, HitCoverage=65%, E-value=1e-59, Identity=42%"; Hit description =Putative uncharacterized protein
  Pfam annotation: Domain name=Ferric_reduct; Domain location=105-225; Score=-6.2; E_value=0.0021; Accession=PF01794.10; Description=Ferric reductase like transmembrane component
MACSTTLLAAILKLLIIFLFAGLSFAVYTFPIVAIAILGLLLLDLKAGYQRSRSARSPSKSNFFSNPLVHGPTTRISADFKKLMPYKSLKLNTWQLKYHKIAIRFGLLAEPCMALLLLPILRGLAVFRILGIQFEASVRYHTWVGTAMIIFATIHCASTLLVWGISHHIQDEQVISSLIIFFKQIWKWQKTGRKYLAGEIALFFLFHAGDRHFYPVFPGIFLFSLDKLIRIIQSSPKTCMVSARIFPSRAVELILPEDPGWWANSLYDLIHAELDKTADTRKGIPVAIEGPYGPASLDFLRILLHHFPYFPYLFQPYYNSFWKALQNGQRKDSLLGCGSSSDSCFYPSFSLQRLGGSYFEMEKAEERDSAKIA

SEQ ID NO: 116636 - protein, 195 aa, Glycine max
  Coding DNA Sequence Number=SeqID_24951
MAGRKVLIKSIVQSIPSYVRSCFLFLVTTCSQIDSMTSCFFWGGSLEPLIWLCCLNNGGEFFVLENSLLSVTLEVKYYPRTHPLCAKVGSNCSYIPGPTKSACKKIIPVKESLWKKSICQDEDRNKTGFGVVFRDAEGRVLGGATDLRQVGYQPHIAEVLCFKWALKVASQMCFHMIILKLIMFKFIMLGIARMA

SEQ ID NO: 116637 - protein, 45 aa, Glycine max
  Coding DNA Sequence Number=SeqID_24952
MGLVASSYFDPARRAVVAKIVFMDDAAGYYLKPNQLLIKIMNDLR

SEQ ID NO: 116638 - protein, 416 aa, Glycine max
  Coding DNA Sequence Number=SeqID_24953
  Gene Ontology: Mol. function=DNA binding; Biological process =regulation of transcription
  Homolog annotation: Hit_ID=A7PEX1; Match level="QueryCoverage=79%, HitCoverage=67%, E-value=2e-84, Identity=54%"; Hit description =Chromosome chr11 scaffold_13, whole genome shotgun sequence
  Pfam annotation: Domain name=Myb_DNA-binding; Domain location=193 -263; Score=26.2; E_value=0.00012; Accession=PF00249.22; Description =Myb-like DNA-binding domain
MSLVGTAMEASRQQLQAFKVNHGAKPVLEEFIPMKHLASESSEKATNMSDKANWMTSAQLWSQASSEGTKQQPPITTLKESDIGFSISPKLALDNKQRNGGGAFLPFSKERNSCQGSTLRPLPELVLASAEKEMEDKKRAEVEIKGVSCQSRKENSGSDGAVVDQGKGGSPVASSHAQTTTTTTSAQTHRKARRCWSPDLHRRFVNALQMLGGSQVIKKGPLDSESHAELIFDTVATPKQIRELMKVDGLTNDEVKSHLQKYRLHTRRPSPSPQAGAAAPQLVVLGGIWVPPEYATAAHTATPTLYGAHPTSHAPPPHYCAATPMPQDFYTAAPPQPLLPPPPQHHNALHHLHMYKAASHGHGSPESDVPGGGERSESIEDGKSESSSWKGESGENEGERKGIGEESNGSEITLKF

SEQ ID NO: 116639 - protein, 155 aa, Glycine max
  Coding DNA Sequence Number=SeqID_24954
LKINQICGILINGGEMMVGQRRVRRRGRGATKVKGRHGGRATRLRVEWGGEAWRRVRQVKMGKPRKEKRGEVKKEDRRQRRSNIEGWSRFGFSCRNWELGIGEKNKEMEMQGISRGVNLDPQTRILAGTAPVWGPVDEDFFPSGMGTRINIPPWA

SEQ ID NO: 116640 - protein, 243 aa, Glycine max
  Coding DNA Sequence Number=SeqID_24955
  Gene Ontology: Mol. function=carbon-sulfur lyase activity; Cellular component=vacuole
  Homolog annotation: Hit_ID=A7PCU3; Match level="QueryCoverage=79%, HitCoverage=41%, E-value=6e-53, Identity=58%"; Hit description =Chromosome chr17 scaffold_12, whole genome shotgun sequence
  Pfam annotation: Domain name=Alliinase_C; Domain location=90-242; Score=-75.4; E_value=1.1e-09; Accession=PF04864.4; Description =Allinase, C-terminal domain
MAKLAVPPLLSLRHFLVLSIALNVSLILRTVYYESEKGSKGFCLNKKMMADADSDREGHLIHKSRLAMSSTSSLVNSTRADHPGGRETVINLDHGDPTIYERFWRQVGDKTTIIIPGWQSLSYFSDGSNICWFLETEFAREVVRLHKVVGNAVTEGRHIVVGTGSSQLILAALYALSSPDAAEPISVVSAAPYYSEFSHVLITESASTFGPSRCLSSSMSFPLSHEPEPDHMKTCGKQSNVLN

SEQ ID NO: 116641 - protein, 763 aa, Glycine max
  Coding DNA Sequence Number=SeqID_24956
  Gene Ontology: Mol. function=kinase activity; Cellular component =nucleus; Biological process=DNA mediated transformation
  Homolog annotation: Hit_ID=A7PHD1; Match level="QueryCoverage=95%, HitCoverage=99%, E-value=1e-173, Identity=49%"; Hit description =Chromosome chr17 scaffold_16, whole genome shotgun sequence
  Pfam annotation: Domain name=Bromodomain; Domain location=170-259; Score=99.2; E_value=1.3e-26; Accession=PF00439.16; Description =Bromodomain
MGKSRKYSKGHATGFVPDFRHAVETMGESEGLGNLGRVDNELTMSEISCAPKRKRVDESFDVPFQLLSLTKMARSGRKDLTLRLKSELEEVRKLQKKIAGMSSITTELSPYSDIRSCSVGEKRPPLESLALHGKKRPLLKHNGPKTKRSISGRFISAKSAAPVTPSYAVLMKQCETLLKRVMSHQFGKVFDKPVDIVKWNIPDYFTIIKHPMDLGTVKSKLISCEYTSLMDFAADVRLTFSNAMSYNPPGNDVHVMAETLSKYFETRWKPIEKILAIDDVPSEPSKPTTCIEKSEIVDPPVKKKKITPNGTNVKPEPIKRIMTGEEKQKLSMELDASVVELPENIIDFLKEQSYNASQINDDEIEIDIDALSDDTLFKLRKLLDDFMLEKQKTLAKPGPCEIQPANESGFSNSLQQCEGNEPIEEEVDIVGGDDPPLPSYPPAEIENGGTNKTSEHSSSSSSSESGSSSSDSESDSEPGIAKASDHFNPMKEKVGSGLSIDQKEGNLDNSETEIDSMNAAGHVEQSSQTDSVSDEPENHQEGENAPSKKQVSPDKLYRAALLRSRFADTILKAQEKTLEKGDKWDPEKLRMERKELERRQKEEKARLQAEAKAAEEVRRKAEAEAATEAKRKRELEREAARQALQKMEKTIGISESSQFLEDLEMLSGLLDEHLPNFTEERSPDHLENGLGSFKLQGSCNPLEQLGLYMKADEEEEEEEMPQSTTRETNDSITPGLALMKNVIEEARMKGHKHWFWFLGKEMV

SEQ ID NO: 116642 - protein, 157 aa, Glycine max
  Coding DNA Sequence Number=SeqID_24957
  Gene Ontology: Mol. function=hydrolase activity; Cellular component =membrane; Biological process=multicellular organismal development
  Homolog annotation: Hit_ID=A5B2V2; Match level="QueryCoverage=73%, HitCoverage=27%, E-value=2e-33, Identity=61%"; Hit description =Putative uncharacterized protein
MAHKICISHFGYAAIVSGLILGNSMRRRITPWLWIVEALEHALEPLIVWAEHLVPREMQGKTPVFVLATAELRRLPREEASRVLGDVEAVVKDHNFMFSKSWIRFLSGREEAYYGWVALNHKMGMFDSYPGSPTLGLVDLGGSSLQVVVEIDGAGDD

SEQ ID NO: 116643 - protein, 112 aa, Glycine max
  Coding DNA Sequence Number=SeqID_24958
  Homolog annotation: Hit_ID=A7PCV8; Match level="QueryCoverage=33%, HitCoverage=14%, E-value=3e-13, Identity=92%"; Hit description =Chromosome chr17 scaffold_12, whole genome shotgun sequence
MELMRTVYPTTAVPLPLSNLPVRTNFAVRCSNVHSQPQLDSRKLVLAVKEKLEKEHHSLPVGRNGRDDEDMILWFLKDRKFSVDDAIYKLTKAIVSFFSLLYHSGILFIIIV

SEQ ID NO: 116644 - protein, 1443 aa, Glycine max
  Coding DNA Sequence Number=SeqID_24959
  Gene Ontology: Mol. function=structural molecule activity; Cellular component=cytoplasmic membrane-bound vesicle; Biological process =multicellular organismal development
  Homolog annotation: Hit_ID=A7PCW2; Match level="QueryCoverage=96%, HitCoverage=86%, E-value=0.0, Identity=37%"; Hit description =Chromosome chr17 scaffold_12, whole genome shotgun sequence
  Pfam annotation: Domain name=Extensin_2; Domain location=51-327; Score=-137.0; E_value=0.062; Accession=PF04554.4; Description =Extensin-like region
MQGVPQPKNEEFSLSSGDFPTLGSDKDKSVLNSELQDHSSQAHLDSSYELRKDINETPVTDDVPVNANIKGGTVNSWRRDNLAYNEEGVRSGIEKWQGNSQPYPNAGIPPQPYDAWHGPPVNNPQGCVWFRGPPSGPPFGNPVPPSGFPIEPFPYYRPHMPPTGLANPPPGPPPGAGPRGHHKNGDVYRPHMPDAFIRPGIPMRPGFFPCPMAYEGYYSPPMGYCNSNERDVPFMGMAPGPPVYNRYLNQNAPEPDNSQGRSGGYGNAGEQLTSEQVESGHPPDTAGPYRVLLKHHESDGKNEPTNWENSETTNATHVDGRGQPRMTVWENEQRSNYRKNEERDFRTSTRGEVSSRSSENQISSSSVMKAKFPESSGNIKKSDDISARKLDGVASDMLEIPLKPSAPKDATLIQKIEGLNAKARDNSSARIREEQRNKIHASNAPINHVENAVGADVVFPARTHATEIINPAHHEMGAAGAEKNSESLSFSGTATSRQAAHGMHGRGIHRNKGRSNNQDADGWRKKSVVEDSSASSGAQLEASNVLVGDHQIPVQTYDRSGSFNKARHIGESVQTRSDPADSHAQRAKMKELAKQRTKQLQEEEEERIRKQKAKALAKLDELNRRSQAGDGSTEKEYATNSAIQNKQEELQPSESTTAAGKFAPVSSAVNCNANTICQINDPSISKVEKSPVLFGEPIVETLKNSGKEPVLNHQAVALHQDINNAGATNVHNYVTSKQKRMNYKQKQNLPLEKTSSEKVVSTTSTALKVENETRVDVSLSSGGVTNDVGSACGSDLPMNSAALVESSVNLKKKNIRNGKNKQKHEESSSQAALPSAIPKESNLSKSSVESDKSKASDFELDQGSLQPAPLSKDPNQFSEQHKYLANEESHGKMNSQWKSQHSRRMPRNTQANRPAEKSHGTDAVMWAPVKPQSKSEIMDELSEKSKVEAVDPVKSEQQVHNLKNKRAEMERYIPKPVAREMAQQGNIQQVASSSSQAPTDDSIGRLDSASQGPQVIQQTNLVVGKVGSGMESKNRDGRHTKQGKAHGSWRQRNITESTNVHDVLDHDSNSEPNVQRQTEHHHDQKSEVSFVKGQTKHFNDSGDIDGSNNSNRNDTAALASVPVIKDHSATSRGRRAPFRGHRGAGGNRDVDDKKNSGEAEKVETRISSSEHGQPDVGVVASKENRAVGERLMSQWQPKSQASNNHRGNISSDQNVSSVVVGANKKDPTHDGESLPVNRGKSSNAHVSQPFHDQSVSEKSKAGEVPHFGNQEGKRERKSAPSKRHHHSPNEVSVTSVEQAPTSADLLHDQRPSSGSGKNVNHNRFRRGHELHGDSKPPTQDNRHYNQPTNRERQGPNLHYEYHPVGSYDDGKSDNFERPKNGNHGGGRFREREFHPSINCAPIFSRVFRRINYLLMFSMYSAGQGTMKMVSPFLWGGGGRVPCG

SEQ ID NO: 116645 - protein, 241 aa, Glycine max
  Coding DNA Sequence Number=SeqID_24960
  Gene Ontology: Mol. function=hydrolase activity, acting on ester bonds; Cellular component=cytoplasm; Biological process=lipid metabolic process
  Homolog annotation: Hit_ID=A7PCY9; Match level="QueryCoverage=99%, HitCoverage=98%, E-value=1e-79, Identity=58%"; Hit description =Chromosome chr17 scaffold_12, whole genome shotgun sequence
  Pfam annotation: Domain name=Lipase_GDSL; Domain location=5-204; Score=119.6; E_value=9.4e-33; Accession=PF00657.13; Description=GDSL- like LipaseAcylhydrolase
MRSKIVLFGDSITEQSIRENGWGVPLANAYSRRADILVRGYGGYNTKWAMFLLDHLFPLDSTKPPIATTIFFGANDAALLGRTSERQHVPIEEFKENLRKFVRHLKQMAGCTLVLPSKANILNAFWECSPTMVIVLITPPPLSEEGRLAYARSVNGENATKIPERTNEVTGQYANACVEVAKEMGVWDGLHLTTEGNAVVYEELIKVFDEAGLSAVNMPMDFPHHSKIDSKHPERAFQQHV

SEQ ID NO: 116646 - protein, 214 aa, Glycine max
  Coding DNA Sequence Number=SeqID_24961
MSQVAALVPSALQVAFLSGTSAVSIQHHLLQEVSATTLPSPYIAARVIHQQNDEVDVGDAFARLLLPCVRRRHFLQRPDQTIYPVVHASVTSVPVETARRPRLTMRTLMFEEARETANDSHELEGVAEGTYCVWTPPCKRQAPCPSAGRFEIFCLGESQRWESGARKRKRDMVVEKERKQKHKVKEDKEAIVDQGRCGELTHLELLLVAGEGKS

SEQ ID NO: 116647 - protein, 730 aa, Glycine max
  Coding DNA Sequence Number=SeqID_24962
  Gene Ontology: Mol. function=binding; Cellular component=kinesin complex; Biological process=proteolysis
  Homolog annotation: Hit_ID=A7PD12; Match level="QueryCoverage=99%, HitCoverage=99%, E-value=0.0, Identity=58%"; Hit description =Chromosome chr17 scaffold_12, whole genome shotgun sequence
  Pfam annotation: Domain name=TPR_1; Domain location=312-345; Score =19.8; E_value=0.01; Accession=PF00515.19; Description=Tetratricopepti de repeat
  Pfam annotation: Domain name=TPR_1; Domain location=354-387; Score =5.9; E_value=1; Accession=PF00515.19; Description=Tetratricopeptide repeat
  Pfam annotation: Domain name=TPR_1; Domain location=436-469; Score =26.8; E_value=8.1e-05; Accession=PF00515.19; Description =Tetratricopeptide repeat
  Pfam annotation: Domain name=TPR_1; Domain location=478-511; Score =5.0; E_value=1.3; Accession=PF00515.19; Description=Tetratricopeptide repeat
  Pfam annotation: Domain name=TPR_1; Domain location=521-554; Score =11.6; E_value=0.22; Accession=PF00515.19; Description=Tetratricopepti de repeat
  Pfam annotation: Domain name=TPR_1; Domain location=562-595; Score =2.6; E_value=2.6; Accession=PF00515.19; Description=Tetratricopeptide repeat
  Pfam annotation: Domain name=TPR_1; Domain location=604-637; Score =13.3; E_value=0.13; Accession=PF00515.19; Description=Tetratricopepti de repeat
  Pfam annotation: Domain name=TPR_1; Domain location=646-679; Score =8.1; E_value=0.56; Accession=PF00515.19; Description=Tetratricopeptid e repeat
  Pfam annotation: Domain name=TPR_2; Domain location=269-301; Score =2.4; E_value=15; Accession=PF07719.8; Description=Tetratricopeptide repeat
  Pfam annotation: Domain name=TPR_2; Domain location=312-345; Score =24.3; E_value=0.00044; Accession=PF07719.8; Description =Tetratricopeptide repeat
  Pfam annotation: Domain name=TPR_2; Domain location=354-387; Score =13.3; E_value=0.65; Accession=PF07719.8; Description=Tetratricopeptid e repeat
  Pfam annotation: Domain name=TPR_2; Domain location=396-429; Score =3.1; E_value=12; Accession=PF07719.8; Description=Tetratricopeptide repeat
  Pfam annotation: Domain name=TPR_2; Domain location=436-469; Score =20.6; E_value=0.0058; Accession=PF07719.8; Description =Tetratricopeptide repeat
  Pfam annotation: Domain name=TPR_2; Domain location=478-511; Score =12.1; E_value=0.94; Accession=PF07719.8; Description=Tetratricopeptid e repeat
  Pfam annotation: Domain name=TPR_2; Domain location=521-554; Score =17.8; E_value=0.042; Accession=PF07719.8; Description=Tetratricopepti de repeat
  Pfam annotation: Domain name=TPR_2; Domain location=562-595; Score =3.1; E_value=12; Accession=PF07719.8; Description=Tetratricopeptide repeat
  Pfam annotation: Domain name=TPR_2; Domain location=604-637; Score =14.2; E_value=0.48; Accession=PF07719.8; Description=Tetratricopeptid e repeat
  Pfam annotation: Domain name=TPR_2; Domain location=646-679; Score =6.2; E_value=5.1; Accession=PF07719.8; Description=Tetratricopeptide repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2::TPR_2::TPR_2; Domain location=312-345::354 -387::436-469::478-511:...
  Pfam module annotation: Domain location=:521-554::562-595::604 -637::646-679::269-301::312-345::354-387::396-429::436-469::478 -511::521-554::562-595::604-637::646-679
MPEIVTNGVNDERRVNEMNEIGNISPLRETPSPIKNLRSSLSPQRRQSVGPNFPVNRVIDTSSIDRLHGNVCDKQSSSQSPSRQSFGSDGNESKTDSELHNLVKEGVKKKTKGDSRSEASSKMGSLSNDKKLDRIRPATASGVVSQKLKKASQSQLALEFPSRSRPKGKSPPPKPPVDRKNDNNPLGKQNTRVIRVKKTVGGRSLSQSHIENFTGSALDRPDLGLALLNQARNMISSGDNPMKALELSLQAMKLFERAAAYGKPSLDLAMCLHVTAAIYCSLGHFSEAIPIIERSIEIPTIEEDHQHAIAKFAGHMHLGDIYAMLGHLEKSIKCYTEGLKVQRKALGETDPKVGETCRYVAEANFQALQFDEAERLCQIALDIHRANGSPSSLEEAADRRLMGLICEANGKHEAALEHLVLASMAMVANGQHVEVASVDCNIGDTYLSLARYDEAIFAYQRALAVYRTHKGENHPSVGSVFVRLADLYCRTWKIRESKSYCESALKIYENPMPGVPPEEVASGFMNVSAIYESMNELEQALKLLHKALEILNEASGQQNTIAGIEAQMGVMYYVLENYTESYNTFKNAVSKLRATGEKKSAFFGTVLNQMGLACVQLHALDEAVELFEEARVILEQENGPYHPETLGVYGNLAGTYDAIGRLDEAIEILENIVVMREEKLGTANPDVVDEKRRLDELLKETGRVRNRKTKSLEILFDANPRTIKNLVVEA

SEQ ID NO: 116648 - protein, 88 aa, Glycine max
  Coding DNA Sequence Number=SeqID_24963
  Homolog annotation: Hit_ID=A7PCX7; Match level="QueryCoverage=62%, HitCoverage=33%, E-value=1e-11, Identity=64%"; Hit description =Chromosome chr17 scaffold_12, whole genome shotgun sequence
MVKCHNYCVDIFVFRPSVSARITPMASKEYGTRAVLGAAICFPLGWIHLKLVKMANEGNPAAHPHSDQREVKSGVSAAIERLEGNLSK

SEQ ID NO: 116649 - protein, 346 aa, Glycine max
  Coding DNA Sequence Number=SeqID_24964
  Homolog annotation: Hit_ID=A7PCY1; Match level="QueryCoverage=89%, HitCoverage=93%, E-value=1e-101, Identity=57%"; Hit description =Chromosome chr17 scaffold_12, whole genome shotgun sequence
MRFVTGSPKGTWQPIMTADTTTESYWLNWRVLVCAILVLFSAIISSLIVLKYEVSRKKARNGDKEGLNLKETSSTLYEDEIWRPCLKGIHPVWLLGFRVFAFVVLLVLLILTATEDGGSIFYFYTQWTFAAVTIYFGLGSLLSMHGCYQHLKKASGDKVGNVDGDAEQGIYDASTPPQGSNPSNHEKGLGAPQEHLVRQPASTWGYIFQILFQMIAGAVMLTDCVFWFIIVPFLTIKDYNINLLIISMHTINAVFLIGDTALNSLRFPWFRIGYFCMWTITYVLFQWIVHAIVKLWWPYPFLDLSSPYAPLCASKLLFHGIAAYSVLWHIRFDNEAEAQRVVDAVP

SEQ ID NO: 116650 - protein, 46 aa, Glycine max
  Coding DNA Sequence Number=SeqID_24965
MEKFESSMTKIMYHIPKAVASSQSSLGVNNMEKVRAKKLNKGEKRI

SEQ ID NO: 116651 - protein, 166 aa, Glycine max
  Coding DNA Sequence Number=SeqID_24966
MKEFYHTVRQVEVEDALRQGESESLWCKILRSKYGEGYSSGEVSKREQDTGVWWVEGWGMVMAELVGVGKTDGRKVDGGGFEMPVLQCMQGECQSFVVPMQVLDKYLEQVLQLAGSGDGTAQRSSEALCSTPYGKLLEETSKLGFGSMVRNNMGPMAAPKWDYLSQ

SEQ ID NO: 116652 - protein, 57 aa, Glycine max
  Coding DNA Sequence Number=SeqID_24967
MTRRKRESEVVVKSGRRRKRIREWKMGKALEGEVSVNIGTTPGKTECHNEEKARSRS

SEQ ID NO: 116653 - protein, 126 aa, Glycine max
  Coding DNA Sequence Number=SeqID_24968
  Homolog annotation: Hit_ID=A7PD37; Match level="QueryCoverage=88%, HitCoverage=41%, E-value=3e-24, Identity=54%"; Hit description =Chromosome chr17 scaffold_12, whole genome shotgun sequence
MPGPGPHLMYAMGSGLCLTSISNGRFSPHHTLFYTINAFFGPDVGSFTEWLGSLFGGSAHAFGSALEDLTHHPLFYILLLGLPLSFLYSRISSYLLHTQLLDSLSRVGLPLPFSFHFLVVENSGFT

SEQ ID NO: 116654 - protein, 91 aa, Glycine max
  Coding DNA Sequence Number=SeqID_24969
MTSSSSCSSSIQIKSGPIDGDVLWMQAKHVSENVWNEESDRKLHIRRVVPIYQGQEEIPKKIIHLLRQSRFLLDNEDGLPKNKFVINYCLD

SEQ ID NO: 116655 - protein, 63 aa, Glycine max
  Coding DNA Sequence Number=SeqID_24970
MVSAGIEGGVMTAIAMVLGGSNDSEGSNGKRDTQAVTRVAVKVETMAVGAAKTRKVVAQCGVR

SEQ ID NO: 116656 - protein, 552 aa, Glycine max
  Coding DNA Sequence Number=SeqID_24971
  Gene Ontology: Mol. function=transporter activity; Cellular component= membrane; Biological process=transport
  Homolog annotation: Hit_ID=Q27GI3; Match level="QueryCoverage=99%, HitCoverage=99%, E-value=0.0, Identity=76%"; Hit description =Nucleobase-ascorbate transporter 6
  Pfam annotation: Domain name=Xan_ur_permease; Domain location=50-464; Score=159.2; E_value=1.1e-44; Accession=PF00860.11; Description =Permease family
MAGGGGAPAPKIDEPQPHPPKDQLPNVSYCITSPPPWRTWVLIYESAIEAEAILLGFQHYLVMLGTTVLIPTALVPQMGGGNEEKAKVIQTLLFVAGINTLLQTLFGTRLPAVIGGSYTYVATTISIILSGRFSDEPDPIEKFKRIMRATQGALIVASTLQIVLGFSGLWRNVARFLSPLSAVPLVSLVGFGLYELGFPGVAKCVEIGLPELILLVFISQFVPHVLHAGKHVFDRFAVLFTIAIVWLYAYLLTVGGAYNHAAPKTQSTCRTDRSGLIESAPWIRVPYPFQWGAPTFDAGEAFAMMMASFVALVESSGAFIAVYRYASATPLPPSILSRGIGWQGVGILLSGLFGTGNGSSVSVGNNFLVDEVFVWFPYRENAGLLALTRVGSRRVVQIAAGKFGAVFASIPPPIVAALYCLFFAYVGAGGLSFLQFCNLNSFRTIFVLGYSIFIGLSVSQYFNEYTAINGYGPVHTKARWFNDIINVPFQSKAFVAGCVAYFLDNTLHKKEAAIRKDRGKHWWDKYRSFKTDTRSEEFYSLPFNLNKYFPSV

SEQ ID NO: 116657 - protein, 293 aa, Glycine max
  Coding DNA Sequence Number=SeqID_24972
  Gene Ontology: Mol. function=spermidine synthase activity; Cellular component=cytosol; Biological process=spermidine biosynthetic process
  Homolog annotation: Hit_ID=A7PD36; Match level="QueryCoverage=90%, HitCoverage=74%, E-value=1e-105, Identity=68%"; Hit description =Chromosome chr17 scaffold_12, whole genome shotgun sequence
  Pfam annotation: Domain name=Spermine_synth; Domain location=18-250; Score=251.7; E_value=1.6e-72; Accession=PF01564.8; Description =Sperminespermidine synthase
MERRRVMEHLKTYPAFPGWYADVSWPGEAHIYKMEKILFHGKSEFQELLVFETSRHGKIAIPDGYIQLTENDEFAYQEMLIHLALCSIPNPKKGGDGGILREISRHSSVEHIDICEIDKMVIHVYKKFFPDIAVGYEDPRMHVHIRDGVAFINSVPEGAYDVIILDAFPAMGHSADVLADKCFLESIAKALRPRGVLLWHTNSEVADTIANCKIFKGSVNYAWATVPAYVSGAIGFMLCSTEGPPVNFKHPINKLNPEKNGVAKGPPKFYNSEIHATAFFCGQGWLIQQDIHK

SEQ ID NO: 116658 - protein, 111 aa, Glycine max
  Coding DNA Sequence Number=SeqID_24973
MRDEEAKRNQGCCGGEIRRGKEWRRERRRGEEKESGDEEKEMRCDSDTNSDDGVAVVAMTMTMTMMETMVVAMTIRTKVTSSGDDVSGGCYNNDNDDNNESDDYMIVMMTQ

SEQ ID NO: 116659 - protein, 69 aa, Glycine max
  Coding DNA Sequence Number=SeqID_24974
  Gene Ontology: Mol. function=metal ion binding
  Homolog annotation: Hit_ID=Q53J16; Match level="QueryCoverage=76%, HitCoverage=28%, E-value=5e-15, Identity=75%"; Hit description =Pollen-specific protein SF3, putative
MTGSLDKSFEGVPRSVRVERSADQVQTNKVSRLFSGTQEKCVGCKKTVYPIEKLFTNFAYDLIISSKLG

SEQ ID NO: 116660 - protein, 372 aa, Glycine max
  Coding DNA Sequence Number=SeqID_24975
  Gene Ontology: Mol. function=calmodulin binding
  Homolog annotation: Hit_ID=A7PD63; Match level="QueryCoverage=87%, HitCoverage=98%, E-value=1e-123, Identity=68%"; Hit description =Chromosome chr17 scaffold_12, whole genome shotgun sequence
  Pfam annotation: Domain name=Calmodulin_bind; Domain location=81-370; Score=489.9; E_value=3.2e-144; Accession=PF07887.2; Description =Calmodulin binding protein-like
MSLKRPPDDGKTPDDKRRKPPPFSSVVRDVMKLQALGHLLEPILEPLVRKVVKEEVEAALKRHLTSMKQTCGKEFHTTELRNLQLQFENSICLPVFTGARIEGEDGSNLRISLVDALTGKVVSTGPESSAKVEIVVLEGDFEEESETWMPEEFKSNIVREREGKKPLLTGDVILYLKDGIGMVGEISYTDNSSWTRSRRFRLGARVVDNFDGVGIREAKTESFIVRDHRGELYKKHHPPSLSDEVWRLEKIGKDGAFHKRLSREKILTVREFLTLLNLDPAKLRSILGTGMSAKMWEVTVEHARTCVLDTTRHVYFPSNSQEPGVVFNAVGQVTGLLSECEYVTVEKLTETEKAFIPHHLLLSLLFPSFSSL

SEQ ID NO: 116661 - protein, 323 aa, Glycine max
  Coding DNA Sequence Number=SeqID_24976
  Gene Ontology: Mol. function=mannosyl-oligosaccharide 1,2-alpha -mannosidase activity; Cellular component=membrane; Biological process=DNA repair
  Homolog annotation: Hit_ID=A5BQ27; Match level="QueryCoverage=42%, HitCoverage=25%, E-value=2e-59, Identity=82%"; Hit description =Putative uncharacterized protein
MEKKRKRKQQVKRDGEPKPKSVRAGSTRTDNVKDPFPSHARPTPQECEAVRDTLLALHGIPPELAKYRKLPPSDEPVQLQPPEPVLDGLVRTVLSQNTTEANSQKAFASLKSSFPSWEQVLWAESKDVENAIRCGGLAPTKASCIKNVLRCLRERRGELCLEYLRDLSVDEVKAELSLFKGIGPKTHDELKPISKTFTNSLSELGNLKLEHLPQDYNGSALTLIESLSSLVIMGNYTEFERAVLWLSENLTFDVDARINLFECNIRVLGGLVSAHLLASDSSKKFFQGAYKNQLLALAEDLGKRFLPAFNTPTGLPYAWINLK

SEQ ID NO: 116662 - protein, 379 aa, Glycine max
  Coding DNA Sequence Number=SeqID_24977
  Homolog annotation: Hit_ID=A7PD81; Match level="QueryCoverage=99%, HitCoverage=99%, E-value=5e-38, Identity=63%"; Hit description =Chromosome chr17 scaffold_12, whole genome shotgun sequence
  Pfam annotation: Domain name=DUF1777; Domain location=81-187; Score= -71.6; E_value=0.015; Accession=PF08648.3; Description=Protein of unknown function (DUF1777)
MEEEKAAAYYDELARKGEGAARFKQGLGFSSSAPNDDVPKPSSSFLSKFVKASSESEKQAQLQSIHDKLKKNPSSESRVSSSDRSRSREKRRKRSRSGDRYRETRRRSRSRERHRDSERGRRRSRSVSPRKQRRSEKDANYRGKVSETKKGKNAEIDYSKLIQDEDDVLMLCHRASWCMIDMRFRICQASSVFKVETLYWISNLVTLGYVSQKMSATCFFLNSLYYWLKFVSRFMDICCCYCLQSSAERVKAKMKLQLSETVAQDSEKGVGWERFEFNKDAPLDDEEVEVAEDDASLVKHIGQSFRFSAVEARREEQIQAAHEEAMFGATALLPPTSTDSEPERENEKEADKKELVASLLSETVLAKQKGSWRDRVRQA

SEQ ID NO: 116663 - protein, 214 aa, Glycine max
  Coding DNA Sequence Number=SeqID_24978
MEARMKIPVFSVFKIVKIRRFQPSMIQNLDEIFLDLTEEEVRTRLKLPSSGSLSAVTDLVQLIDEGPLMQEDKRMEGKMIQAGGCINKQRSKEQVTAAEVRGLMINTSSLIEPQYSEPPYLGAWTVADVMLELETRMKIGRSGQLQKEREAKIRTLWVRKGKGLELQKAAQIQRHKHCFKVKRAAENRAPEENKRIYIFVFDPGGIRAIFSILG

SEQ ID NO: 116664 - protein, 55 aa, Glycine max
  Coding DNA Sequence Number=SeqID_24979
  Homolog annotation: Hit_ID=A2X5W1; Match level="QueryCoverage=87%, HitCoverage=26%, E-value=8e-07, Identity=50%"; Hit description =Putative uncharacterized protein
MKQRSLANKANRSKQEIKSIIGTKSIVQKKKDSISGEWSDAMKVWKATHMRSNGA

SEQ ID NO: 116665 - protein, 504 aa, Glycine max
  Coding DNA Sequence Number=SeqID_24980
  Gene Ontology: Mol. function=nucleic acid binding; Cellular component= nucleus; Biological process=RNA metabolic process
  Homolog annotation: Hit_ID=A7PCK0; Match level="QueryCoverage=66%, HitCoverage=66%, E-value=1e-122, Identity=53%"; Hit description =Chromosome chr17 scaffold_12, whole genome shotgun sequence
  Pfam annotation: Domain name=zf-CCCH; Domain location=144-170; Score =38.7; E_value=2.1e-08; Accession=PF00642.15; Description=Zinc finger C-x8-C-x5-C-x3-H type (and similar)
  Pfam annotation: Domain name=zf-CCCH; Domain location=191-217; Score =33.4; E_value=8e-07; Accession=PF00642.15; Description=Zinc finger C- x8-C-x5-C-x3-H type (and similar)
  Pfam annotation: Domain name=zf-CCCH; Domain location=239-265; Score =49.8; E_value=9.5e-12; Accession=PF00642.15; Description=Zinc finger C-x8-C-x5-C-x3-H type (and similar)
  Pfam annotation: Domain name=zf-CCCH; Domain location=391-417; Score =37.5; E_value=4.7e-08; Accession=PF00642.15; Description=Zinc finger C-x8-C-x5-C-x3-H type (and similar)
  Pfam annotation: Domain name=zf-CCCH; Domain location=437-463; Score =42.2; E_value=1.9e-09; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH::zf-CCCH; Domain location=144-170::191-217::239 -265::391-417::437-463
MEGSESDSVSLSISNGEEPQLGRPSSPAAPPEPSDLNHAAEEETLSGELQSKLDLKDVDESEEKVSDFNDGGGVCDEETGKGDGDSKGWETNSWNEEVGVDVDVDGDGDGDGDDDVDGDVDGDDEVEKKEGRNSGGTHHYPLRPEAEDCAFYMKTGNCKFGFNCKFNHPIKRKSQAVKEKAGEREETTERSGMTECKYYQRSGGCKFGKSCKYNHTRGKISTAPAPLLELNFLGLPIRPGERECPYYMRTGSCKFGANCKFNHPDPTAVGGGGGNPPSGYGNGGSISLQGVSQTSVPSWSSPRTLNEASPFVPMMLSPTQGVSTQSSDWNGYQVHWNCSKMSIRIFEASVYLPERSIHPPSTFVMNNPAIDTNVYMHHQKQMPVDEFPERPGEPECSFFLKTGDCKFKSNCKFHHPKNRVTRLPPCNLSDKGLPLRPDQSVCSHYSRYGICKFGPACKFDHPINLQPVMIPGLEQQSYSNSASAGVAGIGGSTGVTDATIQQSV

SEQ ID NO: 116666 - protein, 979 aa, Glycine max
  Coding DNA Sequence Number=SeqID_24981
  Gene Ontology: Mol. function=DNA-directed DNA polymerase activity; Cellular component=DNA polymerase III complex; Biological process =DNA replication
  Homolog annotation: Hit_ID=A7PCL7; Match level="QueryCoverage=99%, HitCoverage=98%, E-value=0.0, Identity=52%"; Hit description =Chromosome chr17 scaffold_12, whole genome shotgun sequence
  Pfam annotation: Domain name=AAA; Domain location=327-517; Score= -1.7; E_value=2.6e-05; Accession=PF00004.20; Description=ATPase family associated with various cellular activities (AAA)
  Pfam annotation: Domain name=DNA_pol3_delta; Domain location=368-638; Score=-66.1; E_value=0.0024; Accession=PF06144.4; Description=DNA polymerase III, delta subunit
  Pfam module annotation: Pfam domain module=AAA::DNA_pol3_delta; Domain location=327-517::368-638
MDGRRHSVDIPISKTLVALKRVRSLRDPSTNGVSRLSPLVDDGDWEDGSSNGVSLSLRFLNGSHVCDSNGNGLLRSSSLDFKGQKEQDTAEFELEMWNSKMNYCGISCQEGLQDDGLVYSNPKQQGISGDKSPNESCCSNHEGRGLDLVSIMPSSNHLKDGESCYLSIATRVEHSKSARKSLCKNQVKPSEVIGDIASHVGSQQCLSVFDACSARSASEHIAQEVDVLDSHHGCGLRSCLSKSPRFRESNRYSEIESLPLILQHVNETDLNGHRSMRHIGVEISPTSETPRSLSMKFRPKSFSDLVGQNVIGKSLLGAISTGRISSFYIFHGPRGTGKTSASRIFAAAMNCLSPLEQKPCGLCRECVLFFLGRSKNVKEVDSLRINRADKVKSLVKSACIPPASSSFKVFIVDECQVLHGETWACLLNCLENVSPRVVFVMITPDLDKLPRSAVSRAQRYHFAKIKDADIARRLKKICVEEGLESEQVALDFIAARSCGSLRDAETMLDQLSLLGKKITISLVHELTGVISDDELLDLLDLALSSDTSNTVIRARKLVRTRIDPLQLISQLANLIMDILAGKCELGASETRTRFCNRYTSEADMQKLSHALRILSETEKQLRISKNQTTWFTAALLQLSSVEYSSVDTNDAKLCARAVSNGDGDICSTPPKGDSLEHLATTGQCDDKPYTLGLGVQEDHKGTLDSIWYKATEMCQSSRLKTFLRKQGKLSSVCISQGAAGRAVAELEFHHRDYVSRAEKSWKLIASSLQFILGCNLELRINYVPSCTSDSIYAKLKRTSFNFFGCSRRIRWKSLPSNEQGSESDYADYTSQKPMMKDQTQTCSSDCEPPVPPFESYNGMQVMTTLRSSEGNLLSSGKMLLNRQDQETPRISCSRVDSLKEEGCNYEHLAPSTLDLDNQTDCFPRTRWLHKKFSSSYASQQKNFVLSIPKFKCSETYRYDLEPCIFSHSSNNCTKAIEEK

SEQ ID NO: 116667 - protein, 167 aa, Glycine max
  Coding DNA Sequence Number=SeqID_24982
  Gene Ontology: Mol. function=nucleoside diphosphate kinase activity; Cellular component=chloroplast; Biological process=nucleotide metabolic process
  Homolog annotation: Hit_ID=A7QZ31; Match level="QueryCoverage=49%, HitCoverage=35%, E-value=4e-39, Identity=93%"; Hit description =Nucleoside diphosphate kinase
  Pfam annotation: Domain name=NDK; Domain location=20-158; Score =139.0; E_value=1.4e-38; Accession=PF00334.10; Description=Nucleoside diphosphate kinase
MGEEPNHIFFRANLQKDRLEQSQHVVRQVRTMPICGKSRAGTEFYSSKCSWNRVIKAYCDCLWFQEHYKDLKQKSFFPKLIDYITSGPVVCMAWEGVGVVASARKLIGATDPLQAEPGTIRGDLAVQTGRNVVHGSDSPENGKREIGKASYAIQFNPNTCNKHRCEL

SEQ ID NO: 116668 - protein, 263 aa, Glycine max
  Coding DNA Sequence Number=SeqID_24983
  Gene Ontology: Mol. function=binding; Cellular component=nuclear pore; Biological process=protein import into nucleus, docking
  Homolog annotation: Hit_ID=A7PD87; Match level="QueryCoverage=84%, HitCoverage=23%, E-value=1e-109, Identity=86%"; Hit description =Chromosome chr17 scaffold_12, whole genome shotgun sequence
  Pfam annotation: Domain name=IBN_N; Domain location=26-93; Score =21.4; E_value=0.00056; Accession=PF03810.10; Description=Importin -beta N-terminal domain
  Pfam annotation: Domain name=Xpo1; Domain location=98-243; Score =93.0; E_value=9.2e-25; Accession=PF08389.3; Description=Exportin 1 -like protein
  Pfam module annotation: Pfam domain module=IBN_N::Xpo1; Domain location=26-93::98-243
MDLQNTVKEALNALYHHPDDAVRMQADRYLQDFQRTLDAWQVGDNLLHDPSSNLETLIFCSQTLRSKVQRDFEELPSTAFRPLRDSLNTLLKKFHKGPPKVRTQISIAVAALAVHVPAEDWGDGGIVKWLRDEMDSHPEYIPGFLELLTVLPEEVLNYKIAARPERRRQFEKELTSQMEVSLNILTACLSISELKEQVLEAFASWLRLKHGIPGSVLSSHPLVLTALSSLNSELLSEASVNAIFLLTQVHLSNIDIAKPANPH

SEQ ID NO: 116669 - protein, 234 aa, Glycine max
  Coding DNA Sequence Number=SeqID_24984
  Gene Ontology: Mol. function=microtubule motor activity; Cellular component=microtubule associated complex; Biological process =microtubule-based process
  Homolog annotation: Hit_ID=Q4W5W8; Match level="QueryCoverage=99%, HitCoverage=99%, E-value=9e-57, Identity=49%"; Hit description =Dynein light chain
  Pfam annotation: Domain name=Dynein_light; Domain location=138-229; Score=63.1; E_value=9.1e-16; Accession=PF01221.9; Description=Dynein light chain type 1
MAHHSSQRRNLAAPESNPTTPNSNPDLIQTYKPSFLAKAMATSAIQEKESTVPVKRTHKEKPQRHCLELERRKLGDPNDKGMVEDAKVVKGKPRNPHLEKHDVVVAAAERMSVSLAPGGGGGRRRSFCGTQADLRDVFAINGAKMVSVDMPPFMQIHAVDCARKAIDSMEKFTSKTLALSLKKEFDGVYGPAWHCIVGTSFGSFVTHSVGGFLYFSMDKKLYILLFKTAVHKAA

SEQ ID NO: 116670 - protein, 108 aa, Glycine max
  Coding DNA Sequence Number=SeqID_24985
MNIVGEEDEQQCNNMNRKIQKIQNHKSTTPPCHLCGCRFESQRSSLFLCRRNSRSDPQNLTTVGVGGGNTEARKRAQRGREEDEETWRQRKTLEEDATEEDGYGNFEK

SEQ ID NO: 116671 - protein, 1582 aa, Glycine max
  Coding DNA Sequence Number=SeqID_24986
  Gene Ontology: Mol. function=nucleic acid binding; Cellular component= intracellular; Biological process=ubiquitin-dependent protein catabolic process
  Homolog annotation: Hit_ID=A7QI28; Match level="QueryCoverage=100%, HitCoverage=100%, E-value=0.0, Identity=58%"; Hit description =Chromosome chr17 scaffold_101, whole genome shotgun sequence
  Pfam annotation: Domain name=DUF627; Domain location=62-184; Score =24.5; E_value=6.7e-09; Accession=PF04781.3; Description=Protein of unknown function (DUF627)
  Pfam annotation: Domain name=DUF629; Domain location=313-843; Score =47.1; E_value=6e-11; Accession=PF04780.3; Description=Protein of unknown function (DUF629)
  Pfam annotation: Domain name=UCH; Domain location=1246-1578; Score =28.4; E_value=3.7e-09; Accession=PF00443.20; Description=Ubiquitin carboxyl-terminal hydrolase
  Pfam module annotation: Pfam domain module=DUF627::DUF629::UCH; Domain location=62-184::313-843::1246-1578
MGHKKRNPAPRSKQSLAAATANGGATSPDADTACNVSDHNPRKIELATLQSEGSDYSTIKLECERALTTLRRGNHTKAMKQLKEICAREEGSPHAAFVNRVHSLMCFKTATVITDPSSKQRHLRNALESARRAVELMPNSVEYAHFRATVMLEAASEGKDYEEVVHECERGLAIENPSDPAKETLQDESEQKASSLEERIAHVQNELRQLIQKSNIASLSSWMKNLSNGEERFRLIPIRRTPEDPMEVRLVQTRRPNEIRRLIQKNSESPQSANEGDRDDRQLDSSAGSGQRIGDRRRHGNVRKSGFSAERMKWVHSYWNSVSMDMKKDFLRVKIYDLKSHYGSSKDTLPNDILSEALFYAGANKTWKFWPCCNCEEKHSNPDSHRHHVVQEHMGSLSPQMQRLLPHNVDSEWIEMILNCSWKPLDILAAVRMLYNKAKFKSSSLPEDLYLDHHALDYNDCFKDASSSYIEKESSGDSLPNCSVECNNHYKIIENDVREGVEDQLSMANPIIDCWPVSDDPERAKLLGKIHAIFETLIKHKCLAASHLNKVIQFTMGEIQGLAAGSQLLNHGVDQTPMCMCFLGATQLKTIFQFLQEISHACGLARNADKGGSPTNDLLNISQGPEIKDKIVLDGDASCLLLDECLLQTQVTAGTVQGTVLDDVTTPSSPDGISCYNDALLSWIFSCSPIGDQLTSWLRTREDKLNKGKEIVQLLEKEFYHLQGLCEKKGERVSYEEALQTVEDLCLEEGKKRETVGEFVQRSYESVLRKRREELIESENDMMYVSNRFELDAISNVLQEAEARNVNQFGYEETYAGVTSQLCDLESGEEDEWRMKDYLHQMDGCIENAIQKLKEHLSIELSKIDARIIRSVTEMQQLEFKLGPISANDYRAILVPLVKSYLRALLDDLAEKDAREKSDAVSEALLAEIALDSKKAVKGGSESTRHVEKTKDKKKNKDHRKARDLKVASGHAQFSLGSTTPDSNLVAPESDFPDNEVVAMNDDDLEQLEEEFRRKIELEEEEKKLEETLEFQRRIENEAKQKHLAEQQKKSSGLYLEGVVDKLQDSETKVDADPPDAHEHVGVLVQDQLVKENGSRSNLDAGLPNGVVPENGLDRRAGKKHKRKNSSRQVDGKFEPVSSGQENIEDTHTDYHLREQFKLNSNQDVNNVWQNNGSKVMGELQVEDAEEERFQADLKMAILLSDTYQARGNLHSVSSLRMPQRASSQEDSVDCLPVEDSTDNVNGATLLGTGLKNEVGEYNCFLNVIIQSLWHLRRFRVEFLGRSRSEHDHVGNPCVVCALYEIFTALDTASKDSRREAVAPTSLRIALSNLYPHSNFFQEAQMNDASEVLSVIFDCLHRSFICGSSVSDAESAESNCMGSWDCANGSCIAHSLFGMNIFEQMNCYHCGLESRHMKYTSFFHNINASALRTMKDTFAESSFDKLLNLVEMNHQLACDLEAGGCGKLNHIHHFLSTPPHVFMTVLGWQNTSESADDITETLAALSTKIDTSVLYCGLDPKCVHNLVSVVCYYGQHYHCFAYSHDHEQWIMYDDKTVKVIGGWADVLTMCERGHLQPQVLFFEAVN

SEQ ID NO: 116672 - protein, 604 aa, Glycine max
  Coding DNA Sequence Number=SeqID_24987
  Gene Ontology: Mol. function=transporter activity; Cellular component= membrane; Biological process=oligopeptide transport
  Homolog annotation: Hit_ID=Q9FRU2; Match level="QueryCoverage=93%, HitCoverage=99%, E-value=0.0, Identity=72%"; Hit description=Nitrate transporter NRT1-5
  Pfam annotation: Domain name=MFS_1; Domain location=50-519; Score= -15.0; E_value=0.059; Accession=PF07690.7; Description=Major Facilitator Superfamily
  Pfam annotation: Domain name=PTR2; Domain location=102-512; Score =242.5; E_value=9.1e-70; Accession=PF00854.12; Description=POT family
  Pfam module annotation: Pfam domain module=MFS_1::PTR2; Domain location=50-519::102-512
MTKRETSENDEEESLLKNENSGTDDDSKINYRGWKVMPFIIGNEIFEKLGAIGTLSNLLVYLTTVFNLENIMATNIINIFNGSTNFATLLGAFLSDAFFGRYKILAFCTMASFVGLFAIQLTAAVEKLHPPHCEESTICQGPTEGQMTFLKTGLGLLMVGAAGIRPCNLAFGADQFNPNTDSGKKGIASFFNWYFFTFTVAQMISLTIIVYIQSNVSWAVGLGIPSALMFVSSIIFFMGSKLYVKVKPSGSPITSIVQVIVVATKKRRLKLPEYQYPSLFNYVAPKSVNSKLPYTYQFRFLDKAAIMTPQDQINPNGSATDPWNLCSMQQVEEVKCLLRVLPIWVSGILYFVVIVQQHTILVFQALLSDRRIGQSGFLIPGASYYVFLMISVAIWLPVYDRKVVPLLQKLTRKEGGITLLQRMGIGIFFSILSMLVSARVEQHRRTLALINPLGVETRKGAISSMSGLWLIPQLSLAGLAEAFMSVAQVEFYYKQFPENMRSIAGSLYYCGHAGSSYLSSVLIAVIHQITAKSETGNWLPEDLNKGRLDNFYSLIAALEIINLGYFVLCARWFRYKGTGSSSIELEKATKQSERSANGVNDSNL

SEQ ID NO: 116673 - protein, 560 aa, Glycine max
  Coding DNA Sequence Number=SeqID_24988
  Gene Ontology: Mol. function=aldehyde dehydrogenase (NAD) activity; Cellular component=mitochondrial matrix; Biological process =metabolic process
  Homolog annotation: Hit_ID=A7YVW1; Match level="QueryCoverage=97%, HitCoverage=90%, E-value=0.0, Identity=72%"; Hit description=P5CDH1
  Pfam annotation: Domain name=Aldedh; Domain location=49-508; Score= -203.7; E_value=9e-06; Accession=PF00171.13; Description=Aldehyde dehydrogenase family
MAITLNVLSSLSVQGKWAGSSNWNTVVDPLNGDSFIKVAEVDETGIQPFVESLSSCPKHGVHNPFKAPERTLGDFQMISLLGVNGTEVLILFGYLMFGEISAKAAHMLSLPKVSDFFTRLIQRVSPKSYQQAFGEVYVTQKFLENFCGDQVRFLARSFGVPGNHLGQQSHGFRWPYGPVDCGNYANSDASIVLYIKPMYIDDLDWSGSLPFGSIVAIITPFNFPLEIPVLQLMGALYMGNKPVLKVDSKVSIVMDQMLRLLHNCGLPLEDVDFINSDGKTMNKLLLEANPRMTLFTGSSRVAEKLAVDLKGRVKLEDAGFDWKILGPDVLQEDYIAWVCDQDAYACSGQKCSAQSLLFMHENWSKTSLLSKLKDLADRRKLADLTVGPVLTVTTDSMLEHINKLLEIPGSKLLFGGQPLEDHSIPPIYGAMKPTAVYVPLEEIMKAKNFELVTREIFGPFQIVTDYKSSQLSVVLDALERMHNHLTAAEVIGQSVNGTAYAGLRARTTGAPQNHWFGPAGDARGAGIGTPEAIKLVWSCHREIIYDFGPVPKNWEVPPST

SEQ ID NO: 116674 - protein, 147 aa, Glycine max
  Coding DNA Sequence Number=SeqID_24989
MINKFERQKSLETKIEGRIIMGYINNVDQVRRSFIGLGCNWAITSCTYRKDGMDTTTPLSHQILPVQPAPPPTTISTSTTTNTTTPRPTTVINSQLPHAILCPHGAAGGVVGAACACPSSETAPSQFNFKAPSLGGSHLVGKLVYSA

SEQ ID NO: 116675 - protein, 518 aa, Glycine max
  Coding DNA Sequence Number=SeqID_24990
  Homolog annotation: Hit_ID=A9P8R6; Match level="QueryCoverage=60%, HitCoverage=82%, E-value=2e-51, Identity=45%"; Hit description =Putative uncharacterized protein
MVQSKGEEKGSGCDLKGVVSGGVPVQLLQNQVFPVSLIFIPKHTEKTLTRSRAKSRLGKLSRWWNEMDGGDGSAWREVWEPRWQDSVVDCVECATKRNMEDVGDGSVVQLLTPPYYSPVFVPQTLEDWQVSKPKRGTIVAQLTDVVVVKWKAPQDGIAKCSIDIQKETMEEPVKEQQPLSAGNSARPKLQRYALRSSSKSKENKPDAPDRSISSESKRFGVQSSAWVWSHSGRGLSTPRLSRSVCGLDFSGNKDKSTSAKPPRRLSNPVKASPTPNLKLVGNITPISESRTMRSGNVQGSQSRSQTPASEISRTSSRMKFNLLSSSSYWLNQIKLSESADKHSVSLGFFKLASEARCEKMKDELKSYVQRHQLAELGEVKELLQSYDIAENIEQPQVSESITQVPEEGTGSSDDEEVHCSSSSTMDTAKLKPEPLDTESTEPAPVKIESTKKETSQKNNHPGSRLRENLKNSANSRPASDSGSSRLVKKSEKPTTQQTNKEKSEDVQTPDEMILTEVA

SEQ ID NO: 116676 - protein, 101 aa, Glycine max
  Coding DNA Sequence Number=SeqID_24991
  Gene Ontology: Mol. function=DNA binding; Cellular component=nucleus; Biological process=response to brassinosteroid stimulus
  Homolog annotation: Hit_ID=A7PDM4; Match level="QueryCoverage=73%, HitCoverage=89%, E-value=2e-25, Identity=69%"; Hit description =Chromosome chr17 scaffold_12, whole genome shotgun sequence
  Pfam annotation: Domain name=ZF-HD_dimer; Domain location=19-78; Score=119.5; E_value=9.8e-33; Accession=PF04770.3; Description=ZF-HD protein dimerisation region
MKKRQVVVKRDYATSSPAVGNIRYGECQKNHAANTGGYAVDGCREFMASAGEGTNAALTCAACGCHRNFHKREVGILDNGLSGDYALIKTASVKRIKKNVT

SEQ ID NO: 116677 - protein, 60 aa, Glycine max
  Coding DNA Sequence Number=SeqID_24992
MAVMNAGTGAKGRGSVEEGRISAEVVGGDHDHNQTSNTSPGMRGFGKVFASRVGLPWQDT

SEQ ID NO: 116678 - protein, 45 aa, Glycine max
  Coding DNA Sequence Number=SeqID_24993
MEIEARIVFDERQKHDLNLPINSYLNKDGDYEMVVALGEVAIPIM

SEQ ID NO: 116679 - protein, 139 aa, Glycine max
  Coding DNA Sequence Number=SeqID_24994
MAYRQQLIVQRVIEQISPKLNLFRRVLIAGFQIVIWIFWNCRPMAMSGMDQILGVGVFKCSYITLSFPKTLRFSLEQNDLEGTCIIEHLGGVNLGDQGLLVGVDLVELLISCINCHCMGEAILMGEMGALIAVKWGIDG

SEQ ID NO: 116680 - protein, 422 aa, Glycine max
  Coding DNA Sequence Number=SeqID_24995
  Gene Ontology: Mol. function=protein serine/threonine kinase activity; Cellular component=plasma membrane; Biological process =protein amino acid phosphorylation
  Homolog annotation: Hit_ID=A7PDI2; Match level="QueryCoverage=81%, HitCoverage=91%, E-value=3e-38, Identity=48%"; Hit description =Chromosome chr17 scaffold_12, whole genome shotgun sequence
MEMKIQHDIRSAAEGSPIDQIGPLCIKDESLERNMWKEILIQPRRRESKGWGEGGEGGVCDAIWRFSWSIGGNRKSFGLGGRTFKSDRETTSLLSTTEDLQISLDSYLSPSVPSSSSLPLHQTARVFQEESTYSFYIYKSGRLWVRLYFFPLPDPSYNLTSAVFSVQTNQHVLLHEFSVRNNDTSVFKEYLVNVSDSRFSLKFKPKKNSFAFINAIEVVSAPDTLISDSATALSPHGEFKGWDQPIYNKAWTDAIVNRIEVMKMSNDADSLDGFFSVDGKYEGAKPVIYPTLPREEINLADWAMKQHKRGVLREVIDPRIVKIISPQSFNVFVQTAERCLADCGVERPSMEDVLWHLEYALRLQKDATRIKELEEKSASIFTNECNDNDNIAGHSGDPASDVSDSTDANSALFSQIANFQGR

SEQ ID NO: 116681 - protein, 98 aa, Glycine max
  Coding DNA Sequence Number=SeqID_24996
MENVCRRAASSFNLFRVSQAYIEARSMLTLKEAESTMVAASQSIYDSNFSHSDQQQRGKPSGYHKNSGKKKLVAVVLGPVRDSLSVRVRRPLASTAGV

SEQ ID NO: 116682 - protein, 411 aa, Glycine max
  Coding DNA Sequence Number=SeqID_24997
  Homolog annotation: Hit_ID=A5BM24; Match level="QueryCoverage=34%, HitCoverage=70%, E-value=3e-09, Identity=31%"; Hit description =Putative uncharacterized protein
  Pfam annotation: Domain name=DUF827; Domain location=11-191; Score= -91.1; E_value=0.0012; Accession=PF05701.2; Description=Plant protein of unknown function (DUF827)
MGSEIDTKSIEPVRNAVSLFGDKSDQKKYLAARSKSDCEKEFEVLTKELADCKVQLEAKHAAHLQALLKLEHNQKMINELSTLLKKSDIERNKNVNECSECKALKDELESKMKEMADQNLETTAKAEKEQKEELLQQVKELNEVIYDSKLDAIKSEQEKLAILGSLSEKEEKIELATKATSQVQQQLEDMTKHAEMLQGLQNQPMDKSTRVETLVLSEDSAPKFVNDSGQLSIDMELKERKIMDQYVYIETLEMELSHDIEAQVEIALLKSQFQEHRLAHKNGQVTEVSKVDHSKAEAEERNSENNNDHVTSRNGAQGSVGEVKRFSELALMEKELENASGKISELRARGEQALSKAEFAENAKAALEDKIRRHREHMQRRRAALTALHLGRNLPLNHLVLPHHMEHLEPM

SEQ ID NO: 116683 - protein, 569 aa, Glycine max
  Coding DNA Sequence Number=SeqID_24998
  Gene Ontology: Mol. function=nucleic acid binding; Cellular component= intracellular; Biological process=regulation of transcription
  Homolog annotation: Hit_ID=A7PDG3; Match level="QueryCoverage=98%, HitCoverage=98%, E-value=1e-120, Identity=47%"; Hit description =Chromosome chr17 scaffold_12, whole genome shotgun sequence
  Pfam annotation: Domain name=zf-C2H2; Domain location=13-35; Score =13.0; E_value=0.45; Accession=PF00096.17; Description=Zinc finger, C2H2 type
  Pfam annotation: Domain name=zf-C2H2; Domain location=391-413; Score =15.1; E_value=0.26; Accession=PF00096.17; Description=Zinc finger, C2H2 type
  Pfam annotation: Domain name=zf-C2H2; Domain location=480-502; Score =19.9; E_value=0.0095; Accession=PF00096.17; Description=Zinc finger, C2H2 type
  Pfam annotation: Domain name=zf-C2H2; Domain location=97-119; Score =12.5; E_value=0.5; Accession=PF00096.17; Description=Zinc finger, C2H2 type
  Pfam module annotation: Pfam domain module=zf-C2H2::zf-C2H2::zf -C2H2::zf-C2H2; Domain location=13-35::391-413::480-502::97-119
MEGDHRIHQELKHACKFCGKCFPCGRSLGGHMRSHITNFSSEMNEKEKLSSSHNNGGDKDSEAAAAANTAGYGLREKPKKTWRISDYSSEDPLVFDKFCKECGKGFQSWKALFGHMKCHSEKERVSNSLEDQDSWTNAKVVMDSQSDNEATAPNKRRRSKRRTRYTVVASSAAAAAATTTSSVVSFANPSSSLSEAEQEQEEVAMSLMMLSRDVSPWSGPHSVAESSDNNSAYFEARSSVRTNLITKFDQAKLIKQSDNKWEVGNSENPNSTRGKSSQLLTTTTATTITTEIPENGFRVNKNGVSNKGYEKAYKSELEYVSALEDSEGEHRRSRRVNGTESALSKSVTTTGKKYSSIKTKFSGSELKSNKNWMDKASEAESSKNSNKRGKFECTTCNKIFHSYQALGGHRASHKKIKGCFASRNESSENSIETDLSPDPIITENKLMKNGDSECVVEHQHGASFHNEVETVNESKKSKGHECPICLKVFPSGQALGGHKRSHMVGGSESRSFQTIVLQEPVAEIRDFLDLNLPAATEEESNSHADSNSNRPWWIVEDNHKQEALVGLIS

SEQ ID NO: 116684 - protein, 403 aa, Glycine max
  Coding DNA Sequence Number=SeqID_24999
  Gene Ontology: Mol. function=microtubule plus-end binding; Cellular component=cytoplasmic microtubule; Biological process=vesicle fusion with Golgi apparatus
  Homolog annotation: Hit_ID=A7PDG0; Match level="QueryCoverage=88%, HitCoverage=86%, E-value=4e-72, Identity=47%"; Hit description =Chromosome chr17 scaffold_12, whole genome shotgun sequence
MSNSCRSDHLTPLNGEELSTRRRREEEYPKESVAGTPHINVQHRKEKDVLQSSQSQSIQPIQMLEQCEKSKSEAHAEDKKHIQRLEKELLNCSQEIDYLQDQLSARNAEVNYLEEHIHNLELKLEGMEDLQEEVFRLREELKRSESKQFSLIQELDTKEKELEKSALSIEKLEESFSSITLESQFEVESMKLDMMVLEQSLFEAKKIQDETLDENNRMSRSIEELQVALQDAQKIIITLNEEIRELEEKLDTANQNSRISSQKDEYWLENKDRSQLETQSSLNVRGNNSTMQEDISTYEVCGPHVGRLAMILDPAADLKGKMEMSQQIQEYECLIKKLKEELREEKLKAKEEAEDLVQEMAELRYQFTGSLEEECKRRACFEHASLQRIAELEAQLKREHKNP

SEQ ID NO: 116685 - protein, 660 aa, Glycine max
  Coding DNA Sequence Number=SeqID_25000
  Gene Ontology: Mol. function=diacylglycerol kinase activity; Cellular component=integral to membrane; Biological process=intracellular signaling cascade
  Homolog annotation: Hit_ID=A7PDE7; Match level="QueryCoverage=98%, HitCoverage=86%, E-value=0.0, Identity=69%"; Hit description =Chromosome chr17 scaffold_12, whole genome shotgun sequence
  Pfam annotation: Domain name=C1_1; Domain location=149-210; Score =44.9; E_value=2.9e-10; Accession=PF00130.13; Description=Phorbol estersdiacylglycerol binding
  Pfam annotation: Domain name=DAGK_acc; Domain location=550-660; Score= -3.7; E_value=8.3e-07; Accession=PF00609.10; Description =Diacylglycerol kinase accessory domain
  Pfam annotation: Domain name=DAGK_cat; Domain location=359-488; Score= 147.9; E_value=2.8e-41; Accession=PF00781.15; Description =Diacylglycerol kinase catalytic domain (pres
  Pfam module annotation: Pfam domain module=C1_1::DAGK_acc::DAGK_cat; Domain location=149-210::550-660::359-488
MDDERDFELLFYSWNTKNPTDQLFIISFLVAALVGMLTIAYTAFQWRRNINLSWMKAIARSKKNPKARHKIPAAPHTWDLESASRAKNLNCCVCFKSVSPSQTLGPIVASEGFIHRCCTCGAVAHLSCSSSAHKDCKCVSMIGYEHVTHQWTVCWTDVADQPDETALCSYCEELCGGTFLSGSPIWSCLWCQRLVHVDCHSTMSNETGDICDLGQFRRLILSPLYVKELNWNLPGGFLSSITHGANEIASSVRASIRNQSKKYKHGNELSVESGNSESIGEVSTESTGDSHQIQNGHHEVGEKSSSNKGVQHQDNEVDNKLDRKPSLRRNSSINQKDESHSLGVKQKYDLIDLPLDARPLLVFINKKSGAQRGDSLRMRLNILLNPVQVFELSSTQGPEMGLYLFRKVSHFRVLVCGGDGTVGWVLNAIDKQNFVSPPPVAILPAGTGNDLARVLSWGGGLGPVERQGGLTTFLHHIEHAAVTVLDRWKGVGWVIDGEKDVFRSLEHGLELVVMQRLLWTFIICVKRIQISFITSLSSSDLDLSDTLPWEMNDLSFQFMNKVLYAREGAKSIMDRTFADLPWQIRVEVDGVEIEVPEDAEGVLVANIGSYMGGVDLWQNEDENYDNFDQQSMHDKILEVVSISGTWHLGKLQLKGLLLEF

SEQ ID NO: 116686 - protein, 663 aa, Glycine max
  Coding DNA Sequence Number=SeqID_25001
  Gene Ontology: Mol. function=hydrolase activity; Cellular component =cytoplasm; Biological process=regulation of transcription, DNA -dependent
  Homolog annotation: Hit_ID=A7PDA9; Match level="QueryCoverage=97%, HitCoverage=97%, E-value=0.0, Identity=66%"; Hit description =Chromosome chr17 scaffold_12, whole genome shotgun sequence
  Pfam annotation: Domain name=Hist_deacetyl; Domain location=18-341; Score=394.3; E_value=1.8e-115; Accession=PF00850.10; Description =Histone deacetylase family
MERENDNSAKSSVNGQRRVGLLYDERMCKHHTPDDEDHPETPNRIRAIWNKLQSTGVPQRCVILEAKEAEDKHLLLVHSENHVNLIKNISSKQFNSRRHKIASKLDSIYFNEGSSEAAYLAAGSAVEVVERVASRELDSAVAIVRPPGHHAEQNEAMGFCLFNNVAVAARYLLDERPELGVKKILIVDWDVHHGNGTQKMFWNDSRVLFFSVHRHEFGSFYPANDDGFYTMIGEGAGAGYNINVPWENGRCGDADYFAVWDHILLPVAKEFNPDIIIVSAGFDAAVGDPLGGCRVTPFGYSVLLEKLMNFAEGRIVLILEGGYNLDSIAKSMHACLEVLLEDKPVIGSSEAYPFESTWRVIKAVLLELSPFWPTLACELPQKLISQMAPPPHTLVSSSDSEAEDDKGAPSSENFVELLEDVIKPLSKLKVDADEDTDVSSTWRSELSNVYIWYASYGSNMWKARLNCYLAGGQILRNDIQVEGMQKGCSGSVNRTLPKEILWKTFPCHIFFGRDSSHSWGMGGVAFLNPEKSFQHNTYMCLYKISLEQFNDILFQENGLSLDAGSPLFDITTLNAISYKEFHSLEVVKGAWYGNVVYLGKELDIPVITMTCSLLDIERFKSGKLPLRAPNKAYANTLIKGLVDGEQLSEVEAIAYIEGAAKSL

SEQ ID NO: 116687 - protein, 147 aa, Glycine max
  Coding DNA Sequence Number=SeqID_25002
MAYATDNQVVFEDEKTIYGRITLLFRDLESQYEANLKCKEQSEKELECLTKLKAEKANLLTQFKTVEEIRETNMNLKPKNEEAKIIGDIPTHGRLHENSVEYILIKNKNTGEPSPKTVEAGSQRLRRASRRWDFDEGETWKKTRLGN

SEQ ID NO: 116688 - protein, 116 aa, Glycine max
  Coding DNA Sequence Number=SeqID_25003
  Subcellular localization annotation: CTP_CleavageSite=37; ConfidenceScore=5.39e-01
MGVLNFWIKKIETSPPRNSSTMKVEKAMTKTKVAKVTRMTKAKEFRRAPRNLSQVESEVVSLYAMVTMLIDASKREESVLRVETRITTRNMHIETGAMILTISSPRESRTLEQGLW

SEQ ID NO: 116689 - protein, 237 aa, Glycine max
  Coding DNA Sequence Number=SeqID_25004
  Gene Ontology: Mol. function=nucleic acid binding; Cellular component= intracellular; Biological process=transport
  Homolog annotation: Hit_ID=A5C6W0; Match level="QueryCoverage=49%, HitCoverage=10%, E-value=4e-16, Identity=38%"; Hit description =Putative uncharacterized protein
  Pfam annotation: Domain name=DUF1675; Domain location=1-215; Score= -26.1; E_value=1.4e-05; Accession=PF07897.2; Description=Protein of unknown function (DUF1675)
MNRGASASYVEEKDSMGIMGNTHAVTKENNIIADVADRAEGELRVEEAFNFELGMRNDLERGHNEKIMLDYRTSLKHSQIGNQAGFANDFFIASTGAGSNFQTPPKKENDSMLSSVAIQEMTPWPSDTMIERPAKKPKHVNSYQESEATDIVRQMPCVITTGGGTTGKRTEGLLYKYKRGQVCIVCVCHGSFLSPTEFVMHAGGKEVADPMKHITVCSDLVYINGDGAGLSPGPWKP

SEQ ID NO: 116690 - protein, 97 aa, Glycine max
  Coding DNA Sequence Number=SeqID_25005
MKFKKKALLHEQDLCKCIAPQTGLEQQQKSNFGKIGRGLKHPSFFEEGCTMLHCLHLPTLAADASSGESLASSAAQFKASSQSHPAQVPSGAPDPLH

SEQ ID NO: 116691 - protein, 31 aa, Glycine max
  Coding DNA Sequence Number=SeqID_25006
MVVSKVVDSGIRKEGDLEVGNLMKTARDCDG

SEQ ID NO: 116692 - protein, 205 aa, Glycine max
  Coding DNA Sequence Number=SeqID_25007
  Gene Ontology: Cellular component=anchored to membrane
  Homolog annotation: Hit_ID=A9P983; Match level="QueryCoverage=90%, HitCoverage=82%, E-value=3e-58, Identity=64%"; Hit description =Putative uncharacterized protein
  Pfam annotation: Domain name=Phytochel_synth; Domain location=71-177; Score=80.9; E_value=4.2e-21; Accession=PF04833.6; Description =Phytochelatin synthetase-like conserv
MLSLWFPTAGSVVPRGDFFAILLLPLLLCTTFTSTEAHDALDPTGNITIKWDVISWTPDGYILELHVPASYAVVTTYNFQQYRHIQAPGWILGWTWAKKEDPTVVDLLPGTPYNQQIANCCSGGVLTSWAQDPQNAISSFQLSVGLAGTTNETVKLPKKFTLKAPGPDDAGMLWGVKLYNDLLTSAGPLGNVQSEVIFRKDKSFI

SEQ ID NO: 116693 - protein, 589 aa, Glycine max
  Coding DNA Sequence Number=SeqID_25008
  Gene Ontology: Mol. function=ATPase activity; Cellular component =chromosome; Biological process=chromosome organization and biogenesis
  Homolog annotation: Hit_ID=A7Q370; Match level="QueryCoverage=67%, HitCoverage=67%, E-value=1e-120, Identity=55%"; Hit description =Chromosome chr12 scaffold_47, whole genome shotgun sequence
MDHRSRLLVLILFSFLLRGESWGWFSSSKETPSGDKTQAGNFKGSSAEFSVDSFNDHKGVKLIQNAKKKMISSNSCWQNAYQHLFAGCSEILAIDEKRSRLAWHLSDCFQRDSGRSPFPHCEPKSSIAVCSRSLDDLAHKVYLEFYLETNTICYQLQAHAFKYETERLVTELKTSAQYVEDKLDSIEEKSEHLLQGSRQIHDSLNSLDSHTKQVAQTAKNLEGHIDSVLTHSRSVYEQTTKIALSQIQLKEGQENMKRSLEDGVAMLKDSYNYLGKEIEKLRNEAIEIENEVIKVGDAMSSRMDNLQSKAEDIGNMAGISLDKQQQLLDGQSTALEGLNSLTEFQSKALEESRKTLQYFAEYGHRQHEELIQRQQQIQGFHDRLMENSREILSSQESFESKQASMNYETLNHQMLLTLINKVNSMQKEKELSWDLDTTDYEDWSEWIDADLPDDVNYLDDPDYMLPQVVAENSITELIGLMNFLRSHIPPDVKINKLSTVWDYEVPEMQRAIGTTHGQVHGSVGKKGAVNGCNKEAVMDMLTPASFLVESGRAVTEIASLYPFAHKEAPMQYHAKSPSAPRPSNSGFAL

SEQ ID NO: 116694 - protein, 272 aa, Glycine max
  Coding DNA Sequence Number=SeqID_25009
  Homolog annotation: Hit_ID=A7PGG8; Match level="QueryCoverage=18%, HitCoverage=9%, E-value=4e-07, Identity=45%"; Hit description =Chromosome chr17 scaffold_16, whole genome shotgun sequence
  Pfam annotation: Domain name=C1_3; Domain location=12-41; Score=7.0; E_value=0.081; Accession=PF07649.3; Description=C1-like domain
  Pfam annotation: Domain name=PHD; Domain location=13-53; Score=14.4; E_value=0.00027; Accession=PF00628.20; Description=PHD-finger
  Pfam module annotation: Pfam domain module=C1_3::PHD; Domain location= 12-41::13-53
MATGPADSYTETKCGVCHAGTDEHLLLLCDLCDTASHTYCVGLGYTVSDAEPSVTINIFDIVRETGSRVVNRPRASPLQQNLSSPVIPLPDRLSYLSRLKGKGPVTGMENDGQGKEDTTPHHRTGSILQGVDKPSCSGGARKISLAHYIFSEQKDQHFKALVLRNTKMEKQCDYSSLNQNLENRSTLNLEEKKQSVDTFKVVARQATHTILATCSSDQQKSSTSSSSSVCSHADNTPQFQKSTLMPNCCRQCFYDFVNNVVNSTILEKVGCA

SEQ ID NO: 116695 - protein, 356 aa, Glycine max
  Coding DNA Sequence Number=SeqID_25010
  Gene Ontology: Mol. function=zinc ion binding; Cellular component =nucleus; Biological process=regulation of transcription
  Homolog annotation: Hit_ID=Q0GLE8; Match level="QueryCoverage=82%, HitCoverage=100%, E-value=1e-109, Identity=68%"; Hit description=Dof4
  Pfam annotation: Domain name=zf-Dof; Domain location=88-150; Score =140.1; E_value=6.1e-39; Accession=PF02701.6; Description=Dof domain, zinc finger
  Subcellular localization annotation: CTP_CleavageSite=38; ConfidenceScore=5.46e-01
MLKVAVAVAAQGYLFLTLSLKPHSHFASQFSPLSLSVRSHVHSNNTLTDINTSFRCYLVILIHQMQEIHTMGGGRFFSGDRRLRPHHQSQQALKCPRCDSLNTKFCYYNNYNLSQPRHFCKNCRRYWTKGGVLRNVPVGGGCRKSKRSSKPTKTSSQTASPDPDHHNNNTNSHSSSGSSSLTAAAATATTTTTTEAVSAPETLNLDSNNNNNNMQESKLLIPALETNPLEHGTGDCGGIFSEIGPFTSLITTTTSTNEPLAFGFGNSTLPDASSFQWLHQKVSSSSNEELKLPESSLLDHTVDFHSKISHGGGFGSLDWQGGADQGLFDLPNTVDHAYWSHTHWSDHDNSTLFHLP

SEQ ID NO: 116696 - protein, 353 aa, Glycine max
  Coding DNA Sequence Number=SeqID_25011
  Gene Ontology: Mol. function=protein binding; Cellular component =microtubule cytoskeleton
  Homolog annotation: Hit_ID=A7PGG1; Match level="QueryCoverage=88%, HitCoverage=89%, E-value=1e-109, Identity=64%"; Hit description =Chromosome chr17 scaffold_16, whole genome shotgun sequence
MQHFVDLQENSELGESNSWLSAKEQSGAAPNTNLDRVLFNDLVEIVPLVQSLIDRKASRSFTRRGSMIYTKTPTRESLSKRTTDSKSRNVAQSILAKKKRDHGEKEQGKNGSNDADNYSMFSTRTLASEKDIEELGMLKEQVEELQRKLLEKDELLKSAENSRDQMNAFNAKLDELKHQASEKESLLKYTQQQLSDAKIKLADKQAALEKIQWEAMTSNKKVDKLLDELGSMQADITSFTLLLEGLSKTDTAKYTNDYDVKPYDFSHLPSIDDLDEVELQKMDEARKAYMAAVSISKEKRDEESIAAAANARPVASGFSKAEELIISFSLKWHSASFLLAADSDWQRLYTWYY

SEQ ID NO: 116697 - protein, 396 aa, Glycine max
  Coding DNA Sequence Number=SeqID_25012
  Gene Ontology: Mol. function=phosphotransferase activity, alcohol group as acceptor; Cellular component=cytoplasm; Biological process =cAMP biosynthetic process
  Homolog annotation: Hit_ID=A7PGI4; Match level="QueryCoverage=99%, HitCoverage=59%, E-value=0.0, Identity=87%"; Hit description =Chromosome chr17 scaffold_16, whole genome shotgun sequence
  Pfam annotation: Domain name=CYTH; Domain location=247-392; Score =38.4; E_value=2.6e-08; Accession=PF01928.12; Description=CYTH domain
  Pfam annotation: Domain name=PRK; Domain location=66-240; Score=56.0; E_value=1.3e-13; Accession=PF00485.9; Description=Phosphoribulokinase Uridine kinase family
  Pfam module annotation: Pfam domain module=CYTH::PRK; Domain location= 247-392::66-240
MAQDTVSGVDSPRGRLLRDQVQVVKKKDSDRYEIVPIQDSLSFEKGFFIFIRACQLLAQKNDGIILVGVAGPSGAGKTVFTEKVLNFMPSIAVITMDNYNDSSRIIDGNFDDPRLTDYDTLLENIQGLKAGKPVQVPIYDFKSSSRIGYRTVEVPGSRIVIIEGIYALSEKLRPLLDLRVSVTGGVHFDLVKRVLRDIHRAGQEPEEIIHQISETVYPMYKAFIEPDLQTAHLKIINKFNPFSGFQNPTYILKSARTVTVDQIKAVIAAEHTETKEETYDIFLLPPGEDPEACQSYLRMRNRDGKYNLMFEEWVTDSPFIISPRITFEVSVRLLGGLMALGYTIAAILKRSSHVFHDDKVTIKTDWLEQLNRTYVQLVLMKYIWKKDRMPVKHICW

SEQ ID NO: 116698 - protein, 93 aa, Glycine max
  Coding DNA Sequence Number=SeqID_25013
  Gene Ontology: Cellular component=integral to membrane
  Homolog annotation: Hit_ID=A7PGK0; Match level="QueryCoverage=96%, HitCoverage=39%, E-value=1e-22, Identity=50%"; Hit description =Chromosome chr17 scaffold_16, whole genome shotgun sequence
MKNATFWEVPKKGPAVNNNSDCNTWNNRREKLCYDCNSCKGGVLANIRNQWKRLTVFNACVLLLVTAIYALGCYAIKNNRSHSHCNHRKTPIP

SEQ ID NO: 116699 - protein, 118 aa, Glycine max
  Coding DNA Sequence Number=SeqID_25014
MQKDSAFEKSLWWICDSKQRERERERAIHTLAAMVTPQIPASYYSYFPPVYRDEVKSLEAAVHRSLPEFGCGRTQSKNRSINLCIQRSLCLSLPAISFLFLLLNNIVFMLPLVFIWKN

SEQ ID NO: 116700 - protein, 984 aa, Glycine max
  Coding DNA Sequence Number=SeqID_25015
  Gene Ontology: Mol. function=RNA binding; Cellular component =intracellular; Biological process=RNA processing
  Homolog annotation: Hit_ID=A7PGL0; Match level="QueryCoverage=90%, HitCoverage=90%, E-value=0.0, Identity=53%"; Hit description =Chromosome chr17 scaffold_16, whole genome shotgun sequence
  Pfam annotation: Domain name=DUF1604; Domain location=36-124; Score =192.1; E_value=1.4e-54; Accession=PF07713.4; Description=Protein of unknown function (DUF1604)
  Pfam annotation: Domain name=G-patch; Domain location=159-200; Score =5.3; E_value=0.043; Accession=PF01585.14; Description=G-patch domain
  Pfam module annotation: Pfam domain module=DUF1604::G-patch; Domain location=36-124::159-200
MESDEDDFVFYGTPIEREDDSISRKKKAIAESSGQLRTLPAWKQEVRDEEGRRRFHGAFTGGYSAGYYNTVGSKEGWAPQSFKSSRKNRAEFKEQNILNFLDEDEKTELEGRFLGTTSQFDTFGFTAAEIARKQAEKEQKQRPSIIPGPAPDEIVVPATESVGVKLLLKMGWSHGRSIKDSHSEALYDARRQARRAFLAFSSDDPKVKITETEPIEGDTENFPEEPVNDDVWFSKSTPVYVLNPKQDLHGLGFDPYKHAPEFREKKRSRLASKGGPGFSTRDGLFGLKSGKAAPGFGIGALEELDAEDEDVYATGYEFEDAYVQEVEEPLTLRLENQRKEVEEPSTLRLESHRKKEQKDQGDLPGFRVASNSDYKMERFEAPLIPKDFVPHHEFSGPLDINRKSYEVNPPDVPPPEDGNLKLLIEGVANLVAKCGTGHEYYARKLWEAQQKHNNQTSRQLDRKMPPSVQRLTAESRGQILGEKPLEKSSQDLSSSVASTDIHLQFNLTDTFIESASLSELMNVEKPFKDDPAKQERFEQFLKEKYKGGLRSASSSLAGDMSEVARAQERLSFEAAAEAIEKGRQVRGSKPLIPSSVDFIPGGVMQFTSGEVKPKKDLQAEDILKKKMYPKREEFQWRPSPLLCKRFDLIDPYMGKPPPAPRIRSKMDTLIFTSDSVKGAKVDEPVTSKKDISPLQLSTNKDITISITENEMEGDVEVENIERPVDLYKAIFSDDSDDEGPSNRRVENQEKKAEVANTALSRLIAGDFLESLGKELGIEVPPDMPYAMQKSRNVAPQKDIFNEDARTDILKSENNGVMSLNHDLPNDQQHIAHEGGPSKGDDTIDGNMLESSINKTKGTSSQDNDSCSEERSKKQSNREKYNEYRKDKTPRKGAENVPDIIGIRSAMQEVIHLVTMTEEIDTVQGQKGEGKVLPKKKAGVKNTQNITSTESMNLQIDPLVIAKRKTIHIPEKRKGGENERETCFL

SEQ ID NO: 116701 - protein, 713 aa, Glycine max
  Coding DNA Sequence Number=SeqID_25016
  Gene Ontology: Mol. function=microtubule motor activity; Cellular component=microtubule associated complex; Biological process =microtubule-based movement
  Homolog annotation: Hit_ID=A7PGM1; Match level="QueryCoverage=87%, HitCoverage=99%, E-value=0.0, Identity=64%"; Hit description =Chromosome chr17 scaffold_16, whole genome shotgun sequence
  Pfam annotation: Domain name=Kinesin; Domain location=166-480; Score =465.6; E_value=6.5e-137; Accession=PF00225.14; Description=Kinesin motor domain
MPVSTRSQISVSNNNGESEPNPSSAATRLRNPHHGLKEKLKTLTLLYEQQKQASASLRNASFTFRPPPPEKAVMRENTMPNTTITRTFVLPQPPSNDNDDAKENVIMGADRIVAFSCPRKTMKANNNVLASQSASVARKLSMGPVRVEAVSEKHGKLGSRILVFVRVRPMNKKEKEAASRCCVRVVNRRDVYLTEFAIENDYLRLNRLRGRHFTFDAAFPDSASQQEVYSTSTSELVEAVLQGRNGSVFCYGATGAGKTYTMLGTVENPGVMVLAIKDLFSKIKQRSCDGNHVVHLSYLEVYNETVRDLLSPGRPLVLREDKQGIVAAGLTQYRAYSTDEVMALLQQGNQNRTTEPTRANETSSRSHAILQVVVEYRVRDAAMNIINRVERALATDQRTLRSLEGANINRSLLALSSCINALVEGKKHIPYRNSKLTQLLKDSLGGTCNTVMIANISPSNLSFGETQNTVHWADRAKEIRAKVSDANEDQLPVPEIETDQAKLVLELQKENRELRIQLAQHQQKLLTLQAQSLASQSSPTPPPSAGPLSTPPTSAQPIEKRRTRSSFLAGTCFTPEAKKKGAELAIKTLQQTVKTLEAEIEKMKKNHSLQLKQKDDLIHELSQKGGKQALTTGELGKGVVTRSSLRPKEPNNSEMKSPSQRFRSPAPTAKKRSFWDITTTNSPSVTTLNGRKTRSHVLAEPAAPPPSMLLQVQ

SEQ ID NO: 116702 - protein, 694 aa, Glycine max
  Coding DNA Sequence Number=SeqID_25017
  Gene Ontology: Mol. function=zinc ion binding; Cellular component =nucleus; Biological process=anti-apoptosis
  Homolog annotation: Hit_ID=A7PGM6; Match level="QueryCoverage=87%, HitCoverage=91%, E-value=1e-105, Identity=50%"; Hit description =Chromosome chr17 scaffold_16, whole genome shotgun sequence
  Pfam annotation: Domain name=zf-C3HC; Domain location=76-256; Score =135.6; E_value=1.4e-37; Accession=PF07967.4; Description=C3HC zinc finger-like
  Subcellular localization annotation: CTP_CleavageSite=65; ConfidenceScore=5.16e-01
MAQDSEKRFHSIMDKLFHPPKPPSASSSSGVQLPGSSKKRPYQSGIMELNWRGDVAEGQQSSSAATMALQGSLCRPWDRGDFMRRLATFKSMSWFAKPKNDTSSVEVKTYSSLTISGKEYSISFGKESFLPHGLLPTMRQEAFFFDTSSVEVVSAVNCASRGWINVDIDTISCEACGARLLFSTPASWNQQQVEKAALVFSLKLDNGHKLLCPWIDNACDETLARFPPATPPVLVDNFREHCFALLQLSALPRISPSAIDYMQSQSTLLEDFLGQSLMLEYGNGSAENSGIGDVSSQEELKLYYQAQKLISLCGWKLRPLPYVVDWKDMSDQSLNNTTNLVVHSAGTNEHLKTDESSKDSIGEQMDPNSAVLDCSLCGATIGLWAFCTVPRPVESIRLVGYAEVNGENADLENRQGVNNTMPDVANSSKDTSSSLNMTIAGGPPPTKQNFKAIISLPIIGQNLRARLSYDSDFRDHVFVDRGGIQSDLQEKTDNIVNAFIGQLVPVSSEIREISNFETGSQSSLHDSDVLAGQSSALKDKMPVHTDADKLNSSAAGYPSSSQCTLTKDIVAQKDSTEGEAPSVSHKTLDGQVGSLENYGVKDREENPISRDNVLYSLGKLKNPPVSDKAMEFDPIRQHRHFCPWIASINDGEPGWKQTLSALYHQKNHLPHSPNRSPSSMPIVKVFLADIITLI

SEQ ID NO: 116703 - protein, 231 aa, Glycine max
  Coding DNA Sequence Number=SeqID_25018
  Gene Ontology: Biological process=response to stress
  Homolog annotation: Hit_ID=A7PGM8; Match level="QueryCoverage=49%, HitCoverage=53%, E-value=1e-40, Identity=72%"; Hit description =Chromosome chr17 scaffold_16, whole genome shotgun sequence
  Pfam annotation: Domain name=Usp; Domain location=2-126; Score=38.1; E_value=3.2e-08; Accession=PF00582.17; Description=Universal stress protein family
MDVRNIAVVVEDVDAARTALQWALHNIIRYGDIITLLHVYPLTRSKSKNKARVLRLRGFQLALSFQDICNNFSNTKVEIVVTEENKEGMKIVAMVRQIGASMLVVGLHDQSFLYSQFSVWMLIKFKVHLVLFGAKTKVVIKGIGDFTLSHTEKDTGSENYYYYSFLVLPRITLRHGIYRTWVDLSNLDSAQHENESAVASELQKLVTENLGTCTCLLNGDKKMPKAFGLHF

SEQ ID NO: 116704 - protein, 76 aa, Glycine max
  Coding DNA Sequence Number=SeqID_25019
MAAEWRRKRERRCHFKEKMSLEEAHHHRRPWIRGRRKKEMNERRGREEHEILCSKRALKSEPTNPRSIPRFSTKCA

SEQ ID NO: 116705 - protein, 101 aa, Glycine max
  Coding DNA Sequence Number=SeqID_25020
MAIQADEGRAEEKVEGYKQQSVAEPALELVSDLIELEEVLEDEDDQQERETPIKESEIGIKMKEEREKEKEKEEIEKEKNQKNEKEKEKVDEEKKKSKSEV

SEQ ID NO: 116706 - protein, 97 aa, Glycine max
  Coding DNA Sequence Number=SeqID_25021
MSMDEFLAQVAWPGVQPSPSGGEDELVPPGQFIFETDPVAQEEAAVQEPTSSAPISPAPISEDTKPSAPAMEPEQPILQDVAAALVLDLNEDQPQDE

SEQ ID NO: 116707 - protein, 491 aa, Glycine max
  Coding DNA Sequence Number=SeqID_25022
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=96%, HitCoverage=82%, E-value=1e-129, Identity=53%"; Hit description =Glucosyltransferase-13
  Pfam annotation: Domain name=UDPGT; Domain location=15-486; Score= -27.7; E_value=3.3e-09; Accession=PF00201.9; Description=UDP -glucoronosyl and UDP-glucosyl transferase
MESAARTTTTTTHIALVSIPAFSHQVSILEFAKRLLNLHNNTFNITCIIPTLNSSYNNIATKPFFDSLPPNIHCIFLPSVYFEDLNNNGVSVEIQIQLSVSRAMPSVRETLRSLFDATNNVVAIVADAMVPEALDFGKELGILSYIYFPCSTMLLSLCLHSSNLDEQVSCEYRDHPNLIEIPGCISIYGRDLPNSVQNRSSLEYKLFLQRCQRYRSAHDGILVNSFMELEEEATKAITQHAKGNGNCSYPPVYPIGPITHTGPSDPKSGCECLLWLDKQPPNSVLYVSFGSGGTLCQEQINELALGLELSRHKFLWVNLRAPNDRASATYFSDGGLVDDPLHFLPLGFIERTKGQGLVMCGWAPQVEVLGHKSIGAFLTHCGWNSVLESVVHGVPMMAWPLFAEQRTNAALVTDGLKVAVRPNVDTSGNSVVVKEEIVKLIKSLMEGLVGEEIRRRMKELQKFAECAVMKDGSSTRTICKLAHKWKSLGRP

SEQ ID NO: 116708 - protein, 108 aa, Glycine max
  Coding DNA Sequence Number=SeqID_25023
MVTIGRPKNAVIWGCLILCELIESISIVSYPNFIRGLSFIDLLILASRLTVRDGELRKGFQGSEGEEIERREKEEEERRGNEVEALPNRDCDQSLRCSLFGVLRATID

SEQ ID NO: 116709 - protein, 50 aa, Glycine max
  Coding DNA Sequence Number=SeqID_25024
MMQQPQALPQGDPCEGKGPVTRAMSMRLQEDWARAAEEGPRVLINLRVDF

SEQ ID NO: 116710 - protein, 355 aa, Glycine max
  Coding DNA Sequence Number=SeqID_25025
MPPRHSRFHDRDPSHRDDDAHEQPEEAVVNDAVIDAKGFPSGPHDTSVLMDYVYHVATKERPKLKLSSHGRKVEKFGRPAPEIEGLVVAIRLSPIIARSLDMGDRGLMSAFGGEVTITLDDVASLMHLPITSVFHSFEPLCVDDVMFLLLKLLEFSAEEARADIVQYHGADDEKKPYACRWKFGKALPVSTYHKRLDRLTSDVVCWILYGDHLAFREFETIPSYPAAPSLCIEDIDDRWIQFSKYIALPGDPARHLLVQHYDTFVEPNVAQHPMATTTMDEAPEDAHADVDQFRHVVEACQAITERLERLLNLSIVTEGIKAYTITEECPRIARGVTTQQNVYIRSRRRRRIEDT

SEQ ID NO: 116711 - protein, 304 aa, Glycine max
  Coding DNA Sequence Number=SeqID_25026
  Pfam annotation: Domain name=Transposase_23; Domain location=56-110; Score=-17.0; E_value=0.087; Accession=PF03017.5; Description =TNP1ENSPM transposase
  Subcellular localization annotation: CTP_CleavageSite=32; ConfidenceScore=5.30e-01
MAMLVVGPHMGRLTGASSMGGKCTESPPTFIRGKRRKNRKGGDFGSYSQFGSCQTRTAKTISVYEGSTVVHNTPLLPVQVKVGVEEVKDPDASVLVPTYELSLVGRAIHIILAWPTHLVQSLSQQDPKVDDPLYLMALTIPELFLRPYQVPWDATVFGVFNPDFPLYIKHEDLSEIAHDGQCLSISVLQLHLTETSMRAGNFDIYGFLEPQSIQSGHWQMVVIMPKEHLVVWFCSLHNRPDNYLKGIINSALKGLDDALQPKSKAPTRWIIVKYFNDPRPLEPERLKALRIQWAQYYLRVRAQS

SEQ ID NO: 116712 - protein, 60 aa, Glycine max
  Coding DNA Sequence Number=SeqID_25027
MEKGGAGDNGKRKKCGIHAKRAFGFLRGPSSPKRELAAKRGDTLGMSCVLSELSQCPTFL

SEQ ID NO: 116713 - protein, 376 aa, Glycine max
  Coding DNA Sequence Number=SeqID_25028
  Gene Ontology: Mol. function=transcription factor activity; Cellular component=nucleus; Biological process=regulation of transcription
  Homolog annotation: Hit_ID=A7PKF1; Match level="QueryCoverage=78%, HitCoverage=55%, E-value=6e-98, Identity=64%"; Hit description =Chromosome chr15 scaffold_19, whole genome shotgun sequence
MLKIEEPNLIALELWSSFGKQRHTFQRIDEATKSNLSLEICFSLVEHSPRLFGASDTRAPELVDFPSSETNASSSTEIEHIASNRTHLTCVESSSASTSAPPHMHDEITGSSGSSALIESNRTGQSGISILQSYYTDYGMWTVLSQLVKRMELAILGSIDIIILENLIDRARRTVRGSADDIGWLQRDPGMPSVEDGTVRFLEILDNIKHGVHRLPNSVVYLLIPGLFSNHGPLYFVSTKVSFSKMGLACHIAKIHSEASVEKNAKELKEYIEEIYWGSNKRVMLLGHSKGGVDAAAALSLYWSDLKDKVAGLALAQSPYGGTPIASDLLREGQLGDYVNLRKLTEILICKVIKKNSGKSSESCGMLGMQSCGLRE

SEQ ID NO: 116714 - protein, 65 aa, Glycine max
  Coding DNA Sequence Number=SeqID_25029
  Subcellular localization annotation: CTP_CleavageSite=17; ConfidenceScore=5.30e-01
MTTTHLAVSMNGRPKIKGMFGSSSMSMITKSIGKIKQVNNTRELLTQFGATSPTSGGYQAREEIH

SEQ ID NO: 116715 - protein, 109 aa, Glycine max
  Coding DNA Sequence Number=SeqID_25030
  Subcellular localization annotation: CTP_CleavageSite=43; ConfidenceScore=5.06e-01
MEARKGIPILPILVIFSLLMPPKANTPPSFGFRLSNIDFSSVMCHEQSLPDALMQSYPPRVLDRRLKEAWARATKEGPRVLMNLRLLKEVFSKKLFKEVFSRKLLKEAT

SEQ ID NO: 116716 - protein, 246 aa, Glycine max
  Coding DNA Sequence Number=SeqID_25031
  Homolog annotation: Hit_ID=Q2HTA0; Match level="QueryCoverage=34%, HitCoverage=14%, E-value=3e-12, Identity=46%"; Hit description=IMP dehydrogenase/GMP reductase, related
  Pfam annotation: Domain name=DUF1723; Domain location=170-219; Score =40.2; E_value=7.6e-09; Accession=PF08330.1; Description=Protein of unknown function (DUF1723)
IFGPDVLDIVSDIVDPAASMLLAIPDVLDIVSDIVNPAASILHLTFHLALCIVQPDLIVDITLDIIVIGRVMGSENNRDSDEAPQQRRPTTSARWQREAAPIVEDAHHVDEHDEHPGDPVPIAEEDLECPKLKLSSNGRKIQKFERPVVEIEGLVVAIKLSSLVTCSLDTDDRGLISTFTKMLHKETSSFHLPVGEVTITLDDVVSLLHLPITGTFHSFETLHVDEAVLLLVKLLEVNADEAKVET

SEQ ID NO: 116717 - protein, 65 aa, Glycine max
  Coding DNA Sequence Number=SeqID_25032
MEIISKRFEELDVCGKVTLKSKLWEIVYPDLNYMCPPPEKVNNKGDQKKSMTKHQRSTKCDPSYW

SEQ ID NO: 116718 - protein, 211 aa, Glycine max
  Coding DNA Sequence Number=SeqID_25033
  Homolog annotation: Hit_ID=Q2HW90; Match level="QueryCoverage=91%, HitCoverage=44%, E-value=2e-22, Identity=32%"; Hit description =Putative uncharacterized protein
MGTNQIGKRFYQVKIKGLDVTSLKELGQLMGQLQRQTFRKTYGKIWDLAMIEVSTEAISSLTQYYDQPLRCFTFGDFQLSPMVEEFEEILGCPLEGRRPYLFSGFYPSLARISKIAKARTLACRGEWAPFIDILALLTFGGVLFPNVDGLVDLAAINAFLAYHDHKESPVVPMLADLYDTFDRRCVKSSTRIVCCIPSLYVWLVSHLFRQE

SEQ ID NO: 116719 - protein, 210 aa, Glycine max
  Coding DNA Sequence Number=SeqID_25034
  Gene Ontology: Mol. function=DNA binding; Biological process =regulation of transcription
  Homolog annotation: Hit_ID=A7PQI2; Match level="QueryCoverage=30%, HitCoverage=77%, E-value=2e-14, Identity=60%"; Hit description =Chromosome chr6 scaffold_25, whole genome shotgun sequence
  Pfam annotation: Domain name=Dabb; Domain location=120-203; Score =12.2; E_value=0.0033; Accession=PF07876.3; Description=Stress responsive AB Barrel Domain
MAAEFGQQTVDLSTLVTPDLSLAARVTRVDSSTVCCPNLATIDFLFGYIPRDSATNKGSYEQRPSSFAPKAYEMEGSCKSKINNTKNDTNLMSNSSNKDMFLDSYTTRNGSDDFYDGLGCCHVRGKADSIASAPIGGFNAARKGRGKDIESHDMLRQGFTHVFLMAFNGKDEFNAFQTHPYDLEFTGVFSPAIKKIVVLDFPSNLVKALA

SEQ ID NO: 116720 - protein, 166 aa, Glycine max
  Coding DNA Sequence Number=SeqID_25035
AGSTWTVGLSTPGGLVAKDHNRVTLRVRFKVDRDCDATAGGGGGGGEGGGGGGEPSGVAMGLLAAGVSLNEACSLSENHALSEALSPLSELGESGGNSDKHLCAQRIISLLSEAFVFSRAKLGKIKHYSSGEANSECREQNRGKNQNKEAKNLSFQEDLRFRSNFQ

SEQ ID NO: 116721 - protein, 105 aa, Glycine max
  Coding DNA Sequence Number=SeqID_25036
MQYGEDNRRTPTHGFSEPIQLNIFIDGLRPHSKQLLDASTGGKIKLNPPDEAMELIENMAASDHVILPDRAYTPTKKSLLELMSQDALLAQSKLLAKKIETLTET

SEQ ID NO: 116722 - protein, 158 aa, Glycine max
  Coding DNA Sequence Number=SeqID_25037
  Gene Ontology: Mol. function=endonuclease activity
  Homolog annotation: Hit_ID=Q2HUJ2; Match level="QueryCoverage=80%, HitCoverage=32%, E-value=4e-12, Identity=27%"; Hit description =Endonuclease/exonuclease/phosphatase
MSRPNTELKETINVEIIHHLSTDAGTTFTSYYRGILDNCPILLRSSNVDWGLKPFRVLDCWFQDKKFRKVKKISRIESEINSLESDGDGRQLDDQEIQLRKKLQEDLWVTATSYESLLRQKARSKWIKEEDCNSKFFHIIVNGNRRYNSLRALHVEKC

SEQ ID NO: 116723 - protein, 157 aa, Glycine max
  Coding DNA Sequence Number=SeqID_25038
MVVAMLNGTKHKTHLVEESCYSPCRYKCHLGNMFGSSGKIILGDSEVESMVLSEPKSPKDGKAMTIRQQDDDHNRWNNITQRIDGQSNEARPMGSNHWSLSLSQINIVIGQIAAMESNKVESQPRVQQSLTKKHFTQKPAGFNHELVKKVDLAKMAI

SEQ ID NO: 116724 - protein, 59 aa, Glycine max
  Coding DNA Sequence Number=SeqID_25039
MYKVDQVGSATNEVCISASLLGVREWADPYSIQIKLIRKTGTNQVDLYVDINHMDQLDP

SEQ ID NO: 116725 - protein, 200 aa, Glycine max
  Coding DNA Sequence Number=SeqID_25040
  Homolog annotation: Hit_ID=Q2HTA0; Match level="QueryCoverage=40%, HitCoverage=15%, E-value=3e-07, Identity=38%"; Hit description=IMP dehydrogenase/GMP reductase, related
MDKKCAVSSSGGVSLGKTDDSWDTSIFFIPFKVGLLAELWGERIVMILMMLPQWRRPTASARRQQGDVPVAEDKPVLPTDKPVVLAVDPVVDADEPMVDADVQDTGVDTGAEAAADKPKGFPSGPRDTSVLTKYVDHVTVSEWSGEKLGRLVPAIEGLVAGTGLSPLIACSVNTGDRGLISSFVERWHRETSSFHLPVGE

SEQ ID NO: 116726 - protein, 124 aa, Glycine max
  Coding DNA Sequence Number=SeqID_25041
  Gene Ontology: Mol. function=transcription factor activity; Cellular component=nucleus; Biological process=regulation of transcription, DNA-dependent
  Homolog annotation: Hit_ID=A5BRJ8; Match level="QueryCoverage=60%, HitCoverage=9%, E-value=7e-17, Identity=60%"; Hit description =Putative uncharacterized protein
  Subcellular localization annotation: CTP_CleavageSite=96; ConfidenceScore=5.32e-01
MGNKWRKLKLALGLDSCVHTPRAFDDSSAATASVSSGVSPTIISSTCNTSGYRPSIPTPLSYGYPNPLRHRWMSRYRAPLWDNSSRREGQNRKGKQGGYDKEEKAARVYDLVALKVLHYIIPID

SEQ ID NO: 116727 - protein, 154 aa, Glycine max
  Coding DNA Sequence Number=SeqID_25042
QTPKFPTDAKRIDVRVFIMHGADGDNGHDGGVPEAGMAVHGYVLQRKASYAFGHALDPNPNLLLDQGLPLGKHGVLNPLPNWSLIVNGNPNLKILVYVLVRGVGNLNGVVNFKKRGFLRIFGFALPIELEVDLIAEDDFPLADNDVGLTVEGVE

SEQ ID NO: 116728 - protein, 17 aa, Glycine max
  Coding DNA Sequence Number=SeqID_25043
MDTRLHVIGDPMNGVQR

SEQ ID NO: 116729 - protein, 109 aa, Glycine max
  Coding DNA Sequence Number=SeqID_25044
MGGEPSQVKDTTEAGAGDDIIVDLAANWDPWQTSVQVVEYESQQREEKGLTKHKDFSHDMPLIWGRVKVKTVSGRPHYKPIKVVSDPPSVSRITLTEMKCKTRNINCRS

SEQ ID NO: 116730 - protein, 62 aa, Glycine max
  Coding DNA Sequence Number=SeqID_25045
MQFCDLLRGVHSVISLILAFILDRAAHHHRFPFEIGYNDSCGQFALIIVFNLELSVWTVWGD

SEQ ID NO: 116731 - protein, 153 aa, Glycine max
  Coding DNA Sequence Number=SeqID_25046
  Gene Ontology: Mol. function=RNA-directed DNA polymerase activity; Biological process=RNA-dependent DNA replication
  Homolog annotation: Hit_ID=A5AZ88; Match level="QueryCoverage=25%, HitCoverage=3%, E-value=5e-09, Identity=69%"; Hit description =Putative uncharacterized protein
MKEEVVPKKGDMKMICNDKNDLIPTRTITGWRIFIDYRKLNDVIFLCHSWTKCWKGSYSERFDIHIYIAYFRKRAPTGAEKHEKLEPERWHANRGMNSASESFKIPPHFYSKPFSESWSTPLHCGASNFRKLVEKCEILRVRKPNLGLVEIGV

SEQ ID NO: 116732 - protein, 75 aa, Glycine max
  Coding DNA Sequence Number=SeqID_25047
MAFGNRLPMVCNRLHRVIWPLIAMAAQLIHDRVVMECLEGVWETLEGNERCQFRGTIRLTATSLVHPEEPARTLQ

SEQ ID NO: 116733 - protein, 119 aa, Glycine max
  Coding DNA Sequence Number=SeqID_25048
  Homolog annotation: Hit_ID=Q8LNP1; Match level="QueryCoverage=72%, HitCoverage=29%, E-value=4e-07, Identity=33%"; Hit description =Putative uncharacterized protein T18N24.41
MVGPTSAMCNCRKSWDTIMSDIRLLLPAILRQMLEEIRFNAYESSKIYKQKVRACHDRKLVKKNFQPKQQDVKPYGAIELMDPSSTDLEHSWIVNGQMLEVYNGGDIERLTTIIKLRDL

SEQ ID NO: 116734 - protein, 231 aa, Glycine max
  Coding DNA Sequence Number=SeqID_25049
  Subcellular localization annotation: CTP_CleavageSite=55; ConfidenceScore=5.09e-01
MTEPRVFLCAPSKIVGAPNNNIEVTKMPFSKNLKKLSPSLPLQRAVVATIHLFLCASRVPPLGCESILVIVSVISVTLPTPLVIMVRTRGLGQALGRVIGRAPGREVNRDLDEASQRRRPTTSACRQWEAALVAEDVQQVDHVANEIHEQPEEAAVDDVVPDAKGFLGGPHDTSVLIDYVDHVAMIVWNGEECPELKLSSHGRKIKQELRQYNAMGICLTIMAARHLSQQM

SEQ ID NO: 116735 - protein, 250 aa, Glycine max
  Coding DNA Sequence Number=SeqID_25050
MGLYNPGKIVEAARRGISSWRHCWPLEKEEKGQREIKVETRECEKERERREKPLTPPMIFKPASTLRKSNDQNRRLSINDVSFVDVSFLDGNPLSHQHSGVETGIIEGVEKDEKHILLPIQEDVYKSCESISTLASDLFEDVRASIQKSSKKSTPSTSNIKVSSSPSVPLFQTHDWYILCGTSRGYIYLGCYTENKIGYISCGSVQVEGTSTWLFKENKGGYIPCGSLACKGFYKVERNLKNRWLLGDWM

SEQ ID NO: 116736 - protein, 52 aa, Glycine max
  Coding DNA Sequence Number=SeqID_25051
MSVKNLVGCLGVHDKTNHTLASQVTLTRFKGALKPCDPQGLHSEESIRASPT

SEQ ID NO: 116737 - protein, 89 aa, Glycine max
  Coding DNA Sequence Number=SeqID_25052
MTTLAQRWSFLSYFNLAPTSHTSDLNMDKARLIYGIIMKMDMDSGKHPTTWFLTLATDHVDRRILASSIGVDVVEISSVMGIGLPLSEG

SEQ ID NO: 116738 - protein, 124 aa, Glycine max
  Coding DNA Sequence Number=SeqID_25053
MERFLGLACHECLVRFGEQVFALSLHVPIKPDSKNFPNREVFELRATRVLSTSGKFDGGGQSLNVTTIVNLQPLAIHDPAMIQVGKGRVHLLNCYIRLHILDGEGARPLGSKLSRKELKARPTV

SEQ ID NO: 116739 - protein, 50 aa, Glycine max
  Coding DNA Sequence Number=SeqID_25054
MASYLQDALWQAQHPQGAVEAEQQSHDGMSPESVRRALEEPHKDFEGSSI

SEQ ID NO: 116740 - protein, 283 aa, Glycine max
  Coding DNA Sequence Number=SeqID_25055
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=50%, HitCoverage=69%, E-value=1e-21, Identity=42%"; Hit description =Ethylene-responsive element binding protein 1
  Pfam annotation: Domain name=AP2; Domain location=80-132; Score=78.2; E_value=2.6e-20; Accession=PF00847.11; Description=AP2 domain
MNNFNTTLESDDFALLESIQRYLLDDNEDFNSLTEVLATPNNNVNAVNSPLSSLGHATTAATEGRGASSAEARGGHVRNQNYKGVRRRPWGKFAAEIRDPNRNGARVWLGTYNSAEDAALAYDRAAFEMRGSKAKLNFPHLIGCSDAEPSRRIKEETLCLSSSSSLMIIYLSLSIRCGAKVVNPNSSLISYDSMMCSLHCHQISHGGQISTNVAGLVALGRTAEELVHLKPDLKFVRLNVVALLYGGNGGFQFEVGKVIERESVELGVRTRMNGSDLPQQVHL

SEQ ID NO: 116741 - protein, 55 aa, Glycine max
  Coding DNA Sequence Number=SeqID_25056
MPICVRPMKFERMKSVMEFAVTLLAEVWAEEIMMILMMLRSVDGLPHPHGGNEYL

SEQ ID NO: 116742 - protein, 113 aa, Glycine max
  Coding DNA Sequence Number=SeqID_25057
MDKGGISSSKGRVGLMNPKDTKNRLEAQRKNKKGEVVHEVVFLLQPLVSKGKVVLSSSSGFVEKNEWYMVLWDSSKWHIGVVKDDEQFIHLEVQNVGRKWFMTMVYANPHPLM

SEQ ID NO: 116743 - protein, 273 aa, Glycine max
  Coding DNA Sequence Number=SeqID_25058
  Gene Ontology: Mol. function=nucleoside-triphosphatase activity; Cellular component=integral to membrane; Biological process=protein catabolic process
  Homolog annotation: Hit_ID=Q4W5U8; Match level="QueryCoverage=96%, HitCoverage=57%, E-value=9e-35, Identity=41%"; Hit description=FtsH protease
  Pfam annotation: Domain name=Peptidase_M41; Domain location=150-271; Score=-43.1; E_value=5.9e-08; Accession=PF01434.9; Description =Peptidase family M41
EVASKGMSMITGTLYDRIIKKRNIRDFNEFQIVILDIWELLGAPSNNVGVPSTKPSIREAFLLLPPASGSSFFREVHLRSLQVALLLPRIPVLPRAFVVSFFIEVFSGLLLYYFIDEIDVVGRLKGTGIGGGNDEREQTLNQLLTEMKKLDKDVSLSVISMRTSEFSGADLANLMNQQNSGGLTWFIPGEDPSLISKNQLLARIVGGLRERAEEEVIFSETEITTGAAVDLQQITQIARQMVTKFGMSEIGPWALIDPTVQGHHVVLRMLARN

SEQ ID NO: 116744 - protein, 60 aa, Glycine max
  Coding DNA Sequence Number=SeqID_25059
MSCVRSVCARLQTSDPPRDVSATQPRHIPQEPAPASTHVDSDANKPRHAVVDPQKTCRSS

SEQ ID NO: 116745 - protein, 389 aa, Glycine max
  Coding DNA Sequence Number=SeqID_25060
  Gene Ontology: Mol. function=endonuclease activity
  Homolog annotation: Hit_ID=Q2HUP4; Match level="QueryCoverage=35%, HitCoverage=47%, E-value=1e-60, Identity=79%"; Hit description =Endonuclease/exonuclease/phosphatase
MKQLQSQARKYEKELAAYNYTKQLDFAHFTSEDSNIKSIPISDRMHRNKVMKRNKRKRVEEQCDIELYMSNHSLFSYYEKTDCTAVLKDVCDVGIGGVNDRDKEFKLNNEWSFGEYGNVDKSLNDIIQKIEAIQSQVQQLKTRIDMVISESGGKFCSIIQLSIHGPSDGFNHFDSTFTSNGNKLPFSFPHFSSQLQSEFHMGDLLMPGNASASREVMIPCIETTDGPELDDPLKDAFDSQRKTLSNLYDMDQLRNNVNARSLPGSNALYGSSTVSKEQGPLHRRPDVVKSKQGFPHFRERVWVKKLVHDRRIRFGTWNIGTLTGKSMEIVDVMVRRKINFMCLQETKWTGEKAKELDNSGFKLWYTGKIRSRNGVGIIVDKEWKKDVVD

SEQ ID NO: 116746 - protein, 101 aa, Glycine max
  Coding DNA Sequence Number=SeqID_25061
  Subcellular localization annotation: CTP_CleavageSite=53; ConfidenceScore=5.44e-01
MASNSLVLLPSQILKTPISSHSTAPYQPRSNIPFTIGASMMLLCLNLRQWSTTCTFGWDIHHPYRNLPFEEFGHRQGNSNSWWCYVSAKQPDLKRVGCGGE

SEQ ID NO: 116747 - protein, 104 aa, Glycine max
  Coding DNA Sequence Number=SeqID_25062
MARGGSETQLVIVLNVPSKICTVTLRQIDQSRFLLETYSQKGAVSKLFPEGLYFWRELANGVGELDTWQHLVELASGDGETLSTWRVPPFVMAKCFFYEFFFKT

SEQ ID NO: 116748 - protein, 424 aa, Glycine max
  Coding DNA Sequence Number=SeqID_25063
MEEAQAKGELPAFVGEDPIGWIASLWIKRLRDRYGNHFFKRFSILMQEEQTETEICIEEGGTSTMFLKERTNDVPKPKKMLQQLVKKQEIKPEQDGSWKEKAFQKEEPKSYGLHHHSCKVSISELKHGLLKSSEKVLEKKGINLEAKGVEEIRVEEDKNLQQKMQEQNSGFAIVIKEFHSWVVNVIEVEGDNGFFMKPTAMEIVIIWRWIAPTPPPDPLDANSNTILNGLSSASHNLPWRGMAKPRDTNPLASKSLSGMLRETESLWVGTTEMHHSSTNLFLEKEKGTKVKFTFCMVDLIMDVMGQDECGDSTTVCGFYNAVSVELVTVEEKHKSTLRPLDIHGKQNRHETRMVLQTESSNWVAGFIPLNLDDCVADYMLKEQRWKEIAASHMEVQIIQNLLPSRPPPEPQNSTPHAGEWMIPS

SEQ ID NO: 116749 - protein, 92 aa, Glycine max
  Coding DNA Sequence Number=SeqID_25064
  Gene Ontology: Mol. function=serine O-acetyltransferase activity; Cellular component=cytoplasm; Biological process=cysteine biosynthetic process from serine
  Homolog annotation: Hit_ID=Q8L5G2; Match level="QueryCoverage=56%, HitCoverage=21%, E-value=2e-16, Identity=73%"; Hit description =Serine acetyltransferase
MYIKLIIRVFCIMQNFFQLAFFTWISIRFDIRSCFHQETENIIIRDVPPRTIVVGNPAKLVGGKNSSVKLDKISIFTMDHTSHIADFYDYCV

SEQ ID NO: 116750 - protein, 97 aa, Glycine max
  Coding DNA Sequence Number=SeqID_25065
MIRKVKVIRLGEVNVQPIVRIFMLIFQIIMIVEAMPSKIILMMPKNQESSKFQRIKSQASFKNQDQDSRFNNNQDQDSRFKIQVNNQDSRFKNQEKT

SEQ ID NO: 116751 - protein, 188 aa, Glycine max
  Coding DNA Sequence Number=SeqID_25066
MECSWKLESFVRHVKLSSHLLVILGSVQPLIRRSEESISIEHRLEVHRGLQEVVQGANIKFHSLVPHLDLGRIGSLRVIGVGIKLHHQRLINVVLGQGGQHLIPLIRPNTRALQVGSDVDHPVKDNVDEVLVMYFYTNAYDIKGIYPIKVKVWGKTLKFDACTLNTFLKTRVNLQPMPGNDAFLTPYD

SEQ ID NO: 116752 - protein, 170 aa, Glycine max
  Coding DNA Sequence Number=SeqID_25067
  Homolog annotation: Hit_ID=A7NXG4; Match level="QueryCoverage=57%, HitCoverage=50%, E-value=1e-24, Identity=60%"; Hit description =Chromosome chr5 scaffold_2, whole genome shotgun sequence
MKDEDWALLNRQALEVIQLTLSRNVAFNIAKETTMVDLMEAISNMYEKLSASNKVHLMRRLLNLRMLEGASATQHLNELNIVTAQLSSVRIEFDEDSQEEEIQPEDMDVENKKTIGGPNPGIIEVPTTRSLSSIGIVETPGITKTSARLHQRFKRRMLRQMLLLDQVTSE

SEQ ID NO: 116753 - protein, 20 aa, Glycine max
  Coding DNA Sequence Number=SeqID_25068
MVAIFVGEEEKGKKEKGKKV

SEQ ID NO: 116754 - protein, 68 aa, Glycine max
  Coding DNA Sequence Number=SeqID_25069
HKDSMYDEDKARNKGNEPLEGLGGPMARARTKKAKEALQQVLTKLFEFRPKLQVEKLQIVNFTMFQEE

SEQ ID NO: 116755 - protein, 241 aa, Glycine max
  Coding DNA Sequence Number=SeqID_25070
  Gene Ontology: Mol. function=protein-tyrosine kinase activity; Biological process=protein amino acid phosphorylation
  Homolog annotation: Hit_ID=A7NYA7; Match level="QueryCoverage=70%, HitCoverage=33%, E-value=2e-33, Identity=42%"; Hit description =Chromosome chr6 scaffold_3, whole genome shotgun sequence
  Subcellular localization annotation: CTP_CleavageSite=30; ConfidenceScore=5.14e-01
MKARTFKMQKLPMCLPLAWRSPTTLPLPPMTETVFRVLFHKKIHFVPNRRRSSALPKARDVDLVEFDMKDVFLHIKLMEQASESDQPTIFTQEECDYEVQGSALRLTFACNSSVRCLVLWIVPLFVLVRIRVESTLMFATKRPKTGAMKLPFGLCGCQEENSKGGELVEIEEETSDGYRGKEFQDSGQRIQLQVPLPSSSFVVLVDEWQTIKSGGDEIEKLLLNLRSLINQEQSMPIGSCP

SEQ ID NO: 116756 - protein, 97 aa, Glycine max
  Coding DNA Sequence Number=SeqID_25071
MKLSLLCSATLSLFGNRKRKCLIRCLASLSLAEEAQQKARQNEEEVLISEVLVRNKDDEELERKDLEAEAAQALKACRRDSGKRMCIALGWRDFGKP

SEQ ID NO: 116757 - protein, 69 aa, Glycine max
  Coding DNA Sequence Number=SeqID_25072
MESAKHMATPMSTGCYLDKDESDQSIDMKQYRDPKQIERAQVGHVNLLDLLLYHGILLCPNFMDEATTI

SEQ ID NO: 116758 - protein, 262 aa, Glycine max
  Coding DNA Sequence Number=SeqID_25073
MVEQAKQASYVQDPCDESKLVVLHGKTIGVNVEDDDSVIDTYVSPLSTQISPNIVGEEVDDVPANHNDHDERELINIVYCIFYTMQMATPPNSPPSPLPTNATSHSPSTLKRTRKAIRLRSLATRPVGTKRPLVHDKIISHDSLEEHTSHGSFVTHGRQDVLIVTIGRLEHLVVFVLLELVSRSNNTLERLHRPPGLTLPLELEVGPSATRVSTKESYVDPSGNDPDTDESEKCELYNEENPSQLVSIGRIYEGSCTLWAMI

SEQ ID NO: 116759 - protein, 121 aa, Glycine max
  Coding DNA Sequence Number=SeqID_25074
MRKKDNEMKNGNHGEEMQTGENSEVTMEMEIGKMQRHEHCRAKPNSKRQNNNCSVGGNEKMREPDIATRPSSSRPAFGSPGPPNNFKAKGLACLGEVTALGLSFSLPGKVATAPRWPFAYK

SEQ ID NO: 116760 - protein, 178 aa, Glycine max
  Coding DNA Sequence Number=SeqID_25075
  Subcellular localization annotation: CTP_CleavageSite=47; ConfidenceScore=5.39e-01
MMIQPLILVSVLSPHKRCLMSTKKKLMMHMATPPSSPPILPESVAPSPSTSKKIEKVARLRSLATRPVGAENPMFHVDPVTGKVDVPHRKKLRIYLGIISRDKDVQNSLFYFYNFNKPFWKWKRFFSTSMLNHPKKMFFTVPKSPRYALQLFRNEHNNAPKGNIDNRIRRLLVEPLHA

SEQ ID NO: 116761 - protein, 114 aa, Glycine max
  Coding DNA Sequence Number=SeqID_25076
MSRLVDSRKRRASTSQPQEPYDATRFISEIMQYDEFCQELDRHRWSRALTRQPDNHIDVALVKEFYANLYDLEDKSTRQELIARLCIPRRGFVLNVEGAPWKLLKKDLTTLAQT

SEQ ID NO: 116762 - protein, 71 aa, Glycine max
  Coding DNA Sequence Number=SeqID_25077
MAKEEKVQVTDDSLSKVDPLSEWHLLREASSSLSGLRNPRRGSVRDVLAQRAASPPSEDVVSSRAQHAQSW

SEQ ID NO: 116763 - protein, 124 aa, Glycine max
  Coding DNA Sequence Number=SeqID_25078
  Homolog annotation: Hit_ID=Q2A9P6; Match level="QueryCoverage=63%, HitCoverage=22%, E-value=5e-10, Identity=43%"; Hit description =Putative uncharacterized protein
MGRKGKRVEGGWGWKEEARERRWTREKKGKEREKKGETEGEGGVQISRRGLSPLQKCVATIHILAYRSPADSVNEYVSIAECTVIQCFEAFVKDANGIFGDDCLRRTTTITSIIYYKLEIHMGF

SEQ ID NO: 116764 - protein, 94 aa, Glycine max
  Coding DNA Sequence Number=SeqID_25079
MDRARLVYDLVTKMDMDSLSPTINLAYIRMNCWNPNDPMITFPGTRKTRARGPDTSAPSFSAPTTSAPTLTLPVLVPTPSGTSAQSTEILVPML

SEQ ID NO: 116765 - protein, 151 aa, Glycine max
  Coding DNA Sequence Number=SeqID_25080
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=A2Q2E1; Match level="QueryCoverage=87%, HitCoverage=45%, E-value=5e-42, Identity=61%"; Hit description=GTP -binding signal recognition particle SRP54, G-domain
  Pfam annotation: Domain name=SRP54; Domain location=42-151; Score =36.3; E_value=7.9e-14; Accession=PF00448.13; Description=SRP54-type protein, GTPase domain
MSSPGLTILQVPKAIYRCSLFHMRHLECIRQEVSELVFAKFGPTIILLAGLQGVRKTTVCAKLANYLKKQGKSCMLVAGDVYKPVAIDQLAILGKQVDVPVYTTGTDVKPSEIAKQGLEEAKKKKIDVVIVDTAEVLLVVDAMTGQEATCI

SEQ ID NO: 116766 - protein, 141 aa, Glycine max
  Coding DNA Sequence Number=SeqID_25081
  Homolog annotation: Hit_ID=A7PKE3; Match level="QueryCoverage=99%, HitCoverage=55%, E-value=4e-46, Identity=64%"; Hit description =Chromosome chr15 scaffold_19, whole genome shotgun sequence
MMSRDAIRLEVAPKDGNWGFDVSEREAMLPAGTVDKNVERVYKELPKWEEDPNLHTRPRYKQIVKDLADKYHTENLLLVTHGEGVGVALSSFKKDVTVYEVDYCGYVQLRRPIFKKDQSFTAGEFEVLNHNGQTGVNFIPN

SEQ ID NO: 116767 - protein, 112 aa, Glycine max
  Coding DNA Sequence Number=SeqID_25082
MTPTHDALLYYNGRWNMPPQNKFQVAPKGIPPHGIQESKTVRRLFFRQPERFEYSDKVIKYEINELKINDEVLKVLVQSNYWKKYGPIEILAIFTKHGMEIEDDVAATSLND

SEQ ID NO: 116768 - protein, 81 aa, Glycine max
  Coding DNA Sequence Number=SeqID_25083
MITKDDDKKLKDQSKNNSSEPKINQRTTQVNQEEFNTQEESLESRFKVQDLKNQDSRFKISRIKIKIQDSRFKNQEKVQSR

SEQ ID NO: 116769 - protein, 119 aa, Glycine max
  Coding DNA Sequence Number=SeqID_25084
MKNSHETEKPLVGLNVEEPNQIMDVDTDGINFPKLQDDKRFRVRLQNQGNGIEDKPGMLNGDLYCARRPRALGESWWLGSSPMKMTWMSLLVLSWQRREQVEEEERDTSAFSWSLLREQ

SEQ ID NO: 116770 - protein, 315 aa, Glycine max
  Coding DNA Sequence Number=SeqID_25085
  Homolog annotation: Hit_ID=Q6WAY6; Match level="QueryCoverage=68%, HitCoverage=41%, E-value=6e-23, Identity=29%"; Hit description =Putative uncharacterized protein
NGVVEIPRKHLEEKAKALADQGEWASFIDILTLLIFGFVLFPNVDGLVDLEAIDAFLAYHHSKESPIIAILADVYDMPTYQLQGHRLCAEKGKENWEQLLASVVGASINWFPCWKEGITGVFSSCEGFPNVPLLGTRGCIIYNPVLAIRQLGYPMRGAPSEENITPFIAWDFSDPNARVLQGVCKAWDAVQRKDKKLWGSSNGIIDDSHKWLRAQTKELDWLPKLMVAREEETETLEEIKEKFKSTTIKVQKAYDELRDINMATAEALERETRRAQKEEQVEQNQRNIWAIIDQYKEKLNLAATHEWRLEDEYAK

SEQ ID NO: 116771 - protein, 147 aa, Glycine max
  Coding DNA Sequence Number=SeqID_25086
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MKHFTDTLISANIIKGRERGGEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 116772 - protein, 34 aa, Glycine max
  Coding DNA Sequence Number=SeqID_25087
GVLRLQDRICVSNVPELRKMILEEGHRSNLSIHP

SEQ ID NO: 116773 - protein, 108 aa, Glycine max
  Coding DNA Sequence Number=SeqID_25088
  Gene Ontology: Mol. function=oxidoreductase activity; Cellular component=endoplasmic reticulum membrane; Biological process =electron transport
  Homolog annotation: Hit_ID=A7QBE0; Match level="QueryCoverage=95%, HitCoverage=20%, E-value=2e-21, Identity=52%"; Hit description =Chromosome chr13 scaffold_74, whole genome shotgun sequence
MAIPEEDGEPAPQQPLLDVFQRFSFDNIYRFSFGLDPDCLTRQSGFTPVFVKNFDLTLKLFAERATTGSPFVWKLKRLLNLGSRKQLKKAVRVINVLVREVIQQRCKK

SEQ ID NO: 116774 - protein, 57 aa, Glycine max
  Coding DNA Sequence Number=SeqID_25089
MTKSKGKDPLEELGGPMTRARARKAKEALQQVLSILFEYKPKFQGENSKVVNGIKLF

SEQ ID NO: 116775 - protein, 114 aa, Glycine max
  Coding DNA Sequence Number=SeqID_25090
LKIPEEATELIENMYASYHAILSNRTHQPTKKSLLQVIPSMVRLGQCIPIEENTQEIHYMGNQQGQGYTQGRFSGFQQGPYNQQGQWRSHPGNQFNKDQGGPLNMPIQQGPNIF

SEQ ID NO: 116776 - protein, 287 aa, Glycine max
  Coding DNA Sequence Number=SeqID_25091
  Gene Ontology: Mol. function=phosphoenolpyruvate carboxykinase (ATP) activity; Cellular component=cytoplasm; Biological process =gluconeogenesis
  Homolog annotation: Hit_ID=Q5QUN4; Match level="QueryCoverage=100%, HitCoverage=54%, E-value=1e-125, Identity=74%"; Hit description =Phosphoenolpyruvate carboxykinase [ATP]
  Pfam annotation: Domain name=PEPCK_ATP; Domain location=1-287; Score =435.2; E_value=9.2e-128; Accession=PF01293.11; Description =Phosphoenolpyruvate carboxykinase
MFIRPSHYELENFGEPDFTVVNGSKTTNPNWEAQGLNSENFVMFNLTEKLQIIGGTWYGGEMKKGMFAMMNYYLPLKGMASMHCSANVGEEGDVALFFGLSGTGKTTLSADPKRYLIGDDEHGWDNNGVFNYEGGCYAKVIDLSEEKEPDIFRAIKRDALLENVVVNNGVSDYTDNSITENTRVSYPIYHINKIVLPSKAGHAKKIVYLSADAFGVLPPVSILDENQAQYHFLCGYTSKLAGTERGITSPEPSFSPAFGEAFLTLHPTMYSKTLIGKMKEHGAKAYL

SEQ ID NO: 116777 - protein, 26 aa, Glycine max
  Coding DNA Sequence Number=SeqID_25092
GVMAGRNNRAIANALQALAQAIGNPN

SEQ ID NO: 116778 - protein, 138 aa, Glycine max
  Coding DNA Sequence Number=SeqID_25093
  Subcellular localization annotation: CTP_CleavageSite=13; ConfidenceScore=5.16e-01
MDLAGGQPAANPTAEQPSNVPSGASTSGWRSFEEGVLLESSNESSEASVNQQPVIPELEPPLLDDNTQGAELAVRLRANWGGIAYNERILDSFVRSQLAIERHIEAALVADGYSPQVVFERRHMIRGFLFYPEGACAE

SEQ ID NO: 116779 - protein, 240 aa, Glycine max
  Coding DNA Sequence Number=SeqID_25094
MIIDQSLFFYLTKLPSQGAPFEGTIVDDWKFDYSSHDAHHMVCNDQAEMTGRLLAGSLTFNNRIMHYIIVRILLPRSSNLAQASEEDLILLWDFLTGRQIDWAHLVWYRMHKALQANAPLPYPQLVTVFLRHFQIPLDDEPFVQVKRSFAIGVGAVTSFGYQRFPSSTDERTPSPPPQRDDSALITEVLSELRGLRTYVGERFDSLDNRFAGMDIRLTQLEEDVGYIRQSFDLPPPPPPS

SEQ ID NO: 116780 - protein, 129 aa, Glycine max
  Coding DNA Sequence Number=SeqID_25095
  Subcellular localization annotation: CTP_CleavageSite=46; ConfidenceScore=5.75e-01
MATPPASPPPPSPPPPPSTVSSASLSTLKRTHKATRLRSLATRTPEAEKPVPRPHVDPTTNKTDGPHKKKLRTYLGIVARDKAEFEIPEAFDSRTKKKVLQTIGERMCGKRHRPFRSKTPPPRVVSWGL

SEQ ID NO: 116781 - protein, 171 aa, Glycine max
  Coding DNA Sequence Number=SeqID_25096
  Gene Ontology: Mol. function=RNA-directed RNA polymerase activity; Cellular component=mitochondrion; Biological process=RNA-dependent DNA replication
  Homolog annotation: Hit_ID=P92567; Match level="QueryCoverage=90%, HitCoverage=75%, E-value=6e-29, Identity=43%"; Hit description =Uncharacterized mitochondrial protein AtMg01410
MDGTDNQVSPLDLLVGAEHVSSYDLKSATDGWPINLQGDILAFLFGSEVEVPFRRAPHRKGGRGDPVEYPFARGRPVVSFETGQPLGYLSSWPLFTLSHHLVLQSCAEKVYPGRYFDRYAILGDDICIADRKVASVYHQVVTDLGVDLSIPKSLVSDSGGAEFSKRFSVII

SEQ ID NO: 116782 - protein, 51 aa, Glycine max
  Coding DNA Sequence Number=SeqID_25097
MAEINQGTDASGARVTTDQSLPLPGAKQAENVAAGQPKMAPRKLASEIQEG

SEQ ID NO: 116783 - protein, 267 aa, Glycine max
  Coding DNA Sequence Number=SeqID_25098
  Homolog annotation: Hit_ID=Q2XNY0; Match level="QueryCoverage=94%, HitCoverage=62%, E-value=3e-07, Identity=21%"; Hit description =Putative uncharacterized protein
MSLILPVYSDLVKAFYSHLEIQEGTLMPEVYGIKMVIDQSLFYDLTQLPSEGVPFEGTLIDDWKFDFFVHDAHRLVCTNQADMTGRLLAGSLAFESRILHYLIVRILLPRSSNLAQVSEEDLIVMWAFHKGLQIDWAHLVRYHMHKALRLNAPFPYPHLVTLFLQHFNIPLDSEPYVPIKRSFLIGASVIARHVGEEGHDGEDSSLLSKILDRFDGLQTFVGERFDTLELQVEMRFNEIESRITKVEEDVSYIHSSFDLPPPPPPSS

SEQ ID NO: 116784 - protein, 137 aa, Glycine max
  Coding DNA Sequence Number=SeqID_25099
  Homolog annotation: Hit_ID=A5BIS3; Match level="QueryCoverage=54%, HitCoverage=7%, E-value=2e-13, Identity=48%"; Hit description =Putative uncharacterized protein
MRIVETRNARFNENGEISGSIVPREVEIKEVRVCCYKINEEEQHNSEPIMEESQEVALRRSQRERRPAISNNYVNYQRIVRELVVSGSSRLKVTLMATLNVTRLDLLLSDLLRKMTLIIKRHFHRSHERILLGLSWH

SEQ ID NO: 116785 - protein, 138 aa, Glycine max
  Coding DNA Sequence Number=SeqID_25100
MAKIAKVVKVSVQELDRVKQNRNGVVGIPKKNLEEKAKFLVDQGEWASFIDVLALLVFEVVLFPNVDGLVDLAAIDAFLAYHHSKESPVVTVLVDAYDTFDQRCEKSSTRIVCCTTALCVWMVSHIFSPESRPICPLQ

SEQ ID NO: 116786 - protein, 88 aa, Glycine max
  Coding DNA Sequence Number=SeqID_25101
MGLAFSGIHKIQKKLNEVEDLASNRSLSDDEIKAKRELQQELWEASIAYESLLRQKSRGRQVETSTQIKNRRQVQALFRPRKLLKCGK

SEQ ID NO: 116787 - protein, 32 aa, Glycine max
  Coding DNA Sequence Number=SeqID_25102
MTASKSPKQASKLVGKNFGDEGQEIVTDPLEE

SEQ ID NO: 116788 - protein, 19 aa, Glycine max
  Coding DNA Sequence Number=SeqID_25103
ANSARQSIRWAPNAMVENT

SEQ ID NO: 116789 - protein, 76 aa, Glycine max
  Coding DNA Sequence Number=SeqID_25104
MAHLGLPKDSKRGQWLLVEATKLAWARWAATTSLFSPINRGRREEGKDVSVSDFVMVLHRSSPFFVRSSSFFGLQS

SEQ ID NO: 116790 - protein, 181 aa, Glycine max
  Coding DNA Sequence Number=SeqID_25105
  Subcellular localization annotation: CTP_CleavageSite=17; ConfidenceScore=5.36e-01
MAEPSKKRKGSSSTAAAAAHRRHGPSEASTAPIHPSLSSPRSSTLFYSDDQRLRVSNSGLVDFMSLKLPHYPELVKVFYCNLKIQDVIISSEVHGIPMIIDQSLFFSLTHLPSQGAPFEGTIVDDWKFDYSSHDARRMVCNDQAEMTGRLLAGSLTFDNRIMHYIIVRILLSSVFKFRISL

SEQ ID NO: 116791 - protein, 41 aa, Glycine max
  Coding DNA Sequence Number=SeqID_25106
MQVSSPGQAELAWASNPCTRMLKMGEGEGVVGGGPRPMVHS

SEQ ID NO: 116792 - protein, 418 aa, Glycine max
  Coding DNA Sequence Number=SeqID_25107
  Homolog annotation: Hit_ID=Q84VH5; Match level="QueryCoverage=100%, HitCoverage=63%, E-value=1e-162, Identity=70%"; Hit description =Envelope-like protein
MATSPKETSAPGSPSAPSNQERPEFNIQPIQMIPGQAPVPEKLVPKRQQGVKISENPSIATSPREVDPEMDKKIRSIVSSILKDASVPDAGEDVPTSSTPNVSVPDVDKDVPTSSAPNAEALPSPSEEESTEEEDQASEETPAPRAPEPAPGDLIDLEEVESDEEPIANRLAPGIAERLQSRKGKTPIKRSGRIKTMAQKKSTPITPTTSRRSKVAIPSKKRKEISSSDSDDDVELDVSTSKEGQEIWEKVPENVPDAPLDTSLSTPLAMLKSGNIELGRAAMDCKEIMDLIKAAGLLKTVSKLGECYEGLVREFIVNIPSDISNRKSDDYQRVFVRGKCIRFSPAVINKYLGRPTDGVIDIDVSEHQIAKEITAKRVQHWPKKGKLSAGKLSVKYAILHRIGAANWVPTNHTSTIAT

SEQ ID NO: 116793 - protein, 93 aa, Glycine max
  Coding DNA Sequence Number=SeqID_25108
MRDDKRSSYVIGIGVNSGVGLGGKFIIALELAPKWALPAGRVVAGAGAGAWGAFLWMGAGALGCAEVTTWVSPSFLFAPVAPILLALVLVDET

SEQ ID NO: 116794 - protein, 173 aa, Glycine max
  Coding DNA Sequence Number=SeqID_25109
MAVGRRHGADGGGQPFALETGADEDQAVHPLWDLILLAQTLAQGLVGGREFLIVDGVIDHRDFVGGHAKVGDDFLLDHLGVADDGFQLRRGVHGAFGAHHIAVIAIGEQPFAAPFRQQTRTLQQPAAVYAVAGAVDVAAGNALVALHQIETLFLPQRPGCHGEASLAADAAEF

SEQ ID NO: 116795 - protein, 163 aa, Glycine max
  Coding DNA Sequence Number=SeqID_25110
  Gene Ontology: Mol. function=DNA-directed RNA polymerase activity; Cellular component=chloroplast; Biological process=transcription, DNA-dependent
  Homolog annotation: Hit_ID=Q2MIB0; Match level="QueryCoverage=69%, HitCoverage=8%, E-value=2e-51, Identity=89%"; Hit description=DNA -directed RNA polymerase subunit beta''
  Pfam annotation: Domain name=RNA_pol_Rpb1_4; Domain location=1-56; Score=24.9; E_value=3.8e-05; Accession=PF05000.8; Description=RNA polymerase Rpb1, domain 4
  Subcellular localization annotation: CTP_CleavageSite=23; ConfidenceScore=5.02e-01
MNPNFRMTDPFNPVHIMSFSGARGNASQVHQLVGMRGLMSDPQGQMIDLPIQSNLREGLSLTEYIISCYGARKGVVDTAVRTSDAGYLTRRLVEVVQHIVTIYTEVHDALPLEIKILELDLSIDLKPFKPNQYLSELPLPVGIHLGSVDCVMAKVLLMVTWWN

SEQ ID NO: 116796 - protein, 121 aa, Glycine max
  Coding DNA Sequence Number=SeqID_25111
MGDQEEVQEQMKADMSALKEKMACMMDAMLGLRQLMENNAATAAAVSSAADADPTLPATAHHPIPNVVGRERSTLGHISNPHPGYNRVAYPYGLPPNYTPPAIRDDAGHVPPPILEGEPPR

SEQ ID NO: 116797 - protein, 159 aa, Glycine max
  Coding DNA Sequence Number=SeqID_25112
MSNRKSTESALKNLEVQVGQLAKQIDDKSSNLAPTSYTSDLTMDRARLIFGLVSRTDMNIGALMSSQMTSIAQSNSSRLGFPALIIALCRARGVVSDSLTYGCLSPVINLAYIRKNCWNPDDLTISIRGARRARPAELPSTSTTPTPASTSVAPSVPAQ

SEQ ID NO: 116798 - protein, 31 aa, Glycine max
  Coding DNA Sequence Number=SeqID_25113
MEQAGFVADLGVAFVDNWVFLAYRVVGNEKG

SEQ ID NO: 116799 - protein, 76 aa, Glycine max
  Coding DNA Sequence Number=SeqID_25114
MAARLGELMLSPEETGSPRRAGSFSPKQIGDPGKPEASLGELGSTKLPEMTILPLPLGIFCILDQNVERSHTLVQN

SEQ ID NO: 116800 - protein, 66 aa, Glycine max
  Coding DNA Sequence Number=SeqID_25115
MVTRTFHQPGANEPVDAKRLTSSSAPFAIQGQRVRWQAEIPFGHPHLSSTEGNEFDDVRMMLVIRF

SEQ ID NO: 116801 - protein, 177 aa, Glycine max
  Coding DNA Sequence Number=SeqID_25116
MAPTRHPLDPDKSNRALGFPALITGLYQSFGVPVTPTKVIRPPITRAFIEKYCTQRQAQGDAPQAAGAPPPPHQAGPAGSFDMEQYLRHLVRRQAANHRAHVQTHDCLYQMSLSMQSQGFASFSCPTLDQFREEVAWPGDWLEAQAGEAPPEAPGDGEEAHEDEEMADLLDFLGGSG

SEQ ID NO: 116802 - protein, 50 aa, Glycine max
  Coding DNA Sequence Number=SeqID_25117
MSLPSAVHVSSIIKCEASEEKRRSKGESRHHGKGRMDEISVLSLLSSYLR

SEQ ID NO: 116803 - protein, 152 aa, Glycine max
  Coding DNA Sequence Number=SeqID_25118
MSSPSKDYMSSPSEDFMSSPSEDFTSSPPEDYMPSPSEDYTSSPSEGHTPSPSEDYMSSSSEDYIGLHTLTFRGLHVLAFRGLHVLTFRGLHVLAIRGLHALSFIGLHALTFRGLHVLIFSETPQQPGDGRQRATDALPPPLEFTSAHPQKG

SEQ ID NO: 116804 - protein, 103 aa, Glycine max
  Coding DNA Sequence Number=SeqID_25119
MHKALWANAPLPYPHLVTLFLYHFIVPLDDESYVKVKRSFSIGVGVVTSFGYRKDVDGQWVCKQDLPPPIPDELTPSPPPERDASSSLLTKFLTELRDLQAFV

SEQ ID NO: 116805 - protein, 20 aa, Glycine max
  Coding DNA Sequence Number=SeqID_25120
MVPKTCSLPASAPDRASSIK

SEQ ID NO: 116806 - protein, 50 aa, Glycine max
  Coding DNA Sequence Number=SeqID_25121
VAIIKKGEIVEASFMLMNQVDSSSFDDNKDDDKKPKRMISRLIQQVQDQD

SEQ ID NO: 116807 - protein, 119 aa, Glycine max
  Coding DNA Sequence Number=SeqID_25122
MEAKKFKLVPLTPSQVARDQAQIKLKWSEEKNRKRKEEQPLMVKEECKEVSVSSKRLAKKKSHFAIKTNIKETPLLRQLPHLLLCKRKLVSTATPLGHKVIPQVKELLDEGLVLSQPSL

SEQ ID NO: 116808 - protein, 15 aa, Glycine max
  Coding DNA Sequence Number=SeqID_25123
MQYLGSDPRSSPNEQ

SEQ ID NO: 116809 - protein, 169 aa, Glycine max
  Coding DNA Sequence Number=SeqID_25124
  Gene Ontology: Mol. function=helicase activity; Biological process =viral genome replication
  Homolog annotation: Hit_ID=Q9LW42; Match level="QueryCoverage=95%, HitCoverage=9%, E-value=1e-38, Identity=50%"; Hit description =Helicase-like protein
MPTAKSFRMARDRLANSQVDNVRLKLVAARETDGHVYNLPNVAEVVALIVGDFDGNSRRDIIVETQNGELQRIDELHSRYLGLQYPLLFPYGEDGYRPDILHRSTSATKKRKRNRLTMREWFAYRLQSRPNEAQTLLHSKKLFLQFIVEAYTMVESERLSYIRHKPKET

SEQ ID NO: 116810 - protein, 62 aa, Glycine max
  Coding DNA Sequence Number=SeqID_25125
  Subcellular localization annotation: CTP_CleavageSite=28; ConfidenceScore=5.43e-01
MAMDLNFSSTTRALSSFAFRASADDPITASPKLSVLSNTTHPMPLRTPWSTPSIVVTENLVR

SEQ ID NO: 116811 - protein, 210 aa, Glycine max
  Coding DNA Sequence Number=SeqID_25126
MIFDHGLQVLNKSDDAANWANFWALLTRASTVAQHLQGPSNVDTLKDQLLKAELGTTGQYQVGEGYQDLGESKKEKTTTEKGRIQQKAFDDVYDTHEVSFNHCLRQVLLLCQVSDPSVFDINKDIYHGELMSIDDIANDGTPMLERSMLKVPRSMIRIMETLGIKRTWVLRFLCDDKKIKDQSKNNSSESRTSQEFKIRIKKNSRLKKKV

SEQ ID NO: 116812 - protein, 87 aa, Glycine max
  Coding DNA Sequence Number=SeqID_25127
  Subcellular localization annotation: CTP_CleavageSite=50; ConfidenceScore=5.41e-01
MASSTCFQQISSQITITKHKPKVYPNLKFRSPTRRDALHDSENAFLSRFGAEMATKGWSFVGASMVEEEEENGNVRERGKSFLKFWG

SEQ ID NO: 116813 - protein, 69 aa, Glycine max
  Coding DNA Sequence Number=SeqID_25128
MLDLGASVSVMPLSIFNSLSLGPLQSTDVVIHLANRSVAYPAGNIHFYLICILVIPYASVEAKTLSFIF

SEQ ID NO: 116814 - protein, 96 aa, Glycine max
  Coding DNA Sequence Number=SeqID_25129
MELIENMAASDHAILCDRVHVVLFVAELTNPGRCISTEEHNHEVKYMGNQQRQGYNQGGYLGFQHGPNYNQQGQWRSHPGNQYNKDQGGPSNRPPQ

SEQ ID NO: 116815 - protein, 82 aa, Glycine max
  Coding DNA Sequence Number=SeqID_25130
MSRQNEFVGYSFTGKNPKKFDILTGCTMDELKDLIKQVAPRGIPLMVLIESNYWKKIRPIEILVVFNKPVPKMEDELSLSQN

SEQ ID NO: 116816 - protein, 129 aa, Glycine max
  Coding DNA Sequence Number=SeqID_25131
MCHRQCSNLFVDELRGFGGGGGASIAHCRPSAGCYGVLPCACLEAQYFLMKARGRSALWSLGRMLLSSNVIHICVRVVMLVRMICTRLFAAARVKSCPDMHSSYAIASLWLCSHSWPSFEIRGWPRKRN

SEQ ID NO: 116817 - protein, 111 aa, Glycine max
  Coding DNA Sequence Number=SeqID_25132
MARSASYLERGAEIVPMGRAWQLPLLKGLSHVKLTWLATYKYSQIKMRRDGRPNRATTWDGNGSAHMHHLMKALQSLPRSGLTPPPREQDAGRDGAGSQPILSWGLPCPNI

SEQ ID NO: 116818 - protein, 158 aa, Glycine max
  Coding DNA Sequence Number=SeqID_25133
MGDVEEVQKQMKVDMEAMKEQMTTMMEAMMSMKKIMEANAVAVAAISAVAKAKIWEVRAANIMCKFKTSMPSHHMACLPTIHHPMWHTLLVRMSITLLPYSLKADNLKLIMHMSLTPFPVFPTFSSNKRWWRLRAFFSHGRRTREPRVVLPPKGRLRQ

SEQ ID NO: 116819 - protein, 387 aa, Glycine max
  Coding DNA Sequence Number=SeqID_25134
  Gene Ontology: Mol. function=acetolactate synthase activity; Cellular component=intracellular; Biological process=branched chain family amino acid biosynthetic process
  Homolog annotation: Hit_ID=Q1GXB7; Match level="QueryCoverage=99%, HitCoverage=52%, E-value=1e-177, Identity=75%"; Hit description =(P)ppGpp synthetase I (GTP pyrophosphokinase), SpoT/RelA
  Pfam annotation: Domain name=RelA_SpoT; Domain location=1-86; Score =99.1; E_value=1.4e-26; Accession=PF04607.8; Description=Region found in RelA  SpoT proteins
  Pfam annotation: Domain name=TGS; Domain location=129-188; Score =92.3; E_value=1.6e-24; Accession=PF02824.12; Description=TGS domain
  Pfam module annotation: Pfam domain module=RelA_SpoT::TGS; Domain location=1-86::129-188
MYGFRVIVKDTAACYLALGALHALYKPIPGRFKDYIAIPKANGYQSLHTTLFGPFGTPIEVQIRSQEMHNIADAGVAAHWLYKTTDAHLTKLQQQTHQWLQRLVEIQTESDDSHEFLENFKVDLFPDEVYVFTPKGNIMALPRGSTAVDFAYAVHSDVGNSCVAVKINNELAPLRTEMRNGDHVEIITAPLAKPNPAWLNYVVTGKARSHIRHYLKTVKVEESAQLGERMLNVALRAMHIEPAALTDKQWQKVMNDYGVKTRQAILTDIGLGKRNSLMVAHQLVAHPAEAEEKSAKVLDTITIRGSEGMAVQFAQCCRPIPGDPILGFINKDKGLVIHTHDCPAIRKFKLDPEKWLDVEWDADPKKLFSVNLRVTVVDQRGMLGGIL

SEQ ID NO: 116820 - protein, 175 aa, Glycine max
  Coding DNA Sequence Number=SeqID_25135
  Homolog annotation: Hit_ID=A5BSR3; Match level="QueryCoverage=38%, HitCoverage=21%, E-value=2e-08, Identity=42%"; Hit description =Putative uncharacterized protein
MAKFDIAEATKVKTKNEGQQTQDVVTKYGLDPEAWKQFEETRLTPNWEGIRKRAQSIQKHNDCPHVLSRGGYDLLEKKLLDQKQKRIQEEALLSENPASPYEPPSPIKRHVKWKVARTRAVGNMTSDSAQEIADKIDSLEEQVTQGSFVSHGRQDILNTAIGRPDHGGRVRAAGS

SEQ ID NO: 116821 - protein, 336 aa, Glycine max
  Coding DNA Sequence Number=SeqID_25136
  Gene Ontology: Mol. function=transcription factor activity; Cellular component=membrane; Biological process=regulation of transcription, DNA-dependent
  Homolog annotation: Hit_ID=A8IDB2; Match level="QueryCoverage=85%, HitCoverage=89%, E-value=6e-58, Identity=40%"; Hit description =Transcriptional regulator
  Pfam annotation: Domain name=HTH_1; Domain location=33-92; Score =62.8; E_value=1.2e-15; Accession=PF00126.18; Description=Bacterial regulatory helix-turn-helix protein, lysR family
  Pfam annotation: Domain name=LysR_substrate; Domain location=116-326; Score=142.7; E_value=1.1e-39; Accession=PF03466.11; Description=LysR substrate binding domain
  Pfam module annotation: Pfam domain module=HTH_1::LysR_substrate; Domain location=33-92::116-326
MSDVLGIAIVLFPSVAYQAKAQGAAVAKQGLSEKRLRYLYEAVLAGSLRSAAEKLEVEPSVLSRQIQLLEADVGVQLLERRGRGVSPTEAALIVVEHCKERFSAEEALRQKLDDLNGLHRGEVRIAAGEGFMAHLLVPILENFCARYPGVNISLDLANAADAVRLVQQDQVHIGLALSPPPNEQLHTIAARRQPLCAVVWPGHPLTHETLPLTMAQALDYPHGLMAQGYGLRQLVQLAAFSDSIVLRPSFTSNSIALLKHYVMARAGITFLSHIAVATEKEAGALIALPVHNAVLEQAQARLFVRRNRPMPFAVRHVIDSIRQLGLFSGFAPESGN

SEQ ID NO: 116822 - protein, 22 aa, Glycine max
  Coding DNA Sequence Number=SeqID_25137
TTFLNEKIYTVPEFQQKLLTTT

SEQ ID NO: 116823 - protein, 142 aa, Glycine max
  Coding DNA Sequence Number=SeqID_25138
MDMNLGYLISHQISLIAQHDTSKLGFPALITTLCKAKGVQSDSRSVENISHAINLAYIKKNYWNLDDPTVTFRGPRKAMGKRSEVPTTSAPPETPAPSSSTAPVPSSAPVIPPTPTQIPLLAPISVGPSDFIFTPYMLHSML

SEQ ID NO: 116824 - protein, 61 aa, Glycine max
  Coding DNA Sequence Number=SeqID_25139
MDGFIEPMKERKLETLEEPSSSPLKQRTAESPQGRANRMLKPDFPKKGMEKKKWKDRKRKR

SEQ ID NO: 116825 - protein, 182 aa, Glycine max
  Coding DNA Sequence Number=SeqID_25140
  Gene Ontology: Mol. function=DNA-directed DNA polymerase activity; Biological process=nucleobase, nucleoside, nucleotide and nucleic acid metabolic process
  Homolog annotation: Hit_ID=A8G9P7; Match level="QueryCoverage=100%, HitCoverage=23%, E-value=9e-88, Identity=85%"; Hit description=DNA -directed DNA polymerase
MPTIRGAEQGSKKRYAGLIARGGGEEEMVYKGLETVRTDWTPLAQQFQQQLYQRIFKRQPYQDYVRDYVGKTLNGDFDDQLVYRKRLRRKLDDYQRNVPPHARAARIADDYNRSQGRPLQYQNGGWISYVMTVAGPEPLETRHSPIDYQHYLERQLQPVADAILPFLHDDFTTLVTGQMGLF

SEQ ID NO: 116826 - protein, 98 aa, Glycine max
  Coding DNA Sequence Number=SeqID_25141
MGDSLRAGSDYNTRLYEGRGWWVRNVFNMILFPYLFDEKCKTKKEPIFSTGKCESVLSTFSIPLYQNDPTKRKASLLFSCSISAPLVVTYVEERFGTL

SEQ ID NO: 116827 - protein, 73 aa, Glycine max
  Coding DNA Sequence Number=SeqID_25142
MPEVERGHCRKIRKVLQHSRGQKRGLLRNPPTWAFRGVPTEGGAFWWKQQLARASLAATTSLFSPINRGKRAE

SEQ ID NO: 116828 - protein, 77 aa, Glycine max
  Coding DNA Sequence Number=SeqID_25143
MYEYPRRGDVLTRKHSFQNSCGYSCFVGEREMAPKKLSTKRSRRDATGEGSSAAPEFDSHRFQSVEHQQCFEGDQGW

SEQ ID NO: 116829 - protein, 232 aa, Glycine max
  Coding DNA Sequence Number=SeqID_25144
  Homolog annotation: Hit_ID=Q6WAY6; Match level="QueryCoverage=90%, HitCoverage=34%, E-value=4e-17, Identity=30%"; Hit description =Putative uncharacterized protein
MDGLVDLAAIDAFLAYHHSKESPVVAVLANLFDTFDQRCEKSSTRIICCLPALCVWLVSHLFQQDIRHPCPLRSHRSCVKKRRVDWDQHLAGIGGRTINWFPRWKKGKEGVIFSCGDYPNIPLIGTRGCINYNLALAIRQLGYPMRGAPAEESLSPFLVRDFGTQGFKVIQRVHKAWESSLRKDKELRGIYNGIIGGYHEWLKVRTRGLDWLSKLKIINEENFEAPEEDEEV

SEQ ID NO: 116830 - protein, 100 aa, Glycine max
  Coding DNA Sequence Number=SeqID_25145
  Subcellular localization annotation: CTP_CleavageSite=25; ConfidenceScore=5.09e-01
GEFGRPSKAMRSADSVAQFRLTATSLATSGGTRTHFQQPVEWILSTPTPYRQVEPVQVIEDDEDPLPDVDSPEDVMSASEADSTEESGPRGTANSDDSSS

SEQ ID NO: 116831 - protein, 47 aa, Glycine max
  Coding DNA Sequence Number=SeqID_25146
MTLRRKDFQVQAIGQFAQATCAPEFGLPRSFNQRLLVLHVGGVAVKQ

SEQ ID NO: 116832 - protein, 161 aa, Glycine max
  Coding DNA Sequence Number=SeqID_25147
YGVYQCTLWTDKSNRALGFPALITGLCQSFGVPVAPSKRQAQGDAPHAVDAPPPHQAGPARSFDTEQYLRHLVRQQAANHRAHVQTHDCLYQMSLSLQSQGFTSFPCPTPDQFRAEVAWPRDWPEARAGEAPAEAPDEADEAREDEEMADLLDFLGGSGTT

SEQ ID NO: 116833 - protein, 184 aa, Glycine max
  Coding DNA Sequence Number=SeqID_25148
  Homolog annotation: Hit_ID=Q0KIL1; Match level="QueryCoverage=52%, HitCoverage=10%, E-value=2e-07, Identity=34%"; Hit description =Gag/pol polyprotein, 3'-partial, putative
  Pfam annotation: Domain name=G-patch; Domain location=39-82; Score =20.3; E_value=0.00067; Accession=PF01585.14; Description=G-patch domain
MPYVEAAEESLETAFQSFEVVSIASVDSFSGQPCLSDMTMMVGRVMLGNGYEPEMGLGKNNGGRTSLISTRGNRGKFGLGYKPTQADIRKSVAGRKSRSKGSQLGRKVEGGLPCHISRSFISAGLGHEGQVVAICEDDSLSGSDLVRPCPPGFRLGNWRVEERPDIYATSIMLPFVAFKLYGWA

SEQ ID NO: 116834 - protein, 216 aa, Glycine max
  Coding DNA Sequence Number=SeqID_25149
  Gene Ontology: Mol. function=iron ion binding; Cellular component =cytoplasm; Biological process=iron ion transport
  Homolog annotation: Hit_ID=P13039; Match level="QueryCoverage=37%, HitCoverage=21%, E-value=3e-41, Identity=96%"; Hit description =Enterochelin esterase
QSGSYWWPHRGGQQEGVLLEKLKAGEVSAEGLRIVLEAGIREPMIMRANQALYAQLHPIKESIFWRQVDGGHDALCWRGSVLHIAQCAGAIQSVAATMRLTGRLGHCVSAAVTGVLPAVAGSPLAYSDTDEFYPVAGGTMSQHLPLVAAQPGIWMAEKLSELPSAWSVAHYVELTGEVDSPLLARAVVAGLAQADTLRMRFTEDNGEVWQWVDDAL

SEQ ID NO: 116835 - protein, 105 aa, Glycine max
  Coding DNA Sequence Number=SeqID_25150
MYSLDWKKLLKKCNYRGITKTRIYSRRIFRLPASKSDNGDKLPSFFDSFNTWELIPRITSNERPAHLATFIEICNTVKIAGEAKRWLHSFKGNSLKTWEEVVEKF

SEQ ID NO: 116836 - protein, 51 aa, Glycine max
  Coding DNA Sequence Number=SeqID_25151
  Subcellular localization annotation: CTP_CleavageSite=29; ConfidenceScore=5.02e-01
MTLYRLVFAFSNPLKDTRLPCSGVFRLPKARKGQRSVGRDPSLYLRPFLST

SEQ ID NO: 116837 - protein, 39 aa, Glycine max
  Coding DNA Sequence Number=SeqID_25152
MDKSLKVGEDGGGRGREGAQNFVPQMRAKFWSQNFTNDD

SEQ ID NO: 116838 - protein, 69 aa, Glycine max
  Coding DNA Sequence Number=SeqID_25153
  Subcellular localization annotation: CTP_CleavageSite=33; ConfidenceScore=5.11e-01
MEDCKNTSGEDVSFTSRISQSLTNSSQALKPAPASSSGGLVHALAPSARMDRLTHVNDFWHSAPFLLSG

SEQ ID NO: 116839 - protein, 257 aa, Glycine max
  Coding DNA Sequence Number=SeqID_25154
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=100%, HitCoverage=100%, E-value=1e-140, Identity=89%"; Hit description =Beta-lactamase TEM precursor
  Pfam annotation: Domain name=Beta-lactamase; Domain location=31-251; Score=129.2; E_value=1.2e-35; Accession=PF00144.15; Description=Beta- lactamase
  Pfam annotation: Domain name=Peptidase_S11; Domain location=29-234; Score=-127.3; E_value=0.07; Accession=PF00768.11; Description=D -alanyl-D-alanine carboxypeptidase
  Pfam module annotation: Pfam domain module=Beta-lactamase::Peptidase _S11; Domain location=31-251::29-234
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPADKVAGPLLRSALPAGWFIADKSGAGERGSRGIIAALGPDGKPSRIVVIYTTGSQATMDERNRQIAEIGASLIKHW

SEQ ID NO: 116840 - protein, 104 aa, Glycine max
  Coding DNA Sequence Number=SeqID_25155
MKRRVLEKFFLASRTTSIRKEICGIRSIIDAASGGALMDKTHVATRQLISNMAANYRQFGTKVATTSKAVVNEFFVSKVADNQRMENKLTKLTSFVRQLAIGQQ

SEQ ID NO: 116841 - protein, 59 aa, Glycine max
  Coding DNA Sequence Number=SeqID_25156
MGEATWLAGRAELAWASWAATTSPICYNRGGSEKKGNFAKVLTVLRRSSFVPHRSSIFN

SEQ ID NO: 116842 - protein, 55 aa, Glycine max
  Coding DNA Sequence Number=SeqID_25157
VTGCAICGGTYESGLFIPFEEKTQEVSYMGNQQRQGYNQDGFLGFQQGPYNQQGQ

SEQ ID NO: 116843 - protein, 92 aa, Glycine max
  Coding DNA Sequence Number=SeqID_25158
MSLATLFGKLQEHEMELLRLHQHEENVKKKKGIALKASSSIQEESDQENDPDDDDDLSLFVKRFNKFLKKKMKNLKRKILVKETEESIHHMG

SEQ ID NO: 116844 - protein, 127 aa, Glycine max
  Coding DNA Sequence Number=SeqID_25159
MTVPFFHITLFSLRCTKKALEGRQQKKSYSGRSRNPPHMGHLQRGVALAYSKEGRNKSETLVEFVLCGTESCLSWRNNCSVLLRISMPLVIPSPKVSFIGRFHCRRALLESYRLGMHFLQNLKGAPQ

SEQ ID NO: 116845 - protein, 392 aa, Glycine max
  Coding DNA Sequence Number=SeqID_25160
  Homolog annotation: Hit_ID=Q6WAY4; Match level="QueryCoverage=83%, HitCoverage=62%, E-value=1e-31, Identity=29%"; Hit description =Putative uncharacterized protein
KVKSLDVTSLKELGRLMGPLQRRAFRKVYGKILDLAAAEVFTEAVVSLAQFYDQPLRCFTFGDFQMVPTIEEFEEILGCPLGGRKPYLFSGFLPSLSKITAVVGDSAKELDCTKKTRNGVVGLPRKYLEGKARDMASQEKWGPFADILALLIFGVVLFLNVDIVYTFDRRCEKNSARMSVFTCSVCVVDFTLFHQDMRHPCPLQSYCSCAEKGRVDWDQHLARIGGSTINWFPHWKEGKEGVLFSCGDYPNIPLIGTRGCINYNPALAIRHLGYPMRGAPTEESLSPFLVRNLGAQSLKAIQRVHKAWRSPLRKDKELRGIRNGVIGGYHGWLRIHTRGLDWLSNLKVIDEEDFEAPEEDKEVRALKLELGKARLAKEKFKSAATHIRKECT

SEQ ID NO: 116846 - protein, 243 aa, Glycine max
  Coding DNA Sequence Number=SeqID_25161
  Subcellular localization annotation: CTP_CleavageSite=41; ConfidenceScore=5.23e-01
MAEPSKKRKGSSSTAAAAAHRRHGPSEASTAPIHPSLSSPRSSTLFSFDDQRLRVFYCNLKIQDDIIFSEVHGIPMIIDQSLFFSLTHLPSQGAPFEGTIVDDWKFDYSSHDARRMVCNDQAEMTGRLLTGSLTFDNRIMHYIIVRILLPRSSNLAQASEEDLILMWAFLTGRQIDWAHLVRYRMHKALRTNAPLPYPQLITLFLRHFQIPLDDEPFVQVKRSFAIGAGAVTSFGYCKDRNGQ

SEQ ID NO: 116847 - protein, 91 aa, Glycine max
  Coding DNA Sequence Number=SeqID_25162
AGSSRATFWGRDEVKAAENQSRVMTDRSSSLPGVGQAEDVAARQPKMASRKLASKRSRKDKAAEGTSSTPEYDSHRFRSAVHQQRFEAIKG

SEQ ID NO: 116848 - protein, 46 aa, Glycine max
  Coding DNA Sequence Number=SeqID_25163
MSKIEEVHEQMKADMVAMKEQMTTMMEAMISTKRMMEVNASTVVVA

SEQ ID NO: 116849 - protein, 154 aa, Glycine max
  Coding DNA Sequence Number=SeqID_25164
MPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSALSPESNPNSPSPVTTMVGHYPTIES

SEQ ID NO: 116850 - protein, 83 aa, Glycine max
  Coding DNA Sequence Number=SeqID_25165
MHVAKLVSDAIYYLQGSRPQDTQWTRRSPIGPWDSSSDYGRLYWARDQQITIPCLAQDVKEALLGGNLVPFKFLLVILFTYVS

SEQ ID NO: 116851 - protein, 84 aa, Glycine max
  Coding DNA Sequence Number=SeqID_25166
MKNSTQFRNFNKHYSQQRNKYRRNNSNDMKKWKQKEIRIKESPNHVAPHATGLLGHGNKKWGGRQKQGFCSYVSSICDEELRPT

SEQ ID NO: 116852 - protein, 168 aa, Glycine max
  Coding DNA Sequence Number=SeqID_25167
MEGKKKKQLEEADKSESTDTIIDPPPPIRRHVKWKMSHTKKTGQMIKPINVFVIGFLGGASLIGFLCLPWTRCHNQTILWTDSKDLLHFFVHDSQILGATNAKDQSQFPSQMQSQGLALPPEPEVDPSVASVSTKESCLDLSRNNPDAVKVGVEKLEMLMLPFQYPMK

SEQ ID NO: 116853 - protein, 131 aa, Glycine max
  Coding DNA Sequence Number=SeqID_25168
EWHQPDRVMRQFGMQQPIPEPVMQPNNIHDLTLKGKEGKNWMRLMQPALNEWNSEIAETLHFMVSLVGRRVCTFDDLLPCVATYPSAGGRRVTRGMRVPRKEYARSRHQRLFEENVGKTGKDAIYELLSEK

SEQ ID NO: 116854 - protein, 95 aa, Glycine max
  Coding DNA Sequence Number=SeqID_25169
MSIKAEPYNLDLKHVKNHVLDVGFQKPRLVRNQTYQLCKRASEVASFEDMQEHEDADHDHAEELVEHRGPEEQEDHADDGVERHNLDIRAGRQRQ

SEQ ID NO: 116855 - protein, 82 aa, Glycine max
  Coding DNA Sequence Number=SeqID_25170
MKAIEVEEIPNKWRSVAMECHDTDMSASEHSFGGVAETHPHFSWTTIRGENEPSSLSRAFGSAYVRLDSAQLVYYKGQAQAF

SEQ ID NO: 116856 - protein, 176 aa, Glycine max
  Coding DNA Sequence Number=SeqID_25171
MWQPLGRFIFEALQKRRCDSHGGCKEDSCLLHSGEMHDMETCLEVKELLQRMIDQGRLEVGIEEKKEQHICMQSTEGSGVAKPKPLVIYFTKNAASQKPGHPLIAKPVPFPYQNSHAVPWRYTPPGKKEEEVTDVSSLSAKVTNITGLSGVTRSGRVFAPPDLPVQSADVKGKGKV

SEQ ID NO: 116857 - protein, 73 aa, Glycine max
  Coding DNA Sequence Number=SeqID_25172
MFNKLTKSEDLHMQGTQRFLQRLELYASVVMGLEAPALIFETEPFLDVMVKTELLSESTAFHVQSLDSVHMNF

SEQ ID NO: 116858 - protein, 107 aa, Glycine max
  Coding DNA Sequence Number=SeqID_25173
MIESFQQQQQMLVLELYVEKDVVGGSMFRAANSVTSCRPNVSHHDSELPRNISNLHDDDDDYLASNSYVEESFDEDDSVDGISDTDNEVTDIVEPVSIVHPTEGVVS

SEQ ID NO: 116859 - protein, 188 aa, Glycine max
  Coding DNA Sequence Number=SeqID_25174
MDRARLVYGLVTNMDMNIGALISGQISSIAQSNSSRLGFLALITSLCRARGVTSDSLTYESLSLAINLAYIKKNYWNVDDLIVNFRGARKPRVRPADVPSSSTLPAPSTSATPTPAPPDSSTQDSQHFEFMLQSLHKGQILLMQSLQVVAPLGSILTMEQFLERVSWPGTLPSLERKGGGLSAQLPQQ

SEQ ID NO: 116860 - protein, 56 aa, Glycine max
  Coding DNA Sequence Number=SeqID_25175
  Subcellular localization annotation: CTP_CleavageSite=36; ConfidenceScore=5.09e-01
MGPKSTLRLMRTLGPSLASLAQSSWSLLSNALGGVRSENPFSGHLPMREHGSSPTQ

SEQ ID NO: 116861 - protein, 90 aa, Glycine max
  Coding DNA Sequence Number=SeqID_25176
VVPTRHPVDPKEPNMALGFPVLVTGLCQSYRAPVPPANSCHRDIGKDRARKTPSGPGEGQQGLGVASSNYRPLLVLRSACRPQQGHQAPY

SEQ ID NO: 116862 - protein, 108 aa, Glycine max
  Coding DNA Sequence Number=SeqID_25177
MDFNSDDFMDKLREALRNVDMRDERWRPRRDEPRPNVDEFKITELPEFNGSADPEDLDDEKRCKYAILKLSKSASLWYEGLKARRTRDGKEKIHSWESLKKKLRQITD

SEQ ID NO: 116863 - protein, 110 aa, Glycine max
  Coding DNA Sequence Number=SeqID_25178
MEAQLIHDRVRNPHARTLQQPVEWILPTPTPYRLMEPVQVIEVSSSEEDPEEDPEELPPEPAVDALDLPEDDEDPLLDVDFPEDIMSASEADSIEDSGLGGTANSEDSSS

SEQ ID NO: 116864 - protein, 37 aa, Glycine max
  Coding DNA Sequence Number=SeqID_25179
RKKKKRRRSSWTNYGKGEDGRNQCLIFAFLLSPIKGK

SEQ ID NO: 116865 - protein, 97 aa, Glycine max
  Coding DNA Sequence Number=SeqID_25180
MERYLQHLVRQQAANHRGQVQIHECLYQLSLSQQGQGFVPFACPTPEQFRAEVAWPEDWPEAHAGEAPAGAPGDVEEARMDEEMTDLLGFLGGSGAT

SEQ ID NO: 116866 - protein, 94 aa, Glycine max
  Coding DNA Sequence Number=SeqID_25181
MASLGLQTTHACCLFHHPPPLPSLTSHLVDDEEPRISADCSSVTSNKSEIYNEEAGNATQKHKPKRVESVNVDAEAFGDHWKVQIGLCILKLKH

SEQ ID NO: 116867 - protein, 263 aa, Glycine max
  Coding DNA Sequence Number=SeqID_25182
  Homolog annotation: Hit_ID=UPI0000DA32E9; Match level="QueryCoverage =83%, HitCoverage=76%, E-value=2e-12, Identity=36%"; Hit description =PREDICTED: similar to mucin 17
MSSPSEGYTPSPIRGLHVPHLHRATRPHLWRTTRPHQQRAARLHLQRTTQDYTSLLSKGHALTFRGLHVLANRGLHALTLRGLHVLANRGLYALTFRGLHVLTNRGLHALTLRGLHVLTNRGLHTLTLRGLHVLANRGLYALTFRGLHVLANRGLHALTLRGLQVLANRGLYALTLRGLHVLANRGLYALTFRGLHVLANRGLHALTLRGLHVLANRGLYALTLKGLHALTFRGLHVLAFKEPCTFNFRGLHVLAIKGTCPHL

SEQ ID NO: 116868 - protein, 60 aa, Glycine max
  Coding DNA Sequence Number=SeqID_25183
MKQKKKQERNSRGRSTNLFFPDGTTPMQPAPIMVVFWGILLSLEMVPRWYNPNDKSKRTV

SEQ ID NO: 116869 - protein, 143 aa, Glycine max
  Coding DNA Sequence Number=SeqID_25184
LHVLAIIGLHSLAFERRHVLNFRGLHALAFRGLRVLTFRASSFLLTVPGPPPDIGGGPTVRAQPEREAITQLLCIPGQDFTRAAAKRRGSHPQDTQWTRKSPTGPWGFQPWLRASISPTGCPDCARKTPSGPEEANSVLSCQL

SEQ ID NO: 116870 - protein, 123 aa, Glycine max
  Coding DNA Sequence Number=SeqID_25185
MNCVFVHLSSTFEFGAMRSDCLVQVSILTLFRNPMNCGFFHVSSIIEFGAMRIDCLAQFSILTLFRSPINCVFVHVTSSFEFGAMRSDCLVEFSILNLFGAPRIAFLFMCPPPSSLELFVLIA

SEQ ID NO: 116871 - protein, 199 aa, Glycine max
  Coding DNA Sequence Number=SeqID_25186
  Pfam annotation: Domain name=Transposase_23; Domain location=46-104; Score=-16.2; E_value=0.07; Accession=PF03017.5; Description =TNP1ENSPM transposase
  Subcellular localization annotation: CTP_CleavageSite=29; ConfidenceScore=5.14e-01
MASFSQLQSQMQSQAPPEPLVGPGPSGPRVSTKGSCVDPSGNDPETGDSDRCGLYIEVDPARLVVVGRVYEGSTLVSVDEVKDADAPVPVPTADVSLVGQALHTFLAWPTHLIKSLSHQVAVSPPKPPPKPDLEVDDPLYLMTLTIPELFLRPYQVRWDATVFGVVNSDFPLYIKHEDLSKIAHGCQCLSISVLQLWIL

SEQ ID NO: 116872 - protein, 62 aa, Glycine max
  Coding DNA Sequence Number=SeqID_25187
MRENETYLDAMDLYCGNANGVAASITGGTNGGNGERVGAQSKIPYLIAIAHININQFCCKKE

SEQ ID NO: 116873 - protein, 71 aa, Glycine max
  Coding DNA Sequence Number=SeqID_25188
MGCRKVVFYAMFIAVATCPFAGERRRGSRVRFPKEERCAKSPPTFICGKRRKKPKETGQNENSKFGSCIYV

SEQ ID NO: 116874 - protein, 84 aa, Glycine max
  Coding DNA Sequence Number=SeqID_25189
LWAVEAPPPPEEEGWSPGQAHLGAGSGIYEGAGGIIGISVEEEEGSVEEEGVGASDCAVEGASDLLPLAFLGPLKVTVDHQDSN

SEQ ID NO: 116875 - protein, 384 aa, Glycine max
  Coding DNA Sequence Number=SeqID_25190
  Gene Ontology: Mol. function=glycerol kinase activity; Cellular component=mitochondrial outer membrane; Biological process=glycerol -3-phosphate metabolic process
  Homolog annotation: Hit_ID=Q848P3; Match level="QueryCoverage=75%, HitCoverage=58%, E-value=1e-110, Identity=65%"; Hit description=GlpK
  Pfam annotation: Domain name=FGGY_C; Domain location=115-328; Score =102.8; E_value=1.1e-27; Accession=PF02782.7; Description=FGGY family of carbohydrate kinases, C-terminal domain
  Pfam annotation: Domain name=FGGY_N; Domain location=1-112; Score= -114.9; E_value=0.012; Accession=PF00370.12; Description=FGGY family of carbohydrate kinases,
  Pfam module annotation: Pfam domain module=FGGY_C::FGGY_N; Domain location=115-328::1-112
MRWLLDRCEGGQRMAENGEICLGTIDAWLLWQLSGGQAFGCDTSNAARTQLLNLASGDWDERMLALFNIPRQALPTISPSSHVFGATLGLEGIADGIPIGAMVGDSHAALYGHALGQAGQVKATYGTGSSVMAPIAEAQCDTSALATTVAWHDGERMQYALEGNIPHTGDAIAWMLDITAMPAGGETPLSELPVCVADSGGVYFVPALTGVGAPWWDEQARGVICGLSRGTRREHLVRAAFESVAYQIADVIGVLRQQPGFALQGLMADGGPSRNDWLMQFQADLLGCPRLAAGGAAHLVAAAGELIDDRRTTMNRDFTGKTVVITGACRGIGAGIAERFARLGANLVIASNAERILTTAETLRQRYGVEILPVILDVTMSAGG

SEQ ID NO: 116876 - protein, 94 aa, Glycine max
  Coding DNA Sequence Number=SeqID_25191
  Subcellular localization annotation: CTP_CleavageSite=34; ConfidenceScore=5.43e-01
MVGGIAPHKTPSGPRKVQQGPGFPSSGYGPLSVLQGARTPDKGSRLQDTQWTRKKVPVTSSKGIKPPSNRAFIKKYCVSRQAQGETPQQHWDGR

SEQ ID NO: 116877 - protein, 140 aa, Glycine max
  Coding DNA Sequence Number=SeqID_25192
MTFEAANEIVDKIDALEEQASQGSFVTHGRHDMLTAAIGRPEHPSRVRVVGAGITIKQYFGSASRTSFIAPEYLQQFTQQIKDQLEDSITEKVTRRLMLSLSQMQSQGLALPAELDVGPSAARVSTKESCVIPQGTIQTP

SEQ ID NO: 116878 - protein, 130 aa, Glycine max
  Coding DNA Sequence Number=SeqID_25193
PMIRGDTLRLSAPFCHPEAAGPMTSRDKIWSFCTLVSSRGSGPDDTRRYLTVIRTLLLSRGGGPDDKQRQNLVILHPCVIQRDKIWVILHPLCHPRGGGPDDTRRYPYGYPAPLCHPEAAGPDESAEVPY

SEQ ID NO: 116879 - protein, 165 aa, Glycine max
  Coding DNA Sequence Number=SeqID_25194
DKATTTASSTVREAEPVLQPSLNTGRDRNTAVFGRRYSPQAYPYGLPLDFTPRATPEDLSQAPTFEGQLPPYDDYPGQDDEEGDTHLGPLLHLKDPSPHELPQPNIVRHIPTSSTPVKESVPFGEDKGKIEALEKRLRAVEGLSNYPFSDLADLLVPNIVIPPRL

SEQ ID NO: 116880 - protein, 78 aa, Glycine max
  Coding DNA Sequence Number=SeqID_25195
MKREKHASYSSHNSCKSLSEELHDYYEGRHRSHLRPHSHRREKERKPQEANINLSYFHGKDNVEANLDWEIEGRGGIL

SEQ ID NO: 116881 - protein, 72 aa, Glycine max
  Coding DNA Sequence Number=SeqID_25196
  Homolog annotation: Hit_ID=A5BEW3; Match level="QueryCoverage=54%, HitCoverage=3%, E-value=2e-07, Identity=66%"; Hit description =Putative uncharacterized protein
MPFGLCNAPGTFQRCMLSIFNDFLESCIEGFIGVLSRILAKWPFDYPICCKRRWSLILMTDAKRLLIALSVW

SEQ ID NO: 116882 - protein, 106 aa, Glycine max
  Coding DNA Sequence Number=SeqID_25197
MGLGKDSHGNADVVDIRGNPYKYGLGYEPEKPGRRNAPSRLRADRAWPDHVSQCFTSAGIMFEEKVAAIGEESPQDPPSFVRPCHPNSQVGNWRVMSQSDAYTADS

SEQ ID NO: 116883 - protein, 76 aa, Glycine max
  Coding DNA Sequence Number=SeqID_25198
MGALPREEGARSHHQRLFEENVRKTGTCGLRTLSVKGSGVVFTHGEGMVDKSGAFAPTYPRFVVRNSYLRSSCEKR

SEQ ID NO: 116884 - protein, 44 aa, Glycine max
  Coding DNA Sequence Number=SeqID_25199
MMKRYEQQAKRHAREGSGHEQQKMSSFLAIIKEERERNKGNSGN

SEQ ID NO: 116885 - protein, 220 aa, Glycine max
  Coding DNA Sequence Number=SeqID_25200
MVIDQSLFFSLTNLPSQGAPFEGTIVDDWKFDYSSHDARRMVCNDQAEMTAQVSEEDLILMWAFLTGRQIDWAHLVRYRMHKALRANSPLPYPHLITLFLRHFQILLDDEPFVQVKRSFAIGAGAVTSFGYRKDQNGQWLKKDALPPQDERTPSPPPQRDDSTLMNEVLSELRGLRSYVGDRFDSLDTRFAGMDIRLTQLEEDVGYIRQSFDLPPPPPPS

SEQ ID NO: 116886 - protein, 110 aa, Glycine max
  Coding DNA Sequence Number=SeqID_25201
  Subcellular localization annotation: CTP_CleavageSite=52; ConfidenceScore=5.47e-01
MKVRTCSPLKMRMFGPLKMRMCIPLMARTCSPLKVRACSPLMVRTCSPLKTRACSPPKGRTCSPLKVRTYSPLKIDCPFERGDSPCNLILSFANLSGNSLRVYVLFDLVT

SEQ ID NO: 116887 - protein, 119 aa, Glycine max
  Coding DNA Sequence Number=SeqID_25202
MCLPLSQPTLRREGDARAHGCVFHGRKMHGVATNVYLRKTSEKPERCGLCTLSVKGSGVVSTHGEDLETYPLKNEEQMKNREERRKTFTDLLTEHLESITEAPRLGFSSRKQFFSPKIA

SEQ ID NO: 116888 - protein, 124 aa, Glycine max
  Coding DNA Sequence Number=SeqID_25203
MRPDEVVLPEQIVPVIHETAEAGESQLRQEVATPERTSQTLEGPLSPGMELSFAQQVTDPPTRVQERQANPLTPIMEMPEDHTLPVLRLSSTPPTTPVLHLTDEEDMQNQDTGHTGPVTGILNS

SEQ ID NO: 116889 - protein, 101 aa, Glycine max
  Coding DNA Sequence Number=SeqID_25204
  Subcellular localization annotation: CTP_CleavageSite=33; ConfidenceScore=5.51e-01
MIVWPNSLKTVPSGVAKCHNLPFGGRTMRGLTGASSKKGKCAESPPTFIRGVATYPSAGGRHVTRGMRVPRKEYAWSRHQRLFEENVGKTGKDAIYELLSE

SEQ ID NO: 116890 - protein, 44 aa, Glycine max
  Coding DNA Sequence Number=SeqID_25205
MTEGCGEGFVGDLEGRDESKRQGLNLSGSWQQGHSATYNTPSRI

SEQ ID NO: 116891 - protein, 67 aa, Glycine max
  Coding DNA Sequence Number=SeqID_25206
MTSFCDWSRNGEQSLELCGQQWWMRRGEEKQHEKLCHMSPFEWSKKGPTFPLDVTHTQPQEEKNLTF

SEQ ID NO: 116892 - protein, 198 aa, Glycine max
  Coding DNA Sequence Number=SeqID_25207
  Homolog annotation: Hit_ID=Q6WAY6; Match level="QueryCoverage=60%, HitCoverage=21%, E-value=5e-14, Identity=34%"; Hit description =Putative uncharacterized protein
MHGSSVVYPLCVWLVSHLFQQDIRHPCPLRSHHSCVEKRIVDWDQHLAGIGGRTVNWFPRWKEGKEGVLFSCGGYPNIPLIGTRGCINYNPALAIRQLGYPMRGAPTEESLPPFLVRDFGAQNFKVIQRGHKAWESPLRKDKELRGIRNGIIGGYHEWLKVRTRGRLTKEKFKFVATDVRKKCAGLREENAATAKALE

SEQ ID NO: 116893 - protein, 82 aa, Glycine max
  Coding DNA Sequence Number=SeqID_25208
STLEDPTVRQQAANHRGQVQIHECLYRFSLSQQGQGLAPFACPTPEKFGAEAHGPEIGPRPRQGRSPQDPPVRQRRPVWMKK

SEQ ID NO: 116894 - protein, 120 aa, Glycine max
  Coding DNA Sequence Number=SeqID_25209
  Gene Ontology: Mol. function=amino acid transmembrane transporter activity; Cellular component=integral to membrane; Biological process=amino acid transport
  Homolog annotation: Hit_ID=A6TH75; Match level="QueryCoverage=100%, HitCoverage=24%, E-value=3e-56, Identity=87%"; Hit description =Putative amino-acid transport protein
MAEMGSAYRKEEGGIYSWMNRSVGPRFAFIGTFMWFSSYVVWMVSTAAKIWVPFSTFLFGADKTQSWAFAGLTSTQTVGVLAACWMVLVTLVAAKGINKIAKITAVGGIAVMCLNLVLLL

SEQ ID NO: 116895 - protein, 372 aa, Glycine max
  Coding DNA Sequence Number=SeqID_25210
  Homolog annotation: Hit_ID=Q6WAY4; Match level="QueryCoverage=84%, HitCoverage=54%, E-value=5e-39, Identity=33%"; Hit description =Putative uncharacterized protein
MSPAFRKVYGKILDLTAVEVFTEAVVSLAQYYDQPLRCFTFGDFQMVPTIEEFEEVLGCPLGGRKPYLFSGFLPSLSKIATVVRDSAKELDHIKQTRNGAVGLPRKYLEGKARDMASREKWGPFADILALLIFGVVLFPNVDGLVDLAAIDAFLAYHHSKESPVVAILAYLFDTFDRRCEKNSARIVCCLPALCVWLVSHLFQQDTRYPCPLQSYRSCAEKGRVDWDQHLAGIGGNTINWFPRWKEGKEGVPFSCGDYPNVPLIGTRGCINYNPALAIRQLGYPMRGAPTEESLLPFLVRDLGAQSLKVIQRVHKAWRSPLKKDKELRCIRNGVIGGYHGWLRVHTRGLDWLSKLKVINEENFEAPEEDEEV

SEQ ID NO: 116896 - protein, 39 aa, Glycine max
  Coding DNA Sequence Number=SeqID_25211
MDTSEPYTVAMKGTMQKGVRNDHNLSLRAIGHDCLRMAK

SEQ ID NO: 116897 - protein, 79 aa, Glycine max
  Coding DNA Sequence Number=SeqID_25212
  Homolog annotation: Hit_ID=B0HC01; Match level="QueryCoverage=39%, HitCoverage=65%, E-value=1e-09, Identity=100%"; Hit description =Putative uncharacterized protein
MLVRGAELWKTPATRPFTVPGLCWPFAHMFFLRYPLILWITVLPPLSELIPLAAAERPSAARNSYDHDYEFELGTLTMA

SEQ ID NO: 116898 - protein, 39 aa, Glycine max
  Coding DNA Sequence Number=SeqID_25213
IAVGPCGLNNNVNVCIHDFDDVKEESNKAASNDKHLLQE

SEQ ID NO: 116899 - protein, 216 aa, Glycine max
  Coding DNA Sequence Number=SeqID_25214
PVRQRQHGKNLQVRCRKGRADGRALEQGHPREKGADVTHEGAIDPGLAEHARQPVHRELQRQRRIAGLLEAQLGQRVEGHEHQKANEIETFHLSYSRGCAPPASYETGEPQSQGHRGRAAPHRGCRPPPAKRERAPCTRGKARSDSGGAVSSQCRPTMATPMDTRTMPATRMGASFSANSSRPAIMMATMLMEPSSTPSDSGTSERKASHSTNSAT

SEQ ID NO: 116900 - protein, 67 aa, Glycine max
  Coding DNA Sequence Number=SeqID_25215
  Homolog annotation: Hit_ID=A5BEV8; Match level="QueryCoverage=77%, HitCoverage=6%, E-value=8e-07, Identity=48%"; Hit description =Putative uncharacterized protein
FWGLFMRVDALPRVIVTDKDLSLMNVVKTVFLDATNLLCQFHIDKNVKAKCKNLIAQKNAWDYVMEG

SEQ ID NO: 116901 - protein, 359 aa, Glycine max
  Coding DNA Sequence Number=SeqID_25216
  Gene Ontology: Mol. function=transporter activity; Cellular component= integral to membrane; Biological process=transport
  Homolog annotation: Hit_ID=A1FHP4; Match level="QueryCoverage=100%, HitCoverage=72%, E-value=1e-176, Identity=90%"; Hit description =Sulphate transporter
  Pfam annotation: Domain name=Sulfate_transp; Domain location=103-359; Score=276.3; E_value=6e-80; Accession=PF00916.11; Description=Sulfate transporter family
  Pfam annotation: Domain name=Xan_ur_permease; Domain location=14-359; Score=-127.1; E_value=0.0023; Accession=PF00860.11; Description =Permease family
  Pfam module annotation: Pfam domain module=Sulfate_transp::Xan_ur _permease; Domain location=103-359::14-359
MLQKLRQTWFSNVRADVLAGLVVALALIPEAIAFSIIAGVDPKVGLYASFCICAVIAFVGGRPGMISAATGAMALLMVTLVKEHGLQYLLAATLLCGVLQILAGYLKLGSLMRFVSRSVVTGFVNALAILIFMAQLPELTNVTWHVYAMTAAGLGIIYLFPYVPKIGKVIPSPLVCILTLTAIAIYLGLDIRTVGDMGQLPDTLPIFLWPEVPLNFETLRIIFPYSAALAVVGLLESMMTATIVDDLTDTTSNKNRECKGQGVANIAAGMLGGMAGCAMIGQSIINVKSGGRTRLSTLCAGAFLLLMVVFLGEWLSKIPMAALVAVMIMVSIGTFSWDSLRNLKEHPLSTNLVMVATVV

SEQ ID NO: 116902 - protein, 73 aa, Glycine max
  Coding DNA Sequence Number=SeqID_25217
STLEGSHGLHDLAIRGLHALTIRGLHVLDIRGLHVLVFRGLDILAFRGLDILAFRGLQVFTFRGLHVLAFRGL

SEQ ID NO: 116903 - protein, 69 aa, Glycine max
  Coding DNA Sequence Number=SeqID_25218
MENWRTALRNNFAGLQTRREWRIGGQRYAITSRGSRLEGGGHMNSARQLHSWVSPIKVENGELANSATQ

SEQ ID NO: 116904 - protein, 101 aa, Glycine max
  Coding DNA Sequence Number=SeqID_25219
YCTQRQAQGDAPQAAGAPPPPHQAGPAGSFDMDQYLRHLVRQQAANHRAHTSSGVEVAWPGDWPKAQAGEAPPEAPDDGEEAHEDEEMADLLDFLGGSGAT

SEQ ID NO: 116905 - protein, 43 aa, Glycine max
  Coding DNA Sequence Number=SeqID_25220
MARDGHQWLVVVEEEVGGVGGGFRGRDGACKTRSSKLWLIWAS

SEQ ID NO: 116906 - protein, 209 aa, Glycine max
  Coding DNA Sequence Number=SeqID_25221
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A4W9X6; Match level="QueryCoverage=70%, HitCoverage=27%, E-value=2e-50, Identity=65%"; Hit description=PTS system, maltose and glucose-specific IIBC subunit
  Pfam annotation: Domain name=PTS_EIIC; Domain location=11-199; Score=- 32.5; E_value=0.0022; Accession=PF02378.9; Description=Phosphotransfer ase system, EIIC
MSLWEFFQSLGKTFMLPVALLSFCGIMLGIGSSLSSHDVLTLIPLLDQPFLQYLFIWMAKIGSFAFSYLPVMFAIAIPLGMARENKGVAAFAGFVGFAVLNLSVNFWLNINGILPTTDAAVLKANNVQNILGIQSIDTGILGAVIVGICGVLAARAFSQYSPAGCAGILRRHALCADYHHRGDGSAGAGGTADLAILCARDYRSWLDDQ

SEQ ID NO: 116907 - protein, 81 aa, Glycine max
  Coding DNA Sequence Number=SeqID_25222
MDDYVIRKVPQHYGKKTSIVTEKRITKKRQEGVFSKKGGSNSNQPTWAFQDVPPEGGCFWRKQPSSPGRAGWQAPPLFSYK

SEQ ID NO: 116908 - protein, 128 aa, Glycine max
  Coding DNA Sequence Number=SeqID_25223
  Homolog annotation: Hit_ID=Q1RSH0; Match level="QueryCoverage=94%, HitCoverage=63%, E-value=2e-09, Identity=33%"; Hit description=H+ -transporting two-sector ATPase, alpha/beta subunit, central region, related
MGSFGEAGWEWEFSWRRNLFDNELGRASAFIEQATTLSPNAALKDYWVWGADPKGIFTTRTAYLCIKGDQPIGYLNRGFSQLWEIKVPPRALSFAWRLLWDRLPTKENLTRRQVVIENDLCTFLPKPS

SEQ ID NO: 116909 - protein, 104 aa, Glycine max
  Coding DNA Sequence Number=SeqID_25224
MLLTILRIFLSIFGSTSLGLVAMLGFSGTGAGPGIICMGWILNSGRSWFDGALVDDGDDGTEGEPGADVSFGEVAMEEQSFWSGFGNIREVLRNADENEIASKI

SEQ ID NO: 116910 - protein, 55 aa, Glycine max
  Coding DNA Sequence Number=SeqID_25225
MDFNSDDFMDKLREALRNVDMRDERWRPRRGEPRPNVDEFKITELPEFNGSADPE

SEQ ID NO: 116911 - protein, 69 aa, Glycine max
  Coding DNA Sequence Number=SeqID_25226
SPVESPNVATYPSAGGRRGAHECVFQERKMCRVAINVYSRKTSEKPEKGVSLAPMYPQLQCGNQTYVVL

SEQ ID NO: 116912 - protein, 319 aa, Glycine max
  Coding DNA Sequence Number=SeqID_25227
  Gene Ontology: Mol. function=transcription factor activity; Cellular component=cytoplasm; Biological process=regulation of transcription, DNA-dependent
  Homolog annotation: Hit_ID=Q1GZ13; Match level="QueryCoverage=58%, HitCoverage=97%, E-value=2e-59, Identity=63%"; Hit description=Cell division inhibitor SlmA
  Pfam annotation: Domain name=TetR_N; Domain location=16-62; Score =29.2; E_value=1.5e-05; Accession=PF00440.14; Description=Bacterial regulatory proteins, tetR f
MATINKEARANRKQQILETLAGMLQNPRGEKITTAALAAKLEVSEAALYRHFANKAKMFEGLIEFIEGALFGVMNKITTDETDGLNQVQLMLQTMLKFAERNPGMSRVLIGDALVNEDESLQARINQLLDRLEASLKQSLRIAEAQGHKVADAGIAANTLISFVLGRWHAFAKSGFKRKPSDNLEQHMENTVFGMNEAQLTEFGMSWGLAGLILFIVFIVGNLAWKSKAGKTGTFAEFLHCGHRSQGTFMQQILVYSDSLSWGIIPNTRQRLPFDQRWPGVLEITLNQSGSHFRVIEDCLNGRRTVFEDPYKPGRNGLQ

SEQ ID NO: 116913 - protein, 175 aa, Glycine max
  Coding DNA Sequence Number=SeqID_25228
MYSPLKKKLKKFIIWEINSDKGILKEDFQASSRVLIINKDSGGHTLAISLTKSRVYLQNRPIQQGPNIFQRTTKLEETLTQFMQVTTSNYKRTESALKNLEVQVGQLTKQIADKSSNNFMTNTEKNPKEECKTVMTRSKRFVEAEDEESVVHKKKGTDGKKNHICLLQNNMFAYR

SEQ ID NO: 116914 - protein, 94 aa, Glycine max
  Coding DNA Sequence Number=SeqID_25229
MTHQDFQVYATIVNHTGMWVQAIERSELSRIRVIRLNMSTEKILQLFLILEKFFLRGSTAFFILPCYKVVETKQRWVPQSLTLGQGGAPCMSLK

SEQ ID NO: 116915 - protein, 170 aa, Glycine max
  Coding DNA Sequence Number=SeqID_25230
  Gene Ontology: Mol. function=electron carrier activity; Cellular component=integral to membrane; Biological process=cell redox homeostasis
  Homolog annotation: Hit_ID=Q3SH18; Match level="QueryCoverage=78%, HitCoverage=78%, E-value=5e-25, Identity=40%"; Hit description =Thioredoxin precursor
  Pfam annotation: Domain name=AhpC-TSA; Domain location=32-149; Score =46.0; E_value=1.4e-10; Accession=PF00578.12; Description=AhpCTSA family
  Pfam annotation: Domain name=Redoxin; Domain location=31-166; Score =4.0; E_value=0.0022; Accession=PF08534.1; Description=Redoxin
  Pfam module annotation: Pfam domain module=AhpC-TSA::Redoxin; Domain location=32-149::31-166
MGCIFNKNKGWQQPFGLFAILLAVFSQGVAETSLAADSGWLMHDLAGRTHQLAQYKGRWVVVNYWAPWCPPCLEEMPELVTFYDAHAKEAMVLGVAVQYTTEQSVRNYIEDMLISYPIILGDQQKHLPVTPEVLPTTYIYAPDGSLYKIKARCLEQSLVGILTQSRRAGG

SEQ ID NO: 116916 - protein, 196 aa, Glycine max
  Coding DNA Sequence Number=SeqID_25231
MSVHVAQLIADSIYLFAGMPPTRHPLDPDKSNRALGFPALITSLCQSFGVPVTPSKVIRPPITRAFIEKYCMPRQAQDDAPQAADTPPPPHQADPAGSLGMERYLQHLVHQQAANHRGLVQIHGCLYLLSLSQQGQGFAPFACPTPDQFRAEVALHGDWPEAQAGGAPAGAPGDAEEARMDEEMTDLLGFLGGSGA

SEQ ID NO: 116917 - protein, 38 aa, Glycine max
  Coding DNA Sequence Number=SeqID_25232
MRTTTGEELATQLAQASKVASSRSNNLLEEESGRPKWA

SEQ ID NO: 116918 - protein, 189 aa, Glycine max
  Coding DNA Sequence Number=SeqID_25233
  Gene Ontology: Mol. function=two-component response regulator activity; Cellular component=cytoplasm; Biological process=two -component signal transduction system (phosphorelay)
  Homolog annotation: Hit_ID=A4W9Z2; Match level="QueryCoverage=69%, HitCoverage=55%, E-value=1e-52, Identity=80%"; Hit description=Two component transcriptional regulator, winged helix family
  Pfam annotation: Domain name=Trans_reg_C; Domain location=63-129; Score=46.5; E_value=9.6e-11; Accession=PF00486.19; Description =Transcriptional regulatory protein, C t
MGANDYILKTTPPAVLLARLRLHLRQHASIEREAPAPSLTPHKAMRFGTLSIDPINRQVLLSGELIALSTADFDLLWELATHAGQIMDRDALLKNLRGVSYDGMDRSVDVAISRLRKKLQDNATEPYRIKTATLNHASPSRTDQKALFDLLELIQSYEILLDLIREFGTDVIDMHIAEGLAVTEKLIAK

SEQ ID NO: 116919 - protein, 47 aa, Glycine max
  Coding DNA Sequence Number=SeqID_25234
MTFSQSLVTEDANIYGEANETFSLSRSEDVDILGVKVTMLSSHAIRL

SEQ ID NO: 116920 - protein, 146 aa, Glycine max
  Coding DNA Sequence Number=SeqID_25235
MLLSYLPRVPPNLPFPFWHTCDDLVRDRQVYLHDEKSGRPTIHKRGCTYNNSPTALFTSQVECVTGIGKNGNGFAFLAMVISKKSIDRCLSQRALRGRARARLTGALSKGGKMRGVATNVYLWKTSKKPKETGQKENSKFESCIYA

SEQ ID NO: 116921 - protein, 61 aa, Glycine max
  Coding DNA Sequence Number=SeqID_25236
MATVQHLVMDDKKRRPIICRTKPDLNKTFKEATKAIGVAQVLLTTLMEVLQIKVHNNNKLN

SEQ ID NO: 116922 - protein, 89 aa, Glycine max
  Coding DNA Sequence Number=SeqID_25237
VEIAGVGSLNIRTCINYWELITKFLELKFLLHFLDIWTKITEKRTKRFGDMNGSIKEKEEREEMPLQGEDESRRSSPPQEAMDKSLEEE

SEQ ID NO: 116923 - protein, 90 aa, Glycine max
  Coding DNA Sequence Number=SeqID_25238
  Gene Ontology: Mol. function=helicase activity
  Homolog annotation: Hit_ID=Q2HUT8; Match level="QueryCoverage=85%, HitCoverage=19%, E-value=8e-13, Identity=48%"; Hit description =Putative uncharacterized protein
MAHKYCFQALDQNIGDGVIGNQNDGYATVEIPEYLLITEYNDPIDAIVRSAFPYLYQHHSNPEFFKCRAILASTNETIEEVNDYILSLIP

SEQ ID NO: 116924 - protein, 86 aa, Glycine max
  Coding DNA Sequence Number=SeqID_25239
MAPRKLSAKRSRKDVAAEGTNAAPEFDSHRFRSAEHQQRFEAIKGWSFHRERRIQLRDDEYADFQGEIARRRWTSLVTPMAKFDLD

SEQ ID NO: 116925 - protein, 71 aa, Glycine max
  Coding DNA Sequence Number=SeqID_25240
MACPCWDADGLGGKLRNDDRNKGKSHEKHKGERHEDHNNKGENNEGDKRENRSGKMKEPEKSYDEYLHEKI

SEQ ID NO: 116926 - protein, 76 aa, Glycine max
  Coding DNA Sequence Number=SeqID_25241
EAGCFGLFLFCSCGVGISPVENDFGMEIPSSFASGERMRILLIDQGSKKSKVVFQWGLLSWEPNLDIWGKTNLGVK

SEQ ID NO: 116927 - protein, 97 aa, Glycine max
  Coding DNA Sequence Number=SeqID_25242
  Subcellular localization annotation: CTP_CleavageSite=66; ConfidenceScore=5.14e-01
MLLSSNVILYLCKSGHVGAHDPHSSLCSGHGVKSCPRVWIWSPLKVRTRSPLKARACSPLKFRTCRLSKARECSPMMARTCKPMKVRACPPLKMGNM

SEQ ID NO: 116928 - protein, 85 aa, Glycine max
  Coding DNA Sequence Number=SeqID_25243
MARKKGDLTFISNLLKRKAVLKKRKNDDDKRPKRMISRLSQEQFKNQEKFDFKIQESSFKNQESRIIKIKIQDSRFKNLEKTQSR

SEQ ID NO: 116929 - protein, 72 aa, Glycine max
  Coding DNA Sequence Number=SeqID_25244
MYPPLFSLNNLVDVPSTRTDPQEMEWEESKEFSNCVILNSLTREKGDTKEFRRLVLCSFGKGRREIQKEFRR

SEQ ID NO: 116930 - protein, 84 aa, Glycine max
  Coding DNA Sequence Number=SeqID_25245
MLSDVGNALAWSLALSLGHVHTLDVVYVRGGEGGRGKCTGLPGSLALALGHFHMLDVVYARGGRSALAFQGLWQFLWATFIRRM

SEQ ID NO: 116931 - protein, 100 aa, Glycine max
  Coding DNA Sequence Number=SeqID_25246
  Homolog annotation: Hit_ID=Q84VH5; Match level="QueryCoverage=42%, HitCoverage=6%, E-value=1e-13, Identity=95%"; Hit description =Envelope-like protein
MPCRSTLEDPTSKDALIAELKDTCKVLEATIKATTEKKMELERLITRLSESGIDDEEAAEEEEEAAEEDKEAAKEEEEAAEEEEDAAEETESDDDSEATP

SEQ ID NO: 116932 - protein, 384 aa, Glycine max
  Coding DNA Sequence Number=SeqID_25247
  Gene Ontology: Biological process=transposition, DNA-mediated
  Homolog annotation: Hit_ID=Q6UUU1; Match level="QueryCoverage=20%, HitCoverage=53%, E-value=5e-17, Identity=60%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMTTAACPAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARVVRLRRAEMAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSKSW

SEQ ID NO: 116933 - protein, 90 aa, Glycine max
  Coding DNA Sequence Number=SeqID_25248
  Homolog annotation: Hit_ID=A2Q186; Match level="QueryCoverage=72%, HitCoverage=16%, E-value=3e-08, Identity=36%"; Hit description =Reverse transcriptase-beet retrotransposon, putative
GVFIDGSWTDDPHKVKKEVKSFFFHRFQEPIGQRPKIDGIRFQTVNLQQNNELLAPFMDEEIQKAIFKATAKFFMKEGNSQKDCMDLMEI

SEQ ID NO: 116934 - protein, 85 aa, Glycine max
  Coding DNA Sequence Number=SeqID_25249
AANHWGQVQIHECLYRFSLSQQGQGFAPFACPTPEQFRAEVAWPRDWPEAQAGEAPAGSSGDVEEALMDEEMTDFLGFLGGSRAT

SEQ ID NO: 116935 - protein, 99 aa, Glycine max
  Coding DNA Sequence Number=SeqID_25250
GFVLYRNREPSWKISLRLKGSSRCGVATENNSGLWWLMVAVGDGESAWDVRNGFGRKKEEEMVFFLSYTKAKAENAQVRNGLGHENLPHTPEIFSKIPK

SEQ ID NO: 116936 - protein, 99 aa, Glycine max
  Coding DNA Sequence Number=SeqID_25251
MASRKRKAPSTPTQDRFDRSRFTSQEAWERYTDIIVPRKLLPERNVVVYYTEFDEFKEELERRCWDKELTDFGDGNIDVAIVKEFYANLYEPEDKSPKQ

SEQ ID NO: 116937 - protein, 70 aa, Glycine max
  Coding DNA Sequence Number=SeqID_25252
STLEDPRFYGVPVAPSKVIRPPTNRAFIKNYCAPRQVQGETPQQPRDGRQRATDAPPPPLEFTSAHPQKG

SEQ ID NO: 116938 - protein, 66 aa, Glycine max
  Coding DNA Sequence Number=SeqID_25253
METIRSFQEWTREGSKLVYQQEGLFPPQNARVAVVGENEGPPKCLQGYTTNCLPFSGTSKARLEVS

SEQ ID NO: 116939 - protein, 283 aa, Glycine max
  Coding DNA Sequence Number=SeqID_25254
MRRISKCSLDGDEGLHQLQSRSCYKTTWLPYERGATRGCANMETLQKVRKAWEVLQKKDKELRGSNNRPIGDYRKWLKAHVQGLVWLLSLRTTKREEVEAPEEDEEVQALRVELEQAQTVKERFKSAALKIQKENAELRDVNVATTKALERETKRACREEHGRNKFRGALWGSNNELKLRREEKDQSRVDSLILKNELKACSRSKRSLSQRLCETETNMLAIITRYQEELNLAAAHEHRVADEYAQVYAEKEARGRVINSLHQEATMWMDRFALTLNGSQELP

SEQ ID NO: 116940 - protein, 193 aa, Glycine max
  Coding DNA Sequence Number=SeqID_25255
RLLDAERDAVGERLAGHQELRRQLAVAVAVDVAGHGAVRQDAARAAQVAGAHADVVQPELLVERLAAPQQGRAHRQQQGGVAAAFVGAAPQQQPRQLLDVADVRVRHQVDARALRGPRCPAAGCPAPLESQRAAPQAQLLAVGLDAAAARAQCADASQAAVVQQDLDRPQQAGIQPHARDVEARPHVELQFHA

SEQ ID NO: 116941 - protein, 153 aa, Glycine max
  Coding DNA Sequence Number=SeqID_25256
GAEDDVSLCVLSGFSSYRQQKVYTDNHSGISGRQRDSKVAEDDVSLCVLSGFSSYRMQKVYTDNHSGISGRQRDSKVSMTDLVSAEDDAFRLTDKKFIRITTRGAEDDVSLCVLAGFSAYRQQKVYTDNHSGISARQRDSKVSMTDLVSAEDD

SEQ ID NO: 116942 - protein, 212 aa, Glycine max
  Coding DNA Sequence Number=SeqID_25257
  Gene Ontology: Mol. function=protein serine/threonine kinase activity; Cellular component=cell wall; Biological process=protein amino acid phosphorylation
  Homolog annotation: Hit_ID=Q2R9X8; Match level="QueryCoverage=33%, HitCoverage=7%, E-value=2e-16, Identity=56%"; Hit description =Leucine Rich Repeat family protein, expressed
  Pfam annotation: Domain name=LRRNT_2; Domain location=32-74; Score =43.0; E_value=1e-09; Accession=PF08263.3; Description=Leucine rich repeat N-terminal domain
  Subcellular localization annotation: CTP_CleavageSite=56; ConfidenceScore=5.36e-01
MTNSSFWFTCTHVVLFSATLLCLQPKSTPSALGNDTDQLSSLRFKEAVENNPFNVLASWNSSTHFCKWHGVTCSLKPQRVSALNLQGYALKGLITPEIGNLTLDASSTVKKLKFIKECIRQWSLSNGDVNARKVPNLKRELNALEVGFNDRTLSQDEVSLKKSLQDPLWNAAYAFESMLRPKARVKRFTEGDNNSNYFPRLIHHRTIPNAIQ

SEQ ID NO: 116943 - protein, 113 aa, Glycine max
  Coding DNA Sequence Number=SeqID_25258
  Subcellular localization annotation: CTP_CleavageSite=56; ConfidenceScore=5.29e-01
MNLWKRMGSQWLSSNSSSSFRSLYSSEHELPFSSLCFSLKNPLELEISRICTERVCALSTNSPCCFFALSGNPPASDNSYLRVLGALSANLQPSTSFPIPCLYFCKRKTIKII

SEQ ID NO: 116944 - protein, 35 aa, Glycine max
  Coding DNA Sequence Number=SeqID_25259
MDIKNDRGYNCTGYAIGWAAGDDLKIIMSRSFEEG

SEQ ID NO: 116945 - protein, 68 aa, Glycine max
  Coding DNA Sequence Number=SeqID_25260
  Homolog annotation: Hit_ID=A5AIZ8; Match level="QueryCoverage=66%, HitCoverage=6%, E-value=2e-15, Identity=82%"; Hit description =Putative uncharacterized protein
MSLLCLLLMTLSMNLGNSHLFQQGQGYSLHADIQYLDARWEVLVVLPLRDCFAQEINMLCRLDGFVVL

SEQ ID NO: 116946 - protein, 77 aa, Glycine max
  Coding DNA Sequence Number=SeqID_25261
MATMMEAMMNIKEIMEVNAAAIAATSVVAKVNSTPPSGLNQMNHPTSDMMIGSGMEKEEREEMPLQGEDESRRSSPP

SEQ ID NO: 116947 - protein, 207 aa, Glycine max
  Coding DNA Sequence Number=SeqID_25262
RGLHVLAIRGLHALTFRGLHVLALRGLHALTLGLHALTSRGLPVLALRGLHALTLVLVTLTVERTTRLHVLAIRGLHVLAIRGLHALTSRGLPVLALRGLHAFTLGTSYPHQLRGLHVLAIRGLHALTFRGLHVLALRGLHALTLEGYTPSPWVLVTLTVERTTRPRLERTTCPHLQRATALTSEDLHVLALRGLPALTLGTSYPHR

SEQ ID NO: 116948 - protein, 76 aa, Glycine max
  Coding DNA Sequence Number=SeqID_25263
NVGGDSARIPFVEHASRESRVALPPKGRLRQKGRAEAKVRGWDVKSKGPRPATSVRAFMSAGSKDTKAQVIAICEG

SEQ ID NO: 116949 - protein, 71 aa, Glycine max
  Coding DNA Sequence Number=SeqID_25264
MKMKANNTRNELKVSDWNTYWLKNEERTKNGRRMVKNGGKSSQICSRKCLGSVTEALRLDFSSRKRVFYPK

SEQ ID NO: 116950 - protein, 128 aa, Glycine max
  Coding DNA Sequence Number=SeqID_25265
MHKALQTNAPLPYPQLVTLFLRHFQIPLDDEPFVQVKRSLAIGAGTWIRKQDLPPPIPDERTPSPLPQRDASSTLMNEVLSELRGLRAFVGDRLDAMDAHFEGMDTRITQLEDDMGFIRRCFDPPAAP

SEQ ID NO: 116951 - protein, 66 aa, Glycine max
  Coding DNA Sequence Number=SeqID_25266
MVVRLFLTHLLLEVACLQSPFLLLYFIVDLQEAKDSIDEEDPRPISSTWSYIIWCDECVEWCNPLL

SEQ ID NO: 116952 - protein, 56 aa, Glycine max
  Coding DNA Sequence Number=SeqID_25267
MTKERQKGVQKENRGEACHPARPGELGLLPPEETAFSRNILEGPSGPGCYLNPHFY

SEQ ID NO: 116953 - protein, 284 aa, Glycine max
  Coding DNA Sequence Number=SeqID_25268
  Gene Ontology: Mol. function=RNA-directed DNA polymerase activity; Biological process=regulation of transcription, DNA-dependent
  Homolog annotation: Hit_ID=A5C5U6; Match level="QueryCoverage=80%, HitCoverage=12%, E-value=4e-32, Identity=33%"; Hit description =Putative uncharacterized protein
MEPEYWDKNPFKATAKVFSPGFHYRPIATNKTRKFYEFILIDTNSVSIKHFKDPKDPNLNTHSTIQILKVMQPRHYGSNLNQPKKFSAPFDPAGYNYWDYIDAWTNVFWHQNSKFKHSWLIYFKNNTAYNFPNWFLQWWNYFGPIPKYFQKKSNRDSNNSTSSIIARNHRHAFVNGGHNLILQRAAPDQVKNWFQSNPEFLKPADPETSLFLNQKSQLAAFLASSKSKESLAQNLKEVLQLLQQEVEEEPSKKEAESSETNDDQEDDPFYQNEDECFGISLDDD

SEQ ID NO: 116954 - protein, 178 aa, Glycine max
  Coding DNA Sequence Number=SeqID_25269
MASRKRARTDDIPSSSILAPQSAAIGPDVQHSQTLVPMLQSLFRGQLIIMHSLRELAHNRPIIPMEHFLEQVSWLEAQLPLVRPNEATPPEPAPTRVEPMPAELRSPVVNPPPSPELEVVPPSPPLIIISDASSDETAAPPDSPAGETANPPDSPVEGIVDLSDSSSREAVAFTDSPF

SEQ ID NO: 116955 - protein, 147 aa, Glycine max
  Coding DNA Sequence Number=SeqID_25270
  Gene Ontology: Mol. function=structural constituent of ribosome; Cellular component=ribonucleoprotein complex; Biological process =translation
  Homolog annotation: Hit_ID=Q2PMT2; Match level="QueryCoverage=100%, HitCoverage=100%, E-value=1e-65, Identity=99%"; Hit description =Chloroplast 30S ribosomal protein S2
  Pfam annotation: Domain name=Ribosomal_S2; Domain location=13-140; Score=151.3; E_value=2.6e-42; Accession=PF00318.11; Description =Ribosomal protein S2
MTKRYWNIILEEMMEAGVHFGHETRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 116956 - protein, 175 aa, Glycine max
  Coding DNA Sequence Number=SeqID_25271
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-24, Identity=30%"; Hit description= UPI00006A17C9 related cluster
  Subcellular localization annotation: CTP_CleavageSite=49; ConfidenceScore=5.50e-01
MTCNPLKARLCSPMKAKVCSPLKRRACSPLKARACCPLKARKFSPPKARASSPLKEKTRSPLKPSTCSPLNARACSPQKASMCNPLKARACSPRKARICSPLKASTCSLLKLRACSPLMAWTCSPQKARACRHLKMRTCSPLKARACSPSKARTCSPLKPRTCHPLKARMSSPVK

SEQ ID NO: 116957 - protein, 107 aa, Glycine max
  Coding DNA Sequence Number=SeqID_25272
  Subcellular localization annotation: CTP_CleavageSite=59; ConfidenceScore=5.44e-01
MRVHCNQASRRPSMITDSPLLLMFPRTRIKWPNSLKTVPSGGRQLSQPTLRREGRRETRGMRVPRKEYARSRHQRLFEENVGKTGKDAIYELFSECFGSCIYARGRY

SEQ ID NO: 116958 - protein, 119 aa, Glycine max
  Coding DNA Sequence Number=SeqID_25273
MLTDKSKEDRLRRWTLKRFLVIFRTKLDFLGFENLPVEERRTVKNVEERSKTFAKSLTETLRKRYGSASTWIFFTKVGGEACHPARPSEQGCFLQKQQPSGGSSGGPSRPGCYLHPHFY

SEQ ID NO: 116959 - protein, 73 aa, Glycine max
  Coding DNA Sequence Number=SeqID_25274
MTTEAAKEIAKKINSFEEQAIQGSFVPHGRQDVLTAAIGRVRAAGAGVTIKQYFGSVPRTSHSSSSLPPEELQ

SEQ ID NO: 116960 - protein, 143 aa, Glycine max
  Coding DNA Sequence Number=SeqID_25275
MAAQLIHDRVEMECLEGVWETLEGNARCRFRGTIQLTATSLVHPEEPAHTLQRTVEWILPTPTPYRLVEPVQVIEVSSSKEDPEEDPEELPPEPAVDALNFPEGDEDPLPDVDSPEDVMSASEADSTEESGPGGIATSGDSSS

SEQ ID NO: 116961 - protein, 310 aa, Glycine max
  Coding DNA Sequence Number=SeqID_25276
  Homolog annotation: Hit_ID=Q84VI1; Match level="QueryCoverage=97%, HitCoverage=49%, E-value=1e-108, Identity=65%"; Hit description =Envelope-like protein
LSEIYEIIPNALLFHGYLNKRNCSFWFTRSTIISAPGTTGIQHPTHTNNSWIKLLSLRNWVPRRQQGGKIAENPSLAQVLGKCPTSSNPNVSVPDVKKDVPTSSAPNAEALPSPGEEGSTEEDDQAAEETPAPRAPEPAPGDLIDLEEVESDEEPIANRLAPGIAERLQSRKGKTPIKRSGRIKTMAQKKSTPITPATSRRSKVAIPSKKRKEISSSDSDKDVELDVSTSKKAKTSGKKVPGNVPDAPLDNISFHSIGNVEKWKYVYQRRLAVERELGRDALDCKEIMDLIKAAGLLKTVSKLGDCYEGL

SEQ ID NO: 116962 - protein, 114 aa, Glycine max
  Coding DNA Sequence Number=SeqID_25277
AGFTSTFPQSQTPLLIRNTMRIPRIPYGEHRSVRDFHVISCYSNLLCSGPVVVYYRPERVVRQFGYTQTITAPPVVSWVSYDDIHDRWMHYSDHIVPAGEVCAMPGQCASDYMD

SEQ ID NO: 116963 - protein, 75 aa, Glycine max
  Coding DNA Sequence Number=SeqID_25278
  Subcellular localization annotation: CTP_CleavageSite=32; ConfidenceScore=5.15e-01
MGSFPKKQGSYTQLTIWAQRASNAKCNFSVLSATEESCKASISGLRPKHEICSLSAMVVFSQAQCMTDAKPTNLR

SEQ ID NO: 116964 - protein, 78 aa, Glycine max
  Coding DNA Sequence Number=SeqID_25279
MKEGIRHILDLTPIGEKMEESLKRLTLTSHTSMERTICQRNGQGRHLRAHPLSPKNDKWEAIEKATPLRASMQEKIAL

SEQ ID NO: 116965 - protein, 54 aa, Glycine max
  Coding DNA Sequence Number=SeqID_25280
MGRWIWAFASGQQQLWIGFLPKMEKMISSLPHFSNQSVLIKWDSPSKEFNPSRG

SEQ ID NO: 116966 - protein, 278 aa, Glycine max
  Coding DNA Sequence Number=SeqID_25281
  Gene Ontology: Mol. function=hydrolase activity, acting on ester bonds; Biological process=lipid metabolic process
  Homolog annotation: Hit_ID=Q8LFP6; Match level="QueryCoverage=98%, HitCoverage=88%, E-value=1e-81, Identity=47%"; Hit description=GDSL -motif lipase/hydrolase-like protein
  Pfam annotation: Domain name=Lipase_GDSL; Domain location=9-268; Score=129.5; E_value=9.9e-36; Accession=PF00657.13; Description=GDSL- like LipaseAcylhydrolase
NSKKKVSAFYVFGDSTVDPGNNNFIDTAFRSDFPPYGRDFVNQAATGRFTNGKLGTDFLASYLGLKELVPPYLDPNLSDKELVTGVSFASAGSGFDPLTPMLGNVIPVAKQLEYFKEYKKRLEGTLGARKIALVGVPPMGCLPIMITLNSHNVFLERGCVDKYSAVARDHNMMLQHELFLMQLNFSNTNPAGAKISYLDIYGPLDDMIQAHQNLGFDEVDRGCCGSGYIEATFMCNGVSYVCSDPSKFVFWDSIHPTEKAYYDLFMAARPTIDALING

SEQ ID NO: 116967 - protein, 49 aa, Glycine max
  Coding DNA Sequence Number=SeqID_25282
MLMVAQTEVEVACARSLKGKKGGRIKRGKKKDRLPHYKQDVLDILACLT

SEQ ID NO: 116968 - protein, 131 aa, Glycine max
  Coding DNA Sequence Number=SeqID_25283
  Homolog annotation: Hit_ID=Q10CV8; Match level="QueryCoverage=51%, HitCoverage=38%, E-value=5e-09, Identity=46%"; Hit description =Expressed protein
  Subcellular localization annotation: CTP_CleavageSite=33; ConfidenceScore=5.21e-01
MAQQSSPPRRQTPPPSQYLEVNCRSSGKIRRFAAGTGAGFAVALINRKLKGTVVAASHIEAVKDGKEEEPIAFGPTSLLSNFGEEVGNGQFQQMAMQKPGLISEVAEARLQYSTAVGGHNSLFFVLLGLGD

SEQ ID NO: 116969 - protein, 2216 aa, Glycine max
  Coding DNA Sequence Number=SeqID_25284
  Gene Ontology: Mol. function=metal ion binding; Cellular component =nucleus; Biological process=regulation of transcription, DNA -dependent
  Homolog annotation: Hit_ID=A7PMB8; Match level="QueryCoverage=78%, HitCoverage=98%, E-value=0.0, Identity=49%"; Hit description =Chromosome chr14 scaffold_21, whole genome shotgun sequence
  Pfam annotation: Domain name=C1_3; Domain location=1286-1315; Score =9.5; E_value=0.041; Accession=PF07649.3; Description=C1-like domain
  Pfam annotation: Domain name=C1_3; Domain location=84-117; Score=9.7; E_value=0.038; Accession=PF07649.3; Description=C1-like domain
  Pfam annotation: Domain name=FYRC; Domain location=637-698; Score =7.4; E_value=0.0041; Accession=PF05965.5; Description=FY rich C -terminus
  Pfam annotation: Domain name=FYRN; Domain location=407-454; Score =60.7; E_value=5.1e-15; Accession=PF05964.5; Description=FY-rich N -terminus
  Pfam annotation: Domain name=MBD; Domain location=259-358; Score =29.7; E_value=1e-05; Accession=PF01429.10; Description=Methyl-CpG binding domain
  Pfam annotation: Domain name=PHD; Domain location=1287-1335; Score =61.1; E_value=3.7e-15; Accession=PF00628.20; Description=PHD-finger
  Pfam annotation: Domain name=PHD; Domain location=85-140; Score=34.9; E_value=2.9e-07; Accession=PF00628.20; Description=PHD-finger
  Pfam module annotation: Pfam domain module=C1_3::C1_3::FYRC::FYRN::MBD ::PHD::PHD; Domain location=1286-1315::84-117::637-698::407-454::259 -358::1287-1335::85-140
MELSDSTGGDRNLNAPPPLPPPHNNHNQDARSGLGIDLNEIPSPSSSFPETLPGSVTVDVVRSYHDNPAPPPGGPAALPRSGSSPCAACAKPSPAAGSHHQLVVCDGCERGFHLACAGIRGGGRQAASLDEWVCGECVAAGVKSKRWPLGVKQLLDINAPPPSDAEGDGGDDEVQLNPLRRFFSEDVGNEWYGLLHALGDNSFAANPFGALVTNSNFNNGNANGFEKASEVVTHAVRVGFEDILNHTQSITRSFEEALRDFVSERRGVLEEGWRVEFRQSVSNSELYAVYCAPDGKIFDSVYEVACYLGLTSGYNSIESELRSERSLPSLGGPPSRKRKSTRTTVANGSMENRGTSTNSNCKDPPCDGLNVECASARGNIPKPSEIGRKEDCHSCSQQSADGLPLQFKDFFVLSLGKVDGRPSYYDVNLIYPVGYKSCWHDKITGSLFTCEVLEGGDSGPIFRIRRCSCSEFPVPVGSTILSMSKLCQVVSQTNEGERKTNANMDLDYDEGLQMMLLDSCLPTENDILSCFPSCSIESRDMSDVLHPITSSVQDNASNSLADNLGFNGLGEILVEERSSFSAWRVISQKLVNACKDILKLKGTLKFYCNHVDKWDLRNGKSDTYCTSLDKFCGSLGSVGIPDVIYSDNDLEGIYVALGKWLEQDRFGLDVEFVQEVLEQLPSVQDSLQYELLNNRNNSSSLPTVENGFLVVEWRDGSKYQEEAVQALYGRSKKVTEKSIKESCHPPLGKPLCSRAPGELIGDIFQAWELLKRFHEILDLKEPLTLDELEKELINPWFDGSNFLEKSERDMDESQVFISLGADGNGRPLLSPRCEVDPSVSIESSHAFIHVETEAMKETAQVKLASFTYARCFGVALTKAHKSLLRVLIGELLSKVAALVDPNSEPGESRTRRGRRKDMDSAVPAKRTKLNMLPINELTWPELARRYMLAFLSMDGNLESAEITARESAKVFRCLRGDGGLLCGSLTGVAGMEADAQLLAEATKTIFGSLSRENDILTMEEEESNAKGAPEIFLANDGNVPEWAQMLEPVRKLPTNVGTRIRKCVYEALEKNPPEWAREILEHSISKEVYKGNASGPTKKAVLSVLVKVGGEGLQSNPNKSQKKKIVISISDIIMKQCRIVLRRAAAADDSKVFCNLLGRKLINSSDNDDEGLLGSPAMVARPLDFRTIDLRLATGAYGGSHEAFLEDVRELWNNVRVAFGDQPDLVELAEKLTQNFESLYNEEVVTYVQRFVEYAKLECLSAEMRKEVGDFIESTNEIPKAPWDEGVCKVCGIDRDDDSVLLCDTCDAEYHTYCLNPPLARIPEGNWYCPSCVVGKHATQNVTERTQVIGKRQSKKFQGEVNSLYLESLAHLSAAIEEKEYWEYSVGERTFLLKFLCDELLNSSLIHQHLEQCAELSAELHQKLRAHSAEWKSLKTREDILSTKAAKIDTFSLNTAGEVGLKEGFASLLSNTGKCLVQPHTAVDNPSNFGVFVDSLPSEEVTKDKYRFDSVDKSISVTNSDSDSQNMNSIDVEGQFRNVSGAVESQCTDKSPKSFPLPNHMPQETNGAGGASLVQGKNQKCEGKDIPTPVSYQQGMPVDVPQISVNESEPYHLELIAIKRDISLLQDSITSVASQLLKLSVRRECLGIDSIGRLYWASALPGGRSRIVVDASAALLHGRGMTFSRDYVEKFSVLQHCALSDKDSSLMSQPSNPLGNSSPWIAYETDVEIEELLGWLDDSDPKERELKDSIMLGPKSRFQQFINAQTEDRAKDQGNVSMPRNREKTVSNSLVTKATSLLEKKFGPFVEWDNSEVLKKQNRKTRTTNDEKLYRCECLEPILPSRKHCTHCHKTVASDIEFDGHNDGKCNAGLLAIEKNKDKNGSSKGRGNLKCDTLHEKFRADAETALTSVSGSSKLSSRLIKFSNEESTCPFNFEDICSKFVTNDSNKELVSEIGLIGSDGIPSFVPSVSPFVSEYTLSAQKDESIVGGVSIVSESRVSQGNTDGAGTCLDHKSGISTGKLAANESNKSNKSSLREQRDGKFSFCSPASVMGADGCCVVPSPSLRPLVGKASHILRQLKINLLDMDAALLAIALRPSKAVPDRRQAWRTFVKSAKTIYEMIQATFTLEDMIKTEYLRNDWWYWSSFSAAAKSSTLPSLALRIYSLDLAIIYEKMPNSSFTDSSEPSVIAEPKPLMNVDTEKSKASRKSTRKRKESDS

SEQ ID NO: 116970 - protein, 234 aa, Glycine max
  Coding DNA Sequence Number=SeqID_25285
  Gene Ontology: Mol. function=hydrolase activity; Cellular component =mitochondrial inner membrane; Biological process=mRNA modification
  Homolog annotation: Hit_ID=A7PSU3; Match level="QueryCoverage=79%, HitCoverage=40%, E-value=1e-56, Identity=53%"; Hit description =Chromosome chr8 scaffold_29, whole genome shotgun sequence
  Pfam annotation: Domain name=PPR; Domain location=120-154; Score =14.6; E_value=0.14; Accession=PF01535.11; Description=PPR repeat
  Pfam annotation: Domain name=PPR; Domain location=62-96; Score=34.2; E_value=4.7e-07; Accession=PF01535.11; Description=PPR repeat
  Pfam module annotation: Pfam domain module=PPR::PPR; Domain location =120-154::62-96
MGRENVELSEFTSCSALKSGASLKALELGRQGWKNDMMYNSMVFRISHALSVFDGISEKDVISWTCMIDVYGRNGQGGEAVEMFQEIKEDGTCGHSGLMEEGKNCFKLLREKYGLQPDSEHYVFYIDILGRAGNIEEVRSTYHTMVEQGTGPTTGVWVALLNACSLNQDVERGELAAKHVLQLEPYKASNIVLVSNFYAATDRWDWVDELRSIMRTKGLVKEVGNSWINVLGFN

SEQ ID NO: 116971 - protein, 400 aa, Glycine max
  Coding DNA Sequence Number=SeqID_25286
  Gene Ontology: Mol. function=catalytic activity; Cellular component =intracellular; Biological process=immune response
  Homolog annotation: Hit_ID=Q9FL05; Match level="QueryCoverage=98%, HitCoverage=85%, E-value=1e-152, Identity=62%"; Hit description =Similarity to intracellular protein
  Pfam annotation: Domain name=HD; Domain location=10-151; Score=41.2; E_value=3.8e-09; Accession=PF01966.13; Description=HD domain
MVYPGAVHSRFEHSLGVYWLASQCVEKLKTYQGLELGIDRFDIQTVKLAGLLHDVGHGPFSHLFEREFLPQVISGSDWSHEQMSVDMVDYIVDEHHIDVYPQMIRRVKEMILASSEYAPSMSSSEKSFLYDIVANGRNGIDVDKFDYLLRDCRACGLGCNFEFQRLLETMRVLDDEICYRAKDLFLIVPCFRLCNLLDLTIHKMFATRADLYRTVYTHPKVKAIELMVVDALVHANSYLGISSNIHDPSEYWKFCNEYPVPKDMLDNYKKVTAQDIVCSQVFNLVKPSHLHKSGGVTLKEEDVAVCNVKIDLTRGKHNPLESIHFFKDYESDEKFTIPDDRVSHLLPTSYQDMIVKVYAKKPELVEAISEAFENFQLKTYGIKTQAHSTPQKKRRYNSFI

SEQ ID NO: 116972 - protein, 193 aa, Glycine max
  Coding DNA Sequence Number=SeqID_25287
  Gene Ontology: Mol. function=protein farnesyltransferase activity; Cellular component=cytoplasm; Biological process=positive regulation of fibroblast proliferation
  Homolog annotation: Hit_ID=Q04903; Match level="QueryCoverage=75%, HitCoverage=34%, E-value=1e-68, Identity=85%"; Hit description =Protein farnesyltransferase subunit beta
  Pfam annotation: Domain name=Prenyltrans; Domain location=32-75; Score=58.8; E_value=1.9e-14; Accession=PF00432.12; Description =Prenyltransferase and squalene oxidase re
  Pfam annotation: Domain name=Prenyltrans; Domain location=80-123; Score=44.3; E_value=4.2e-10; Accession=PF00432.12; Description =Prenyltransferase and squalene oxidase re
  Pfam module annotation: Pfam domain module=Prenyltrans::Prenyltrans; Domain location=32-75::80-123
MKVKLMFELATLPFLESCWNQVASVLNILDDELIQNVGDYIISCQTYEGGIAGEPGSEAHGGYTFCGLATMILIGEVNHLDLPRLVDWVVFRQGKECGFQGRTNKLVDGCYSFWQGGAVALLQRLSSIINKQMEEASQTFTISDVSEAKESLDGTSSHATCHGKHEGRLTSKYPNPKIGDKLGDQKCNFAMLL

SEQ ID NO: 116973 - protein, 173 aa, Glycine max
  Coding DNA Sequence Number=SeqID_25288
  Homolog annotation: Hit_ID=A7PF13; Match level="QueryCoverage=93%, HitCoverage=94%, E-value=3e-40, Identity=52%"; Hit description =Chromosome chr11 scaffold_13, whole genome shotgun sequence
MSGGTPRGGGGLMRQRHSQGYASSGDDLEDDACSRHRPFLAPSPPPRTWIEMLENFLWLASAAFILYFGDQHSNLIYLLCHDNRIKRPPLYLGMIGIGLNIMIFIYTTTLAWSARSIPCLSRFSFALWPIWSFLTLPLLYNQKFTLFMACMVVIPCLIFGTLRPQYYDELRTD

SEQ ID NO: 116974 - protein, 468 aa, Glycine max
  Coding DNA Sequence Number=SeqID_25289
  Gene Ontology: Mol. function=transporter activity; Cellular component= nucleus; Biological process=ribosome biogenesis and assembly
  Homolog annotation: Hit_ID=A7PZT8; Match level="QueryCoverage=54%, HitCoverage=87%, E-value=2e-68, Identity=49%"; Hit description =Chromosome chr15 scaffold_40, whole genome shotgun sequence
  Pfam annotation: Domain name=Mito_carr; Domain location=404-467; Score=18.6; E_value=5.7e-05; Accession=PF00153.18; Description =Mitochondrial carrier protein
  Pfam annotation: Domain name=RRS1; Domain location=1-172; Score =191.7; E_value=1.8e-54; Accession=PF04939.3; Description=Ribosome biogenesis regulatory protein (RRS1)
  Pfam module annotation: Pfam domain module=Mito_carr::RRS1; Domain location=404-467::1-172
MEGEKQHKFDVDLGNLMAFDSYHTFPSQPSLSREDLIKQCLLKGTHLVQAIADALFILPSTEDLDGPLVTLPPPLTKLPREKHLPKPKPPTKWEAFAKKKGIQKRKKDKIVYDEQSGTWKRRHGYDRANDEEAIPIIEAKPTDALPITGTQAAPKKVTKDELGNVAGIAATATASGGKFDKKLAGEKPQKHEGKYRKVVRCALADICFSCPLVEGTGIGSLEREQTEKILNKIISKNSHNILNVEKAVTMHNVKKEKKRRSEKGKASATTDKKLKTQKKEATSYIGIENLVFMGRGRLQVQGVESGNDDVAICSSGIKLGRYSLESKVRPTSLFAGVGQAGFGFGISPNPPTATTRDSGTKPPLINSSTKYVLMPETVEVDEEGHGMKKGKKMKGLESIIEVDEWAIAGAVSRTSVAPLETIRTHLMVGSCGHSTIQVFQSIMENDGWKGWFRGNSMNIIGVAQARPL

SEQ ID NO: 116975 - protein, 86 aa, Glycine max
  Coding DNA Sequence Number=SeqID_25290
MVTNSKGCYRGGLILADARIQSSNSRCPLKQISELTRTLGRNISNSKQQRKNWQSNHNQPKVELEMRKEMSEVARVWLILTTDQHR

SEQ ID NO: 116976 - protein, 347 aa, Glycine max
  Coding DNA Sequence Number=SeqID_25291
  Homolog annotation: Hit_ID=A7PF33; Match level="QueryCoverage=99%, HitCoverage=99%, E-value=1e-122, Identity=65%"; Hit description =Chromosome chr11 scaffold_13, whole genome shotgun sequence
  Subcellular localization annotation: CTP_CleavageSite=74; ConfidenceScore=5.77e-01
MANAWKRDKATRLLSPKLLFLLFSSTLIVFFFFAFLTSRPSNPATTLTAFNTRLSFNAISPFDCTASPQAHPVVANTVEGVRYPFLFSLSDFGTLPDKPHKNIVRMLKGKPFRKPDISVTVQEVLEKARTEGKDGFFVDVGANVGMASFAASAMRFRVLAFEPVFENLQKICEGVYFNRVADLVTVFEAAASDRVGNITVHKVRCYRIRKAYLKSQHVCFGWIDLDECHNLLDNSAISATGAKLAFKSNEEIAFQVRTVPLDEVIPKSERVLLLKIDVQGWEYHVLKGASKLLSRKGSQAPYLIYEEDERLLRASNSSAKEIRDFLRSVGYHDCTQHGTDAHCVKKD

SEQ ID NO: 116977 - protein, 138 aa, Glycine max
  Coding DNA Sequence Number=SeqID_25292
  Homolog annotation: Hit_ID=A3RM06; Match level="QueryCoverage=26%, HitCoverage=11%, E-value=3e-12, Identity=94%"; Hit description =Cysteine synthase
MKKPGRTTTKFGADNKPMCLQSDLEGSKCSIHNIRVSFNSLTQYAIDSIVIKTTRRSIKIGSIKTRNWGSIAGAGRFLRERNPDIKLYGVESAESPVLNGGQPGANAKLGQNLQLPRLCAGSISMCLLLRPGVWLCIL

SEQ ID NO: 116978 - protein, 287 aa, Glycine max
  Coding DNA Sequence Number=SeqID_25293
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=UPI0000ECC20B; Match level="QueryCoverage =19%, HitCoverage=64%, E-value=1e-21, Identity=89%"; Hit description =UPI0000ECC20B related cluster
MDKLDDIRLNKLPDEMVVYVNVLGSFVAEFGPDRMMSSTYTSRMTKEFPEPMVVREHVSKWNLPQELGFSHSLLDTIQDREQLDDKIEVHTQLESDKYKGGLVWCVLLLKVIEGKGLGLGNVLVRGMGITKSSKESRMTWFYEMGELCFNNGEGVLLMRKVAVSLNTEKLMKSAYGSQKLSENKLLRIIRSEALDRYTKLSLNHERPPPRWSSNSTYSESYYDSLDVVLQRRDWENPGDTQVNRLAAHLPFASWRNSEEARTDRPSQQSCSLNGEWDAPWNGALSAA

SEQ ID NO: 116979 - protein, 113 aa, Glycine max
  Coding DNA Sequence Number=SeqID_25294
MAMLTRFLGCICLILILSAGSEARPLNPTIVRDVLGTLKWTPIQPIAEEGGQRDWGTIKDCSWEDDDCIDKCLVRQSTRQLKIYSRNMLNLQSAQKLLCDSWNRAVPYCIEDK

SEQ ID NO: 116980 - protein, 806 aa, Glycine max
  Coding DNA Sequence Number=SeqID_25295
  Gene Ontology: Mol. function=histone-lysine N-methyltransferase activity; Cellular component=chromosome, pericentric region; Biological process=chromatin modification
  Homolog annotation: Hit_ID=Q8GZB6; Match level="QueryCoverage=79%, HitCoverage=96%, E-value=0.0, Identity=54%"; Hit description=Histone- lysine N-methyltransferase, H3 lysine-9 specific SUVH4 (EC 2.1.1.43) (Histone H3-K9 ...
  Homolog annotation: Hit description=methyltransferase 4) (H3-K9 -HMTase 4) (Suppressor of variegation 3-9 homolog protein 4) (Su(var)3-9 homolog protein 4)
  Pfam annotation: Domain name=Pre-SET; Domain location=486-589; Score =108.0; E_value=2.9e-29; Accession=PF05033.7; Description=Pre-SET motif
  Pfam annotation: Domain name=SET; Domain location=591-753; Score =144.5; E_value=3e-40; Accession=PF00856.19; Description=SET domain
  Pfam annotation: Domain name=YDG_SRA; Domain location=296-457; Score =160.7; E_value=3.9e-45; Accession=PF02182.8; Description=YDGSRA domain
  Pfam module annotation: Pfam domain module=Pre-SET::SET::YDG_SRA; Domain location=486-589::591-753::296-457
  Subcellular localization annotation: CTP_CleavageSite=84; ConfidenceScore=5.94e-01
MAAVIPPLSTITIPPRPSSIPGAARQSASSTARFTPSKSRSSSVNATSIPVARRIALRTSSSFSGNHARMKTFALRHIAVRQCQSDAARSACDEHVSVLDWDLHGAENSSESKIAVANGGKVTKAKKKSKCSTMPRRSSARIQALQKAEKELLARQKAEVVVVEEKDNCENAVRAKKRNRNSGGEESVAVEEEVVSKKRKGKVEEVNGKQENAGGGLGEKSDPLKVKETVRLFNKYYLHFVQEEEKRCAAAEPKAAKQKGSRKAKKRGEKSKVTSKRPDLKAMGKMVDNNEVLYPGKRIGDIPGIEVGYQFYSRCEMVAVGFHSHWLKGIDYMPKSYANVYTTYEFPVAVAIILSGMYEDDLDNADDVVYTGQGGHNLTGNKRQIRDQKLEYGNLALKNCVEQCVPIRVIRGHKSSSSYSGKIYTYDGLYNVVEYWAEKGISGFTVYKFRLSRVKGQPKLTTNQVYFVNGRVPRSLTEIQGLVCEDITGGQEDIPIPATNLVDDPPVPPTGFTYCKSLKLAKNVKLPRMNGTGCKCKGICNDPTTCACALRNGSDFPYVSRDGGRLVEAKDVVFECGPKCGCDPGCVNRTSQKGLRYRLEVFRTANKGWAVRSWDFIPSGAPVCEYTGILSRTDDMDRVLENNYIFEIDCLLTMKGLGGREKRSPKGEISANLLDKYDDQSSESAPEFCIDAGSTGNVARFINHCCEPNLFVQCVLSTHHDLRLARVMLFAADNIPPLQELTYDYGYELDSVLDSDGKIKQMPCYSASYEARTLQSVVVSGVRHASVCPHVRIRVVSDVHVGVGAS

SEQ ID NO: 116981 - protein, 67 aa, Glycine max
  Coding DNA Sequence Number=SeqID_25296
MGAIKRFVKMEWNGSWKSENGFLQRGRKCFISKKKCRERNGSNKKVCENGKEEKVVMPEKERDKGSL

SEQ ID NO: 116982 - protein, 146 aa, Glycine max
  Coding DNA Sequence Number=SeqID_25297
  Homolog annotation: Hit_ID=A5C8B4; Match level="QueryCoverage=97%, HitCoverage=12%, E-value=3e-08, Identity=31%"; Hit description =Putative uncharacterized protein
MVKEENEANPKEQPLMMMMITNPKSHNNEIWYIDSGCSNHMIGHRDWLVNFDAKKNSTISHKARWKTSSDLRCALCSWNEEQLDQYGSTLGKIYDTTKRMIMKAPLVRNRTFKAKSEVFNIFKRFKALVEKQSRKCIKILRTDGGG

SEQ ID NO: 116983 - protein, 318 aa, Glycine max
  Coding DNA Sequence Number=SeqID_25298
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8LK65; Match level="QueryCoverage=99%, HitCoverage=79%, E-value=1e-117, Identity=69%"; Hit description=DNA -binding protein phosphatase 2C
  Pfam annotation: Domain name=PP2C; Domain location=8-278; Score =254.1; E_value=3.1e-73; Accession=PF00481.12; Description=Protein phosphatase 2C
MMNFVPTLRSGECSDIGDRPSMEDTHICIGDLAEKFGNNELCKEAISFYGVSYLTDYAIRLVFDGHGGKSAAQFVRDHLPRVIVEDADFPLELEKVVTRSFLEIDAEFARSCSTESSLSSGTTALTAIIFGRSLLVANAGDCRAVLSRGGGAIEMSKDHRPLCIKERKRIESLGGYIDDGYLNGQLGVTRALGDWHLEGMKEMNGKGGPLSAEPELKLMTLTKEDEFLIIGSDGIWDVFRSQNAVDFARRRLQEHNDVKQCCKEIIGEAIKRGATDNLTVVMICFHSEPPPPMVVERPRVRRSISAEGLQNLKCLLEG

SEQ ID NO: 116984 - protein, 48 aa, Glycine max
  Coding DNA Sequence Number=SeqID_25299
MKKMIEEKEVWKRKRRWRGSVRRRQTWNQRAERERDAMNNRCGGVGNV

SEQ ID NO: 116985 - protein, 102 aa, Glycine max
  Coding DNA Sequence Number=SeqID_25300
MIILKTRFLAVARDVSYAYLNTKRIIDLRHVVVNIGDGFQSGNRNPTMNEGEPLGKLANLGKWEQESNDGWVVKGVGFELGGTDERGVNGEKGSKLDLVLGE

SEQ ID NO: 116986 - protein, 220 aa, Glycine max
  Coding DNA Sequence Number=SeqID_25301
  Gene Ontology: Mol. function=calcium ion binding
  Homolog annotation: Hit_ID=A2X754; Match level="QueryCoverage=69%, HitCoverage=30%, E-value=1e-42, Identity=59%"; Hit description =Putative uncharacterized protein
  Subcellular localization annotation: CTP_CleavageSite=65; ConfidenceScore=5.87e-01
MFSWGRRFQLSLRHSIRPFGSQSQGSTSSSSSSSFSSFGGSRHGDNRVRDFEAFLRSITSGVVVVSSTLGYWYWSSLSSPGANSLQSFADGYANEEDQFQQNDENKPKFLFNDLLHVFAFDADGYRRRVFFNYEKRIRLQSPPEKVFEYFASVRSPSGEIFMTPADLMRAIVPVFPPSESNRVREGFLRGEQVPGELQCEPSQFFMLFDTNNDGLISFAE

SEQ ID NO: 116987 - protein, 233 aa, Glycine max
  Coding DNA Sequence Number=SeqID_25302
  Gene Ontology: Mol. function=calcium ion binding; Cellular component =integral to membrane; Biological process=defense response
  Homolog annotation: Hit_ID=A7QS40; Match level="QueryCoverage=95%, HitCoverage=63%, E-value=3e-85, Identity=69%"; Hit description =Chromosome undetermined scaffold_155, whole genome shotgun sequence
  Pfam annotation: Domain name=efhand; Domain location=168-196; Score =25.5; E_value=0.0002; Accession=PF00036.23; Description=EF hand
  Pfam annotation: Domain name=efhand; Domain location=60-88; Score =11.1; E_value=1.2; Accession=PF00036.23; Description=EF hand
  Pfam module annotation: Pfam domain module=efhand::efhand; Domain location=168-196::60-88
MALMRSQNRQGANHRNGRRLGVTASIENGGLVEYFFGKDGNTCLQHERFVQFLRQLHDEILRLEFSHYDYNKKGTISARDFALSLVASADINHINKLLDRVEELNSDQNLRHIRITFKEFQDFAELRKKLKSFSLAIFSYGKVNGVLTKSDFQRAASQVCGVCITDEVVDIIFHVFDANRDGSLSAAEFVRVVQRRESNNSSRHDSFGGLTSCWLNCVKNCSSAQFNFDGIRS

SEQ ID NO: 116988 - protein, 629 aa, Glycine max
  Coding DNA Sequence Number=SeqID_25303
  Gene Ontology: Mol. function=acyltransferase activity; Cellular component=integral to membrane; Biological process=multicellular organismal development
  Homolog annotation: Hit_ID=Q52T38; Match level="QueryCoverage=82%, HitCoverage=87%, E-value=0.0, Identity=62%"; Hit description =Palmitoyltransferase TIP1
  Pfam annotation: Domain name=Ank; Domain location=133-165; Score =31.5; E_value=3.1e-06; Accession=PF00023.21; Description=Ankyrin repeat
  Pfam annotation: Domain name=Ank; Domain location=166-199; Score=6.6; E_value=3.7; Accession=PF00023.21; Description=Ankyrin repeat
  Pfam annotation: Domain name=Ank; Domain location=200-232; Score =26.3; E_value=0.00011; Accession=PF00023.21; Description=Ankyrin repeat
  Pfam annotation: Domain name=Ank; Domain location=233-267; Score =28.2; E_value=3.1e-05; Accession=PF00023.21; Description=Ankyrin repeat
  Pfam annotation: Domain name=Ank; Domain location=268-301; Score=1.1; E_value=23; Accession=PF00023.21; Description=Ankyrin repeat
  Pfam annotation: Domain name=zf-DHHC; Domain location=355-417; Score =86.1; E_value=1.1e-22; Accession=PF01529.11; Description=DHHC zinc finger domain
  Pfam module annotation: Pfam domain module=Ank::Ank::Ank::Ank::Ank::zf -DHHC; Domain location=133-165::166-199::200-232::233-267::268 -301::355-417
MSSEIEVVEEVQSRDEQSAASGGGGDGMGAEESLRNDVYTAASYGIWRNCRDWWSKRVAPSPSPTGWDTTRFSGLLSTIALPLLSTSLRFFDRSLAQLSSAQLSSGWLVGHVCVMEMEIECGHGGDVNATDHTGQTALHWSAVRGAIQVAELLLQEGARVSAADMNGYQTTHVAAQYGQTAFLYHIVSKWNADPDVPDNDGRSPLHWAAYKGFADSIRLLLFLDAHRGRQDKEGCTPLHWAAIRGNLEASTVLVQAGKKEDLMVTDNTGLTPAQLASDKNHRQVAFFLVATKMPKMTAAAGLLAWFGVLLASVGLVMFYRCSSKDPGYIRMNMHDTQDTKDDEPLLKIEINNPALLAGNWSQLCATCKIVRPLRAKHCSTCDHCVEQFDHHCPWVSNCIGKKNKRDFFVFLVLEVSAMLVTGGVCLTRVLTDPLAPQSFGAWIQYVANNHTGAISFLIADFFLFFGVFTLTVVQASQISRNITTNEMANALRYNYLRGPGGRFRNPYDHGIKKNCSDFLINGYNEDIECIEELGSSEEGIGMMHMARSSNLANGDSHNHSEYARGNGNGHHVINVNSNSNSTHSKTNHGHVHSTHCSHNNNHGKTRNDNAPLGLGLGLGRNTRSVTPSS

SEQ ID NO: 116989 - protein, 169 aa, Glycine max
  Coding DNA Sequence Number=SeqID_25304
  Homolog annotation: Hit_ID=A5AFS9; Match level="QueryCoverage=71%, HitCoverage=39%, E-value=6e-44, Identity=72%"; Hit description =Putative uncharacterized protein
MVSDGVVDNPHSKVEEIQEFDGHRDSDTGRAKKDKKKRKKEEGEGCNQEEVYIISSVDDDCSKGMKKWIMEYHQSRPGLDVLQNQIDDFITAHEAKLEEEREEKEALAAEGGWTVVVHHKGRKKTTDSESGIAVGSVAQAAVENKMTKKKHKEVGLDFYRFQRKEAQRN

SEQ ID NO: 116990 - protein, 193 aa, Glycine max
  Coding DNA Sequence Number=SeqID_25305
  Gene Ontology: Mol. function=protein binding; Cellular component =cytoskeleton; Biological process=regulation of actin filament polymerization
  Homolog annotation: Hit_ID=A7QTM3; Match level="QueryCoverage=65%, HitCoverage=69%, E-value=2e-52, Identity=81%"; Hit description =Chromosome chr11 scaffold_170, whole genome shotgun sequence
  Pfam annotation: Domain name=P21-Arc; Domain location=16-175; Score =220.5; E_value=4e-63; Accession=PF04062.5; Description=P21-ARC (ARP23 complex 21 kDa subunit)
MIIVVVVVVVMHGKVYHSSFVNEDGVSRACGCSLLPLKSHIKGPAPVSDQDRTDIVDEAITFFRANVFFRNFDIKSPADKLLIYLTFYINVALKRLEGCRTLAEGTKAIINLGLEKVPVPGESGFPFPGLFPLPQSHKEADKKLYHCLIVFNFEYTPNKECYSLAKTEPFLVTSLHYQFSESKDAGNSRHEAR

SEQ ID NO: 116991 - protein, 99 aa, Glycine max
  Coding DNA Sequence Number=SeqID_25306
  Homolog annotation: Hit_ID=A5C0F5; Match level="QueryCoverage=80%, HitCoverage=12%, E-value=3e-08, Identity=40%"; Hit description =Putative uncharacterized protein
MGDVALHLSIRVDGRVVTGPIFLHWDELCDELLGEVPPENARKGVALKLTWFLSILRAPLPEEPTIHQLQCKCRAYIMYMIGAMDLVSHVFYCTKSPTI

SEQ ID NO: 116992 - protein, 1084 aa, Glycine max
  Coding DNA Sequence Number=SeqID_25307
  Gene Ontology: Mol. function=transferase activity, transferring glycosyl groups; Cellular component=cytoplasm; Biological process =sucrose metabolic process
  Homolog annotation: Hit_ID=Q43876; Match level="QueryCoverage=100%, HitCoverage=100%, E-value=0.0, Identity=83%"; Hit description =Sucrose-phosphate synthase
  Pfam annotation: Domain name=Glycos_transf_1; Domain location=491 -674; Score=73.3; E_value=7.8e-19; Accession=PF00534.11; Description =Glycosyl transferases group 1
  Pfam annotation: Domain name=S6PP; Domain location=802-1049; Score= -79.7; E_value=4.4e-05; Accession=PF05116.4; Description=Sucrose-6F -phosphate phosphohydrolase
  Pfam module annotation: Pfam domain module=Glycos_transf_1::S6PP; Domain location=491-674::802-1049
MAGNDWLNSYLEAILDVGPGLDDAKSSLLLRERGRFSPTRYFVQEVIGFDETDLYRSWVRVPSHTTLSFLLSSFIPSLPLISFLQASSTRSPQERNTRLENMCWRIWNLARQKKQLESETALRVNKRRLERERGRREATADMSEDLSEGEKGDPLSDLSAHGGVGDFNRSRLPRISSADAMETWANSQKGKKLYIVLISIHGLIRGENMELGRDSDTGGQVKYVVELARALGSMPGVYRVDLLTRQVSAPDVDWSYGEPTEMLSPRDTDDFGDDTGESSGSYIVRIPFGPRDKYIPKELLWPYIPEFVDGALNHIIQMSKSLGEQIGSGHAVWPVAIHGHYADAGDSAALLSGALNVPMLFTGHSLGRDKLEQLLKQGRLSKDEINTTYKIMRRIEAEELALDGSEIVITSTRQEIEEQWRLYDGFDPVLERKLRARIRRNVSCYGRFMPRMATIPPGMEFHHIVPHDGDIEGEPEGNLDHPAPQDPPIWSEIMRFFTNPRKPMILALARPDPKKNITTLVKAFGECRPLQELANLTLIMGNRDGIDEMSSTNASVLLSVLKLIDKYDLYGQVAYPKHHKQYDVPDIYRLAAKTKGVFINPAFIEPFGLTLIEAAAHGLPIVATKNGGPVDIHRVLDNGLLVDPHDQQSIADALLKLVSNKQLWAKCRQNGLKNIHLFSWPEHCKTYLSKIATCKPRHPQWQRSEDGGESSESDSPGDSLRDLQDLSLNLKFSLDGEKSEGSGNDNSLNSDGNAADRGAKLENAVLSWSKGISKDTRRGGATEKSDQNPNAGKFPPLRRRKHLFVIAVDCDTTSSLLETIKAIFESAGKDRAESTVGFILSTSLTISEIQSFLISGGLSPIDFDAYICNSGSDLYYPSLNPGDRPFVVDLYYHSHIEYRWGGEGLRKTLVRWADSITDKKGDNDEQIVSPAEQLSTDYCYAFKVRKPGMAPPVKELRKLLRIQALRCHPIYCQNGTRLNVIPVLASRSQALRYLYVRWGFELSKMVVFVGECGDTDYEGLLGGLHKSVILKGVGSSAISQLHNNRSYPLSDVTPLDSPNIVEATEGSSGADIQALIEKVGYLNG

SEQ ID NO: 116993 - protein, 88 aa, Glycine max
  Coding DNA Sequence Number=SeqID_25308
MTWHDTWMCILRDVTSFDDNKTRREKTRGKQSGGEKSRERREEEEEKKPEKSKDDKESKEESTPPKIVQGTTSAMHEHFKHDFLHLLS

SEQ ID NO: 116994 - protein, 165 aa, Glycine max
  Coding DNA Sequence Number=SeqID_25309
  Homolog annotation: Hit_ID=A5B846; Match level="QueryCoverage=32%, HitCoverage=34%, E-value=9e-11, Identity=55%"; Hit description =Putative uncharacterized protein
MECSRCSISALLFPLFFVVLSFIFFSPFKEQNHLTQFALAPPLVLSTIKNLNNHTNITSPSPSPQPPPLELLSNFTPANDTYMYSGTVQIQDLTSLEKIEESLAQARASIQESILSRNYTSQRREIFVPKGSIYRNPHAFLQLSKLNSKFLSHLQLIHLFNNYCN

SEQ ID NO: 116995 - protein, 134 aa, Glycine max
  Coding DNA Sequence Number=SeqID_25310
  Gene Ontology: Mol. function=protein binding
  Homolog annotation: Hit_ID=A7QZ66; Match level="QueryCoverage=99%, HitCoverage=15%, E-value=3e-15, Identity=38%"; Hit description =Chromosome undetermined scaffold_265, whole genome shotgun sequence
  Pfam annotation: Domain name=LRR_1; Domain location=115-134; Score =3.4; E_value=73; Accession=PF00560.24; Description=Leucine Rich Repeat
  Pfam annotation: Domain name=LRR_1; Domain location=27-44; Score=3.2; E_value=80; Accession=PF00560.24; Description=Leucine Rich Repeat
  Pfam annotation: Domain name=LRR_1; Domain location=3-25; Score=10.1; E_value=4.1; Accession=PF00560.24; Description=Leucine Rich Repeat
  Pfam annotation: Domain name=LRR_1; Domain location=52-73; Score=6.4; E_value=20; Accession=PF00560.24; Description=Leucine Rich Repeat
  Pfam annotation: Domain name=LRR_1; Domain location=89-113; Score =6.0; E_value=24; Accession=PF00560.24; Description=Leucine Rich Repeat
  Pfam module annotation: Pfam domain module=LRR_1::LRR_1::LRR_1::LRR _1::LRR_1; Domain location=115-134::27-44::3-25::52-73::89-113
MESLRNLDLSLSGFMGLIPHQLGNLLNLQDLNLGYNYAFQIDNLNWISRLSSLEYLDLSGSDLHKQELHLKSCQIDNLGPPKGKTNFTHLQVLNLSKSNNNFTCPIPSPFANLSSLRTLNLAHIRLNGTIPKSY

SEQ ID NO: 116996 - protein, 68 aa, Glycine max
  Coding DNA Sequence Number=SeqID_25311
MVQKLRKGKQAVSTPPGTLRYVPPEAGHVDVGEGGRSAIRACEEVSQRCAFSRQSAGKGGRRRRVICE

SEQ ID NO: 116997 - protein, 78 aa, Glycine max
  Coding DNA Sequence Number=SeqID_25312
MSSWKISSYFQDNALDICIIGYKHLRVYQCKTRKRMNLTCENVLKCEEQKEQINAKNMERVEKASMKGMYHGGGAISE

SEQ ID NO: 116998 - protein, 779 aa, Glycine max
  Coding DNA Sequence Number=SeqID_25313
  Gene Ontology: Mol. function=potassium ion transmembrane transporter activity; Cellular component=membrane; Biological process=potassium ion transport
  Homolog annotation: Hit_ID=A7Q2E3; Match level="QueryCoverage=98%, HitCoverage=94%, E-value=0.0, Identity=76%"; Hit description =Chromosome chr1 scaffold_46, whole genome shotgun sequence
  Pfam annotation: Domain name=K_trans; Domain location=22-779; Score =1555.8; E_value=0; Accession=PF02705.7; Description=K+ potassium transporter
MDLESVIHRNTIKEESWKTVLTLAYQSLGVVYGDLSTSPLYVYKSAFAEDIQHSDTNEEIYGVLSFVFWTLTLIPLLKYVFIVLRADDNGEGGTFALYSLLCRHARVSLLPNTQLADEHLTEYTMDNGTVPVNRKNVGLGLKNLLEKHRVLQRVLLVLALIGTCMVIGDGVLTPAISVFSAVSGLELSMSKEQHRYVEVPVACVILIFLFALQHYGTHRVGSLFAPVVLTWLLCISAIGVYNIFHWNPHVYEALSPYYMFKFLKKTQKGGWMSLGGILLCITGSEAMYADLGHFSQLSIKIAFTFLVYPSLILAYMGQAAYLSRHHSLESDYRIGFYVSVPVKLRWPVLAIAILQAVVGSQAVITGTFSIIKQCSAMGCFPKVKIIHTSSKMHGQIYIPEINWSLMLLCLAITVGFRDTKRMGNAAGLAVITVMLVTTCLMSLAIVLCWHKNILLAVCFIVFFGSIEALYFSASLIKFLEGAWVPIALSLIFLIAMYVWHYGTLKKYEFDVHNKVPINWLLSLGPSLGIVRVKGIGLIHTELVSGIPAIFSHFVTNLPAFHQVVIFLCIKSVQVPHVRPEERFLVGRVGPKEYRLYRCIARYGYHDIHKDDIEFERDLICSIAEFIRSDASEYGLGFGSFEEDTKMTVVGTSASNLEGSIRMTEDDDQVDSQMEGPSELMEVKSSPEKVRKRVRFVVPDSPQIDLDAREELLELMEAKEAGMAFILSHSYVRAKSGSSWLKKVVINYGYDFLRRNSRGPSYALSIPHASTLEVGMIYHV

SEQ ID NO: 116999 - protein, 69 aa, Glycine max
  Coding DNA Sequence Number=SeqID_25314
MCYKYALDVVSRTCSNRKERRVFKKEFPGSKEYLRSTKLRQERGLRAIGQFELVYGRVEVEAARILDLA

SEQ ID NO: 117000 - protein, 45 aa, Glycine max
  Coding DNA Sequence Number=SeqID_25315
MTIGLQMQSNPARALDRRLQVDWARDPREDPRVLMSLRVDFEPIG

SEQ ID NO: 117001 - protein, 64 aa, Glycine max
  Coding DNA Sequence Number=SeqID_25316
MDEERTKNDHEIVHRNEIKGGDCTTACPGELLASSRSNLARPSELSSPRRASYFSLKLSSGPRG

SEQ ID NO: 117002 - protein, 67 aa, Glycine max
  Coding DNA Sequence Number=SeqID_25317
MPQNVLYDAIGYINGGAPVAFCFLSAVPPCSATDGGGCGNRQKAPPGHQRWQSVAVPAARNHHTRRA

SEQ ID NO: 117003 - protein, 143 aa, Glycine max
  Coding DNA Sequence Number=SeqID_25318
MLEKPSPLRLILWRIKTFPKGMLEVVSNPWRFTVGNWLCDSDLVSPTGIEWVLTEKDLLDDSYSDLEASIFDEKEFLLLKVIPTFPELSCLICSMVGAGRGIDGVALSMTHLTGRVTSSHFIFFGRETLAFVISVINKVVSPL

SEQ ID NO: 117004 - protein, 157 aa, Glycine max
  Coding DNA Sequence Number=SeqID_25319
  Pfam annotation: Domain name=zf-CCHC; Domain location=90-107; Score =27.7; E_value=4.3e-05; Accession=PF00098.14; Description=Zinc knuckle
SYGNSWIGQQYFLLVAVALWNFTDRVTLLPFDFWRVSGLTYCARKGAEYLEAANQRLHVIKFNKFLKVRGNQRRPNFKSKRRTKTSSITPKCFECNQPGHLRVDCPIFKKKMEKSEKKNFSEKKLKKAYITWDENDMESSEDSENEEINLCLMAKIL

SEQ ID NO: 117005 - protein, 136 aa, Glycine max
  Coding DNA Sequence Number=SeqID_25320
MASVRESHNFSVSDDKFPKQVRVGGHLIKFDVNSLNIFLETPVVVEQGESLPFYSRFARLRPDPQELAARLCIPGRGFVLNAEGLPWKLLRKDLTTLAQTWSVLSYSNLALTSHTSDLNLERAQLVYGLVMKMNTT

SEQ ID NO: 117006 - protein, 122 aa, Glycine max
  Coding DNA Sequence Number=SeqID_25321
MYDSEFLFRLMACIANKIKTIDGSKETLKLFLRISELWFVGTPGRSEQAEMQLVRYFYYSQGDQIHVVCKQDQLKTWKMDLKEGCTYMMHNFRVCKNDGQFRVCDHPYKLTYIGVTVVRQCE

SEQ ID NO: 117007 - protein, 98 aa, Glycine max
  Coding DNA Sequence Number=SeqID_25322
STLEDPQQPRDDSRFVVGVGAGRSGSEAQVVMQVRGERSSPLGHALCTTKRRASEGRKYPKRTCVKQPSITLDRSRMDDLQLKVLRIDISYDVMEILV

SEQ ID NO: 117008 - protein, 327 aa, Glycine max
  Coding DNA Sequence Number=SeqID_25323
MRCEESVPQGAHGVVVQVTGKVADSWAAVPTGSCPWQRLPAGLDRCGRMIQQLPVQVVAQWQRREGEWLRYVVGCGRGHAQLCNEPRHDPVRGIELAQLCMDMREPAHYVHTCGLQRVKLRQYVTCGFPPAEVLKALSDVDELHGKLGGYNFIALDRLLVPARFLQGETQQVVGLKKGGIQRERALQAVDSSHLLARALLEVTKQHPLPCLRFCRRDCLACGFKRLSRTMAVTQADRKRGACRLPGGGRGMDLLEQYCGFLCVAELHHAKGCVVAKNIVRRIQQQCSPVVREGVIQPSCMVITASLSGLIHVLPPTPSPCLPRDTSE

SEQ ID NO: 117009 - protein, 133 aa, Glycine max
  Coding DNA Sequence Number=SeqID_25324
MELACEASIEAGSLIFNGDSPSWRCSGRKRRRGEGRHHPQGNKPWKKELHHKECALDKKLEKDALMEEKKERRGEHKIEGIKEGEKWNFEVCLIRLSFIKVTTSVTHASIYRLGSFLEKTSLRSFFEKTSFRS

SEQ ID NO: 117010 - protein, 83 aa, Glycine max
  Coding DNA Sequence Number=SeqID_25325
MEVDEPWLGFMATIELSSGVHHWKCGRADFVVDLGIVFVDNWAVGKDKVGGKFGHIGMAVTAWVSPSFSPSSFAPVFSFVQAR

SEQ ID NO: 117011 - protein, 58 aa, Glycine max
  Coding DNA Sequence Number=SeqID_25326
MRTLSPMKDKGEDFESYERVFPFPFKNFDYSAQQENIRLRDQSCAPLKDGNELSHFGM

SEQ ID NO: 117012 - protein, 24 aa, Glycine max
  Coding DNA Sequence Number=SeqID_25327
MVRCQDEVGGRNPSRYLGTDTSRG

SEQ ID NO: 117013 - protein, 155 aa, Glycine max
  Coding DNA Sequence Number=SeqID_25328
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=43%, HitCoverage=65%, E-value=2e-33, Identity=100%"; Hit description=LacZ protein
MARSVFALCPYLGTYGIISRGLLITNFPTIYNSHGRSLEVSSLKIIILWRYGIPATTHYGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 117014 - protein, 121 aa, Glycine max
  Coding DNA Sequence Number=SeqID_25329
GQGDALQAAGAPPPHQAGPAGSFDTEQYLRHLVRQQAANHRAHVQTHDYFYRLSLSLQSQGLTSFPCPTPDQFRAEVAWPGDWPEARAGGAPAEAPDEADEAREDEEITDLLDFLGGSGAT

SEQ ID NO: 117015 - protein, 133 aa, Glycine max
  Coding DNA Sequence Number=SeqID_25330
MSEVEEVQEQMKADMEAMKEQMATMMEAMMSMKKIMEANAVAVAATSVVAKVNPMPSFDINQMKHPTSDMVGKDLGSTGGPHYAQIQNKHAFPPYGLPPNYAPPNVAYIPNKDVNNSAPILIESRQPHHAHVS

SEQ ID NO: 117016 - protein, 18 aa, Glycine max
  Coding DNA Sequence Number=SeqID_25331
MTVDTSFVHLTAAVASLV

SEQ ID NO: 117017 - protein, 180 aa, Glycine max
  Coding DNA Sequence Number=SeqID_25332
  Gene Ontology: Mol. function=motor activity; Cellular component=cell projection
  Homolog annotation: Hit_ID=UPI00006A2D9E; Match level="QueryCoverage =89%, HitCoverage=85%, E-value=2e-16, Identity=17%"; Hit description =UPI00006A2D9E related cluster
MTGTSTHTFKGLHALAFRGLHVLAFKGLHALTFRGLHALAFRGLHALAFKRLHVLAIRGLHALAFRGLHVLAFRGLHVLTFRGLHVLTFRGLHALTFKGLHALAFRGLHALAFKRLHVLAIRGLHALAFRGLHVLAFRGLHILTFRGLHVLAFRGLHALGHWAWSAIYNIWFASKQLTTV

SEQ ID NO: 117018 - protein, 43 aa, Glycine max
  Coding DNA Sequence Number=SeqID_25333
MDIDSYRETIFGSCSPQAKDVVLASFISMGLGDLKLPKSSLLS

SEQ ID NO: 117019 - protein, 187 aa, Glycine max
  Coding DNA Sequence Number=SeqID_25334
  Gene Ontology: Mol. function=NAD(P)+ transhydrogenase (AB-specific) activity; Cellular component=1-2nm peptidoglycan-based cell wall; Biological process=electron transport
  Homolog annotation: Hit_ID=P0AB69; Match level="QueryCoverage=100%, HitCoverage=40%, E-value=3e-82, Identity=84%"; Hit description =NAD(P) transhydrogenase subunit beta
  Pfam annotation: Domain name=DUF554; Domain location=1-176; Score= -143.7; E_value=0.082; Accession=PF04474.3; Description=Protein of unknown function (DUF554)
  Pfam annotation: Domain name=NicO; Domain location=2-187; Score= -90.8; E_value=0.081; Accession=PF03824.7; Description=High-affinity nickel-transport protein
  Pfam annotation: Domain name=PNTB; Domain location=4-187; Score= -31.0; E_value=1.1e-13; Accession=PF02233.7; Description=NAD(P) transhydrogenase beta subunit
  Pfam module annotation: Pfam domain module=DUF554::NicO::PNTB; Domain location=1-176::2-187::4-187
MSGGLVTAAYIVAAILFIFSLAGLSKHETSQQGNNFGIAGMAIALIATIFGPDTGNVAWILVAMIIGGAIGIRLAKRVEMTEMPELVAILHSFVGLAAVLVGFNSYLYHTPGLEPILVNIHLTEVFLGIFIGAVTFTGSIVAFGKLRGKISSKPLMLPNRHKLNLAALVVSFVLLVVFVRTESVGLQ

SEQ ID NO: 117020 - protein, 676 aa, Glycine max
  Coding DNA Sequence Number=SeqID_25335
  Homolog annotation: Hit_ID=A5B073; Match level="QueryCoverage=71%, HitCoverage=66%, E-value=3e-63, Identity=36%"; Hit description =Putative uncharacterized protein
MDLWVVAAAAGAGYLAKYWNRISKNGDGLCHVASEDSCFENPGPPSCSSPLAKQMRRDELGKDFCYDGRALEGKSSDLNTMNGLLTGEVASTRGIDGEKLQHFWNYNKHDVLSISNLAMPLSTYDDSFKDVDDENEQSSGFVGDHGFLFPNSSAEVVPIHNSSGHKTFLKMKHLSGCVNRPLSSLESCFMAQLYKEHAETEEYVFSSLSSLSTATRSFLVSNGSQIINRANNNLFSTSIESKEYKLQKEVGQVKDENVFGVPSLPKIISVNDTKEKFNAVIVRSRRSSSSDNVSSGKLIHTQQFDKTFLFSLGISFGMITSIMANKREIVKLRELLKQNENLVQDLQEELEMKDSMTVKELQNENYGSQDTCDHSSYDKELNEFSPEKHVDNSPRIDSKESYHQKVEQSSESMSKIEAELEAELERLGLDMNASSLEGKLSELVELDPEFVADFAQGELRVDMVSGKDSVYPKSNEDAGDATPLPVNYAVLPHELSLRLHEVIQSQLEQRMKELEIALENSQRKVRLLESKQENCLQKASSFSKENDDCDLMSQPLILNLSGEALDAYNEAYEELIKINDSEENSPLGIHDHQEDSYANDWHALGVQHGGANGSSKVTMLEGSIYELDGAEDETCGFDDTEVEQQLIRQIVERTKKGSPVFRNAQRILYSMDEDEQ

SEQ ID NO: 117021 - protein, 55 aa, Glycine max
  Coding DNA Sequence Number=SeqID_25336
MHKCPMCGISLYKVKDDDECGGDESTKKGPPAKMLWYLPIIPRWEKLQWNALPSG

SEQ ID NO: 117022 - protein, 204 aa, Glycine max
  Coding DNA Sequence Number=SeqID_25337
EEGQALRAELKQAQTVKERFRSAALKIRKDNAKLRDVNIATTKGLEQETKRARREEHDRKKFQGALWGSNSELKLRREERDQSRVDSLVLKDELKVFLRSKRSLSQRLCEIETNMLAIVSKYQEELNLATAHERKVAGEYARVYAEKEARGRVIDSLHQEATMWMDRFALTLKESQELPRLLAKAKQWRTPTPPPRRSTDFLAI

SEQ ID NO: 117023 - protein, 96 aa, Glycine max
  Coding DNA Sequence Number=SeqID_25338
MELIASLSQYYDQPLRCFTFEDFQLVPTVKEFEEILGCTLGGRKPYLFSGFYPSTARVAKVVKISAQELNQVGPSIRYKVTARASKKEGELGPTLG

SEQ ID NO: 117024 - protein, 198 aa, Glycine max
  Coding DNA Sequence Number=SeqID_25339
  Gene Ontology: Mol. function=hydrolase activity
  Homolog annotation: Hit_ID=A9CLE5; Match level="QueryCoverage=91%, HitCoverage=60%, E-value=5e-74, Identity=76%"; Hit description =Arylester hydrolase
MATLGRRSRCSLRGSGATNPVLVGWSLGGVVLSNYLANHGDAGIGGLLYVDGVIELKPDLITPHPEVYAGLASEDLRTHLDMVRTFLALCFATQPENATFERLLSNAAVASWLMTRTVPSMTVQAKEGLAKAKKPVLLIYGGKDNLVRPQPSIERAKSFNGAIKSEIYDNSGHAPFLEEASRFNKDLARFAASVADGK

SEQ ID NO: 117025 - protein, 171 aa, Glycine max
  Coding DNA Sequence Number=SeqID_25340
  Homolog annotation: Hit_ID=Q6WAY6; Match level="QueryCoverage=46%, HitCoverage=13%, E-value=3e-13, Identity=46%"; Hit description =Putative uncharacterized protein
MFGGKSKNLGRCEKSSTRIVCYTPTLYVWLVLHLFRQEVRHACPLESHHSCTKKGGANWDRLLANEEEASINRFPQWKEGRTWVLISCRGFPNVPLIGTRGCISYNPVLAIRKLGYPIRGAPLEEELAPIISRGFNKTNVETLQKVRKAWEVVQKKDKELRGSNNGPIGGY

SEQ ID NO: 117026 - protein, 31 aa, Glycine max
  Coding DNA Sequence Number=SeqID_25341
AEDEESVVHKKKAAEKKGTEGKRKDVRGESN

SEQ ID NO: 117027 - protein, 86 aa, Glycine max
  Coding DNA Sequence Number=SeqID_25342
MLGGHVWQDIVGVVTDLIDVKTVNPPHRMTVRLRDNNNCDILMTVWEDYAIQLHDAIDKNLLLQEPLVVMLTLGKIKDATGASGVN

SEQ ID NO: 117028 - protein, 165 aa, Glycine max
  Coding DNA Sequence Number=SeqID_25343
MSSPSEGYTPSPIRGLHVLTFEGLHALTFRGLHVLVNRELYALTLRGLHVLANRELHALTLRGLHVLANRGLHALTSRGLHILALRALHALTFRGLCVLIFSVLHIRTLREFKGQLCEHNQRGRLSHSYYAYRGKISPVPLQRDECGSCAPNMTHSYTDIDDIAT

SEQ ID NO: 117029 - protein, 162 aa, Glycine max
  Coding DNA Sequence Number=SeqID_25344
STLEDPTLVRDFSAQSLKIVQRVCKAWESPLRKDKELRGIRNGIISGYHEWLRVHTRGLDWLSKLKIINEGNFEAPEEDEEVEALKSEQGKARLTKEKFKSAATNIWKECVELREENAATARALEQEIKRARKEEHGRDKFRGALWGSNNELKLRREERDQS

SEQ ID NO: 117030 - protein, 186 aa, Glycine max
  Coding DNA Sequence Number=SeqID_25345
  Gene Ontology: Mol. function=transporter activity; Cellular component= membrane; Biological process=transport
  Homolog annotation: Hit_ID=Q48CV0; Match level="QueryCoverage=41%, HitCoverage=30%, E-value=9e-28, Identity=70%"; Hit description =Formate transporter
  Pfam annotation: Domain name=Form_Nir_trans; Domain location=4-156; Score=-103.7; E_value=0.001; Accession=PF01226.8; Description =Formatenitrite transporter
MAGRVYRPPASCSICTLLTSCLLNGARLPLPRCGGIPGRTDSDRAGGWRVADRQHDDAAPLPGSRAALAVSACCVTGFGKDMVGKIFGMWFPVMAFVAIGFQHVVANMFIVPAAIFAGQMSWAEFAPNVVAVFLGNGVGGAIFVGLTYFLAFRPAQAAGQHREKGMAHSRRARAGNGLQSADGGIL

SEQ ID NO: 117031 - protein, 142 aa, Glycine max
  Coding DNA Sequence Number=SeqID_25346
MSWKRSHYFSMPHQDIYSSQDEATISPSSSESEEAKKEESSEEIYPHEEGQPLMVKEECKEVSVSSKRLAKKKSHFEIKTNIKETSPLRQPPHLLLCKKTLVSTATPLGLEVIPQVKELLDEDLVHKSLNPCALLVPKIGTH

SEQ ID NO: 117032 - protein, 116 aa, Glycine max
  Coding DNA Sequence Number=SeqID_25347
MKREKHASYSSHNSCKSLSEELRDYYEGRHRSHLRPHSHRRENERKPQEANINIPYSHGKDNVEAYLDWEIRVEQKLKRKSTLKYYSSHSHPKKDQGLGILEQEHLLSPKMIRGIQ

SEQ ID NO: 117033 - protein, 84 aa, Glycine max
  Coding DNA Sequence Number=SeqID_25348
MALERTWMPSVLQEQVRNQPNTESGQATDDPCATLLAPSARYAVSSLFYAVQTSCGILDHSCNSAQRGETPEEKIWFSSPERTS

SEQ ID NO: 117034 - protein, 131 aa, Glycine max
  Coding DNA Sequence Number=SeqID_25349
  Homolog annotation: Hit_ID=Q8S5R3; Match level="QueryCoverage=83%, HitCoverage=6%, E-value=2e-08, Identity=33%"; Hit description =Putative copia-type pol polyprotein
  Pfam annotation: Domain name=zf-CCHC; Domain location=74-91; Score =12.2; E_value=0.022; Accession=PF00098.14; Description=Zinc knuckle
MEIMRLHQHEENDKKKKGIALKASSSSIHEENDKEDDDFSLFVKRFNKFLRKKGNRRRSNFNPKKKGEDSSLVPKCYECDQPRHLRCDCLSLKEEWKNLRQKLSKIRKKRKHISLGKIMTWIHQVIQKTKS

SEQ ID NO: 117035 - protein, 96 aa, Glycine max
  Coding DNA Sequence Number=SeqID_25350
  Subcellular localization annotation: CTP_CleavageSite=49; ConfidenceScore=5.16e-01
MHTRSFTNPQFLKIGLTHNVPFAGERGRGSRVRFPKEERCTESPPTFICGKRRENRRKPVKMKILSSGVVFMPEEGRQKRGICSYVPSFGEEIRPM

SEQ ID NO: 117036 - protein, 40 aa, Glycine max
  Coding DNA Sequence Number=SeqID_25351
DDVPKGKLYKASFRVLPERSTSPTLVKGHPDANLPRKGIG

SEQ ID NO: 117037 - protein, 98 aa, Glycine max
  Coding DNA Sequence Number=SeqID_25352
MERIVKLAQVSCYFILKQPCSPRRAELAQASYCFILKQPCSPKHAGYFSMKLFGGPSEPDASLGKPVGSKDKDTSFVQAIFLFDRAIGESQGSDTEKT

SEQ ID NO: 117038 - protein, 317 aa, Glycine max
  Coding DNA Sequence Number=SeqID_25353
  Homolog annotation: Hit_ID=A5AFX7; Match level="QueryCoverage=40%, HitCoverage=56%, E-value=9e-17, Identity=46%"; Hit description =Putative uncharacterized protein
MEPFPSSAFKVLILNICYYHQDLHRRPLRPGSRPGFCSDRRALLLIGAWSLPRRPVSLRASTRVSSGFAPLRHSSPSFGPDRYALTRTFTEDQGRSAVQPTGGSHQSASLAPYGFTRPLNSHTCQTPWSVFQDGPNRGAHRPTPGARRCRGTPRARAAIHNRDDDVSTSISTARAWATIAIPRRSMSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFP

SEQ ID NO: 117039 - protein, 59 aa, Glycine max
  Coding DNA Sequence Number=SeqID_25354
MAKRCGMTIICRRMPSDSIVSGWQKVKRQNFQLIRATYAFRMKNNVSTGEGEYADEIFS

SEQ ID NO: 117040 - protein, 96 aa, Glycine max
  Coding DNA Sequence Number=SeqID_25355
MAKFNPYIVLKFYANAWPTEEGVRDMRSWVRGQWIPFDADAISQFLGYPLVLEEGQKCEYGQRRNREASVNYAHQHDHPDPDMDDVAAQQHPAQRS

SEQ ID NO: 117041 - protein, 76 aa, Glycine max
  Coding DNA Sequence Number=SeqID_25356
MLDDVVNFVGEENVVQLAFMNLKASLMSMFSSKEWKTSKFGTSQEGRKVQNVALDSQFWKNVTMCLKVATPLMVVL

SEQ ID NO: 117042 - protein, 124 aa, Glycine max
  Coding DNA Sequence Number=SeqID_25357
  Homolog annotation: Hit_ID=A7Q8B9; Match level="QueryCoverage=45%, HitCoverage=10%, E-value=4e-12, Identity=64%"; Hit description =Chromosome chr14 scaffold_63, whole genome shotgun sequence
MSNCPGGNDSILYLTGGSLFLSNGKEDRHMPLKDSPETKTGCQERRGGRMGSWSDLGFLIWDPGEEDQAGPCEQLDALSPFNPFERNVAKGKRIPWTDPHRLHPVGTTRSPQGRLRHPGVADRP

SEQ ID NO: 117043 - protein, 63 aa, Glycine max
  Coding DNA Sequence Number=SeqID_25358
MGQPQGPQVKGIPLCHINKSFVSTSWMCEGRVAMIHDEVPQEQPNWVRLNPIARPRLQGFPPV

SEQ ID NO: 117044 - protein, 79 aa, Glycine max
  Coding DNA Sequence Number=SeqID_25359
LTAWEFFVPTHWRVHLLGGCYTENKRGYISCGSVQVEGTSTWFFKENKGGYIPCGSLASKEFYKVERNLKNRRLLGDWM

SEQ ID NO: 117045 - protein, 126 aa, Glycine max
  Coding DNA Sequence Number=SeqID_25360
MGTRGCISYNLVLSIRQLSYPMRGTPLEEELAPVISRGFNKTNVETLQKVCKAWEVVQKKEKEIRGSNNGPIDGYRKWLNGSQDLPRLLAKAKAMVNTYSAPEVIHRLLGYCQHMIDLMAHIIRNR

SEQ ID NO: 117046 - protein, 309 aa, Glycine max
  Coding DNA Sequence Number=SeqID_25361
  Homolog annotation: Hit_ID=A9CHH8; Match level="QueryCoverage=23%, HitCoverage=56%, E-value=1e-33, Identity=94%"; Hit description =Putative uncharacterized protein
MVGEGEWRDYAIDHLKEKAVFSVFKRSGEMPLFRIEKNPKLGAKQGAYCVVNTDGRILKRGHELPQVLKVFDKEQHALTDIVVAVPEELQEEGEEVDEVEIERQRTHDGLAASDGNIVSIEIHFLDLLGVVGGQACEDQHANRGNRELQRGGCKEDVDDRSDDQTEQAHDQERAHARQVLLGRVTVKRERTERSRGHEEGLHDALAGVDQEDRGERNTHQRGVNPEGRLRSGNAHVLDAEAKEEDQCQRSEHHDPTKRRREKQLLDSRIGSGERISAERGNAGDDQSQRHKVVNLEHIGAKTFVDQRTR

SEQ ID NO: 117047 - protein, 89 aa, Glycine max
  Coding DNA Sequence Number=SeqID_25362
  Subcellular localization annotation: CTP_CleavageSite=40; ConfidenceScore=5.11e-01
MKNCTKQSLRMAPNSKVEDTCTKTQFMELRKRLRMQNCTSQSLRMAPNSEGGGHMNKTQFMGLRKRVREWRIALSNHYAWLQTQRVEDT

SEQ ID NO: 117048 - protein, 101 aa, Glycine max
  Coding DNA Sequence Number=SeqID_25363
MRPDVRPGGGLSQLALICCTLSVALFLLIRVQHTCMWSTLDAFRDLAHSGGYAWGFAALDHHPTACGVLDATSGDVPTCFPVVDVEGAHEGHHRSTLQGTL

SEQ ID NO: 117049 - protein, 186 aa, Glycine max
  Coding DNA Sequence Number=SeqID_25364
  Homolog annotation: Hit_ID=Q6WAY4; Match level="QueryCoverage=76%, HitCoverage=28%, E-value=2e-12, Identity=32%"; Hit description =Putative uncharacterized protein
MRTNQTGKRFYQVKVKSPGTTSIKELGRLMEPLQMQAFRKTYGKILELTIVEVSIEAIAALTQYYDQPLRCFTFGDFQYRCPLGGRKPYLSSGCLPSLSRIATVVKDSARGLDRIKQTRNGIAGLPQKYLEDKARGMANQGDWVPFMDVLALLIFGVVLFPNVDGLIDLAAIDAFLAYHHSKESPV

SEQ ID NO: 117050 - protein, 29 aa, Glycine max
  Coding DNA Sequence Number=SeqID_25365
KAPPSGVSYPNFVREPLLDDMRPFFGPCE

SEQ ID NO: 117051 - protein, 128 aa, Glycine max
  Coding DNA Sequence Number=SeqID_25366
YCTQRQAQGDAPQAAGAPPPPHQAGPAGSFDMEQYLRHVVHQEAANHRAHVRTNETLYQLSLSMQSQGFASFSCPTPDQFRAEVAWPGDWPEAQTGEAPPEAPDDGEEAHEDEEMADLLDFLGGSGAT

SEQ ID NO: 117052 - protein, 140 aa, Glycine max
  Coding DNA Sequence Number=SeqID_25367
MHYEDHIVPAGEVWIVPGQCSSDYMDWFFRISHPFMTPGHALDPLHHGHAPQPRVVPQAPQTDIPRVPEPGASSTSAKEPRHATEVCDDIAERLERHLSLGGVTPGSSTHEVIEECLRLARSVTQDHLVYVRSRRRRRTD

SEQ ID NO: 117053 - protein, 178 aa, Glycine max
  Coding DNA Sequence Number=SeqID_25368
MLNKAQIRLMSAAAERMLKQRGLGFNPKSAGRHYDRICSCQKQDWSHDVTTSVSTSWNAAEKEQKKEVEVSLLWQVWSHKALLLSSTWPSTSWNSKQQQQKEDDVGSKTQGCQSCCSFTLSRTQAEKEEVLDSLAFVPAMTGIKESILELMKVLTPMLVMCIWRCSTKEKEWNGKASS

SEQ ID NO: 117054 - protein, 83 aa, Glycine max
  Coding DNA Sequence Number=SeqID_25369
MAQPPPRERTLREMAAPDFTYESLCIQYPDEDVPYVLKTGLIHLLPKFHGLARLFLILRGSGKGLAILPCSKVHHELTSREYS

SEQ ID NO: 117055 - protein, 179 aa, Glycine max
  Coding DNA Sequence Number=SeqID_25370
MEAIKEQMTMMMEAIISMRKMMEDNISTVVAASTATEMDLIHPTGFNQVNCPVSDVVGQGGEAAKNACGPHHFQVYSKHSFPSYRLPPNYTLPTFVYTFGDNIGNSAPVLIENQQPQSDHAHVSQPMGKHMKFPKTTLWPGPSTVLENERIKHMEERLCAIEGGGTCAFTDMGNFKNGG

SEQ ID NO: 117056 - protein, 70 aa, Glycine max
  Coding DNA Sequence Number=SeqID_25371
MSAKPFKLISQSLYVDEKSSPNEIKVMEACLWGFYGGWIFELQWGPLMVIFHHVDAAEDKGEEVRGGSIY

SEQ ID NO: 117057 - protein, 64 aa, Glycine max
  Coding DNA Sequence Number=SeqID_25372
MACDSLEEQASQGSFVARGRQDVLVAAIERPEHHGRVRVAGVSVMIKQYFGLARHFAIECTLAN

SEQ ID NO: 117058 - protein, 84 aa, Glycine max
  Coding DNA Sequence Number=SeqID_25373
  Homolog annotation: Hit_ID=A5B0P7; Match level="QueryCoverage=78%, HitCoverage=36%, E-value=2e-08, Identity=33%"; Hit description =Putative uncharacterized protein
MSHYRVVFGKACHLLVEIEHRAYWAVKGCNIAFDEAIEIKNKVTSKVFKVNGHQLKLFHESSQVEEAFVVDLSLILSILCDDMP

SEQ ID NO: 117059 - protein, 35 aa, Glycine max
  Coding DNA Sequence Number=SeqID_25374
LKGAVLRVLDPPGEQIREGFPPLFTVLHPFFVLQR

SEQ ID NO: 117060 - protein, 198 aa, Glycine max
  Coding DNA Sequence Number=SeqID_25375
  Subcellular localization annotation: CTP_CleavageSite=78; ConfidenceScore=5.09e-01
AMMSVKKIMEANAVAIAATSVVAKVNPTSPSGLKQMNHPTSNMVGKDLGSTSGPHDVQIQNEHAFPSYGLPLNYTPPNVAYTPNKNVNNSTPIPIESQQPQTDHAHGKQLVVYPYKTLWRALSITHNYTSCIPQRLKTLMTMAGMGKLDHLEERLRAIEGGEDYAFANLEELFLIWSFPSSRCRTLASTRGLLAPRTI

SEQ ID NO: 117061 - protein, 267 aa, Glycine max
  Coding DNA Sequence Number=SeqID_25376
  Homolog annotation: Hit_ID=Q5XM22; Match level="QueryCoverage=42%, HitCoverage=78%, E-value=1e-24, Identity=43%"; Hit description =Resistance-like protein HAAS-2
MKSKLRQYSVMGHIKCEAEHWTITARAYQLHFLGCTFFANKSATHVHVVFLDTFRDLYQSESNAWGAASLVHMYNDLNNACKSDNIQLVVYITLLQCWIYEHFPSVAEGFTDEDYDERSPCAYHWTYTKALPASTYRKRLDRLTTANVCWMPYGAIMQLETLTRFHVFLDIFDGIPLLSYTDQRGLCGNLDLCCAWKCAPDYMEWFYMILHPFMRLTQLGDPPKHPPIVQDETYVEPDMPQYLVVAAAMEEAFAHAPSDLEQPRHAM

SEQ ID NO: 117062 - protein, 34 aa, Glycine max; identical to SEQ ID NO: 108849
  Coding DNA Sequence Number=SeqID_25377

SEQ ID NO: 117063 - protein, 79 aa, Glycine max
  Coding DNA Sequence Number=SeqID_25378
MRSWVRGQWIPLDADALSQFLGDPLVLEEGQECEFSQRRNRADGFDEEAIAQLLCTSGQDFTQTAAGRRVRIMRTSMTT

SEQ ID NO: 117064 - protein, 130 aa, Glycine max
  Coding DNA Sequence Number=SeqID_25379
MIRGDTLRLSTPFCHPEATGPMTSRDKIWSFCTLVSSRGGGPDDTRRYLTVIRTLVSSRGGGPDDTRRQILTVFRTPLSFRHSRSDGASRDKIWSFCTLCHPEAAGPMTRGDKIYGLLHPFAHSRAQSVR

SEQ ID NO: 117065 - protein, 60 aa, Glycine max
  Coding DNA Sequence Number=SeqID_25380
MDSTAMSIKPSRSDQQWSLGMKLRVNISELYEFHNDGVLNIFEWSNEGRMLTNNGPRTKL

SEQ ID NO: 117066 - protein, 82 aa, Glycine max
  Coding DNA Sequence Number=SeqID_25381
MKNERRRTVENLPEITPGNVTEAPRLGFSSRKQFSSLILSDYKEKEGDACHPARPGELGCFLQKQPPSGGTSWKAQVGLVAI

SEQ ID NO: 117067 - protein, 42 aa, Glycine max
  Coding DNA Sequence Number=SeqID_25382
MTSKELNEEPYEVKISCTVRVNSNDSSTLHYFGNPGLNRMDM

SEQ ID NO: 117068 - protein, 144 aa, Glycine max
  Coding DNA Sequence Number=SeqID_25383
  Homolog annotation: Hit_ID=Q9AVH2; Match level="QueryCoverage=38%, HitCoverage=19%, E-value=7e-20, Identity=85%"; Hit description =Putative senescence-associated protein
MARHKGLLVIWRGGTNQSDRAESQWIVAARPLCHLQYPVAYLSRLQRILPAARWELRFKASRKANPPHEGHQRHVPLGGRGPLLLVGKRTAGARVASSPDSDLKAFSHNPTHFCFAPLAFQPRAMTNCANHRFLSYLVELLLPH

SEQ ID NO: 117069 - protein, 250 aa, Glycine max
  Coding DNA Sequence Number=SeqID_25384
  Gene Ontology: Mol. function=motor activity; Cellular component=cell projection
  Homolog annotation: Hit_ID=UPI00016621D1; Match level="QueryCoverage =93%, HitCoverage=42%, E-value=2e-20, Identity=36%"; Hit description =UPI00016621D1 related cluster
TTSPCLQKATRPRFRGLHVLAIRGLHALTFRGLHVLAFRGSCTFTFRGLHVLASRGLHVLASKGLHVIAFRGQHVLAIRGLHVFTFRGLHVLTFRGLHVLAFRGLHVLTFRGLHVLAFRGLHALVFRGLHVLASRGLPVLAFRGLHVLTFRGLHALTFRGLHALAFVGFHALTFRGVHVLTVGGLHALTFREQHVLAIRGLHVLTFRGLHVLAFIGLHVLAFRKLHALAFRGLHVLTIRGLHALTFRGLH

SEQ ID NO: 117070 - protein, 136 aa, Glycine max
  Coding DNA Sequence Number=SeqID_25385
  Gene Ontology: Mol. function=chlorophyll binding; Cellular component =integral to membrane; Biological process=photosynthetic electron transport
  Homolog annotation: Hit_ID=Q2MI75; Match level="QueryCoverage=84%, HitCoverage=22%, E-value=1e-49, Identity=82%"; Hit description =Photosystem II P680 chlorophyll A apoprotein
  Pfam annotation: Domain name=PSII; Domain location=11-136; Score= -160.7; E_value=0.00047; Accession=PF00421.10; Description =Photosystem II protein
MGHWGDKGIFMGLPWYRVHTVVLNDPGRLLSVHIMHTALVAGWAGSMALYELAVFDPSDPVLDPMWRQGMFVIPFMTRLGITNSWGGWNITGGTITNPGIWSYEGVAGAHIVFSGLCFLAAIWHWGWLVLVLAHFM

SEQ ID NO: 117071 - protein, 48 aa, Glycine max
  Coding DNA Sequence Number=SeqID_25386
MEELINKTQLSPKIIPSSSRLGGSTKESHFSYSTAVILLTRTRVRDHH

SEQ ID NO: 117072 - protein, 26 aa, Glycine max
  Coding DNA Sequence Number=SeqID_25387
MTSQTERKGCCCEKEDHCETEPVPIE

SEQ ID NO: 117073 - protein, 82 aa, Glycine max
  Coding DNA Sequence Number=SeqID_25388
MALARDFCKETTHGAFCQGGVCDVNNKYTLEVHVNNLGEEVVCHFCFKSSVPLVRLTFQMFAFAGNGPEEACLKEVQEGQGS

SEQ ID NO: 117074 - protein, 21 aa, Glycine max
  Coding DNA Sequence Number=SeqID_25389
MDAKFTKSRVPRSLLELLVNW

SEQ ID NO: 117075 - protein, 141 aa, Glycine max
  Coding DNA Sequence Number=SeqID_25390
  Homolog annotation: Hit_ID=A5BGH9; Match level="QueryCoverage=62%, HitCoverage=18%, E-value=3e-07, Identity=35%"; Hit description =Putative uncharacterized protein
MTRGNPSDLQSFDPEIDRTFHRLVRHHLVPFEHPEHSVIGDFEHYNFEHSENMAQPPPRERTLREMAAPDFTYESLCIQYPDEDVPYVLKNGLIHLLPKFHGLAGENPHKHLKEFHIACSTMKPPDVQEDHIFLEGLFHIL

SEQ ID NO: 117076 - protein, 80 aa, Glycine max
  Coding DNA Sequence Number=SeqID_25391
  Homolog annotation: Hit_ID=A5BBN5; Match level="QueryCoverage=97%, HitCoverage=10%, E-value=3e-08, Identity=37%"; Hit description =Putative uncharacterized protein
MNIEERKNMLDDIAESLEQMHIHGQDSKGKGKGSNEDPPEEVKSNDELPKEWKASKDHPLDNIIGDISKGVTTRHSLKDL

SEQ ID NO: 117077 - protein, 121 aa, Glycine max
  Coding DNA Sequence Number=SeqID_25392
MCWFRIGSKIPLAIYTLGMIAKYLDVLEIPRCAHVQFLVPQNALSMHVCKFSQGDVCDSSVPLVKLTFQKFAFAGNGPKEACLKRSRKDKAAEGTSPLLSMTVTALGALYTSSASRPSGDG

SEQ ID NO: 117078 - protein, 126 aa, Glycine max
  Coding DNA Sequence Number=SeqID_25393
MTRGNPSNLQPFDPEIDRTFHRLVRHHFIPFDHPEHSITGEFVHSVIGDFEHPDFEHYNFEHSDSEHSDFEHSENMAQPPPRISYCLLHHEPPDVQEDHIFLKAFPHSLEGVAKDWLYYLAPRGIL

SEQ ID NO: 117079 - protein, 127 aa, Glycine max
  Coding DNA Sequence Number=SeqID_25394
MEKKLIDEKRKKKLEKATQSESTDTVIDPPSPIKRHVKWKLARTKETGDMTSEAAKEIVDKIDALEEQASQGYFVTHGRHDILTDAIGSRYNHQAILWIGYKDLLHCSQIPATVDATNQGPARGFDH

SEQ ID NO: 117080 - protein, 67 aa, Glycine max
  Coding DNA Sequence Number=SeqID_25395
MLLSSNVIYICVRVVMLVRMVHTLLFAAARVKSCPIGPPPISGGGPGTVKRKLLAPLTGKCKSRLSI

SEQ ID NO: 117081 - protein, 164 aa, Glycine max
  Coding DNA Sequence Number=SeqID_25396
MVGTFFLLKQQNSLEIMSEGWSNLDDLLMQFKSIVDSMQQAFKRVETQIGKLVDDMTKVVVRREEKYAEIETHQESICQINAIHHQLITKEEKDEVSIVPEYSYMATTSYFVGKDKGRLELSVEDQKISFDLFEAMKHPDMSDAYFEEEEVEQEIALSASTMVL

SEQ ID NO: 117082 - protein, 58 aa, Glycine max
  Coding DNA Sequence Number=SeqID_25397
MASYGVASPLSLPFSITLPFIFQDAKESIDEELAKAKAMADTYSPPRRSTNFSSIVSI

SEQ ID NO: 117083 - protein, 88 aa, Glycine max
  Coding DNA Sequence Number=SeqID_25398
MMTTKDDEQKAQVNQRTSQENQDQDQDSRIKNSRLKKKAYKQVSRFKIQDLKNQRSRFKNQVSRLKISRIKIKIQDSRFENQEKTQSR

SEQ ID NO: 117084 - protein, 136 aa, Glycine max
  Coding DNA Sequence Number=SeqID_25399
MWGGEQDIEVAATPEGPLSSEASSSFPTQGQSHTVLAEANIMAEEPRRVTLEDYSSSSVSQFFTSIAWPELIHNNLFHGLPNEDPYAHLATYIEICNTVRLAGVPEDAVRLSLFSFSLSREAKRWLLSFTGNSLKT

SEQ ID NO: 117085 - protein, 209 aa, Glycine max
  Coding DNA Sequence Number=SeqID_25400
MGEAEEVQEKMKADMEAMKEQMATMMEAMMSMKKIMETNAVIVSATSAIAKVNPMLPSGLKQMNHPTSNMLGKDLGSTDDPMMCKFKTSTPSHHMACLPTIHHPMWHTLSMKISITPLRYSLRTNNLIRHISLMGETHEIPHHNLADFEPWLRYATEGQAVGGIPFENTLEGPQFRPQPQPLRFVVGKKPSCYGRNGKVGSSRGKAQGH

SEQ ID NO: 117086 - protein, 107 aa, Glycine max
  Coding DNA Sequence Number=SeqID_25401
MVKEECKEVSVSSKRLVKKESHFEIKTNIKETSPLRQPPHLFLCKKTLVSTATPLGLEVIPQVKELLDEGLVRVEGRSPEYEEPQDLRSNPFQGGGDDAILPPEGIG

SEQ ID NO: 117087 - protein, 53 aa, Glycine max
  Coding DNA Sequence Number=SeqID_25402
MVISWFSLKAVVSSKQGKETRLKGLSKKLIQGRINKNQAKAIVQALNGAKHTK

SEQ ID NO: 117088 - protein, 120 aa, Glycine max
  Coding DNA Sequence Number=SeqID_25403
MTGLNQHPKLPTFNFERLDILQDSIRHPSKKLSSFEKAQRFNHSISSVSIYDGTQSDIRVKSYCRLNLLRASTFNFERLDILRDSIRHPSKKLLSFELAQSFNIQFRASRYYGSLNQTSE

SEQ ID NO: 117089 - protein, 90 aa, Glycine max
  Coding DNA Sequence Number=SeqID_25404
NLARLGELGGHHTPRFVEKWDAEASETPVMLPNLARLGELGGNLLPLFPINRLKGAVLRRPDAPGEVSVSKFVKVFLRYSPFFIRSSFFN

SEQ ID NO: 117090 - protein, 110 aa, Glycine max
  Coding DNA Sequence Number=SeqID_25405
MDCTHKTPSDLKKSNRALGFPALVTGLYQSYRVSVPPRQGHVIIGIAPARHPVDPKESPTGSWSCQALITGLCQFYGVPVTSSKGIRPPTNRSFIKKYCAPRQTQGETPQ

SEQ ID NO: 117091 - protein, 89 aa, Glycine max
  Coding DNA Sequence Number=SeqID_25406
MVFGASGAFAMLPVASSSNPGHLGELGDNLLPLFPINRRRDAVPNIPNPLGYAFQLFWVKKIVFVKKIQVEKVFCRSSPFFIRSSFFNG

SEQ ID NO: 117092 - protein, 102 aa, Glycine max
  Coding DNA Sequence Number=SeqID_25407
EQGKHPHRPQKDKKYKKLSSLMTEAWGANTFPVCKYNSRTFHLKVRRSWLFRFFQRFPQINVGGDSTRIPFMEHAPASHASPSRRRVGCDSWRLHWGRFLES

SEQ ID NO: 117093 - protein, 123 aa, Glycine max
  Coding DNA Sequence Number=SeqID_25408
  Subcellular localization annotation: CTP_CleavageSite=38; ConfidenceScore=5.37e-01
MNCVFVHVSSTFEFGAMRSDCLVQFSILNLFRSPMNCVFVHVSSTFEFGAMRSDCLVQFSILNLFRSPMNWVFVHVSPTFELEALRMDGLWQFSILNLFRSPRIWIFVLVSPPSSLELCVVIA

SEQ ID NO: 117094 - protein, 234 aa, Glycine max
  Coding DNA Sequence Number=SeqID_25409
MAKFDPDIVLEFYANAWPTEEGVRDMRSWVRGQWIPFDADALSQFLGYPLVLEEGQECEYGQKRNRADGFDEEAIAQLLCIPGQDFARTAAGRRVRIMRTKMTTLTIIWMSIHVAQLIADVIYLFAETGPGGCSAGRRRTATSSGWPSWIIDTEQYYGIWFTSRRPTTGAHSQGFTSFPCPTPDQFRAEVAWPGDWPEARAGEAPAEAPDEADEAREDEEMTDLLDFLGGSGAT

SEQ ID NO: 117095 - protein, 74 aa, Glycine max
  Coding DNA Sequence Number=SeqID_25410
MKNGEESSRNRSRKRLGSVTEEARLGFFPREKEGSSCRPARPGKLGCFHQKAPPSVEPPGKPNWAWLLFAHPFY

SEQ ID NO: 117096 - protein, 129 aa, Glycine max
  Coding DNA Sequence Number=SeqID_25411
DPNAKLLQGVRKACDALPNLKTVRDNEVKASEESDEVQALKAELERARVVEEKFKAAIVSSNSEEVKGIIMGQRHDLEGRAKACLSETEGNMWAIIDECKEKLNLAATHEQRLEDEYAKISAEREARER

SEQ ID NO: 117097 - protein, 204 aa, Glycine max
  Coding DNA Sequence Number=SeqID_25412
TRLLRVLEVDCDKEDREEHSHAIIQGAPGPTPNSGCLLDPVWGASGGPGFPRQIMLLRPLALRACCCLLPTGEGRAAVWWMHYEDHIVPTGEVCVVPGACSSDYIDWFFRISHPFMTPGHVVDPLPHGHAPQPRVVPQAPQTDISREVCDDIAERLERHLSLGVVTPGSSTHEVVEECLRLARSVIQDHLVYVRCRRRRRTDQA

SEQ ID NO: 117098 - protein, 255 aa, Glycine max
  Coding DNA Sequence Number=SeqID_25413
GCISYNHVLTIRQLGYPMRGPPLEEELAAVISRGFNETNVEILQKVRKAWEVVQKKDKELRGSNNGPIGGYRKTAKREEVEAPEEDEEVQALRTGLEQAQTVKERFKSVALRIRKENAELRDVNIATTKALEQETKRARREEHDRNNELKLWREERDQSWVDNLILKDELKACSRSKRSLSQRLCETETNMLAIISKYQEELSLATTHEHRVADEYAQVYAKKEARGRVINSLHQEATMWMDQFALTLNGSQELP

SEQ ID NO: 117099 - protein, 96 aa, Glycine max
  Coding DNA Sequence Number=SeqID_25414
MAFAQTYLIRKIRRLYLAVSLPKEGSPVSKALDIDVRGIIDLSFQTNKVGKGEGFKMPSSKSVYFFVLGARRSQGLFSNSTGGLEMSIAKSFNAIQ

SEQ ID NO: 117100 - protein, 217 aa, Glycine max
  Coding DNA Sequence Number=SeqID_25415
MTSRDQVWSFCTQDTRRYLTVIRTLLSSRGGGPDDKQRPSLVILHPRYAEIPYVVSDGKQRPSLVILHPRYAEIPYGYLHPFARQTQLCPMASRDQVWSFCTQDTRRYLTVICTPLLGGHSCVRWQAETKFGHSAPKIRGDTLRLSAPFCHPEAAGPMTSRDQVWSFCTQDTRRYLTVIRTLLSSRGGGSDEQQRPKFGSLCTPDTRRYLTGICTLC

SEQ ID NO: 117101 - protein, 76 aa, Glycine max
  Coding DNA Sequence Number=SeqID_25416
MRVQAIGLFAQATCAPEFGLPRPFNQRLLILHVVGSAVKQRVKRSCDLILSCRKVCLLREASCQEYDVGTKWPQLS

SEQ ID NO: 117102 - protein, 167 aa, Glycine max
  Coding DNA Sequence Number=SeqID_25417
  Gene Ontology: Mol. function=aspartic-type endopeptidase activity; Biological process=proteolysis
  Homolog annotation: Hit_ID=A7PDD3; Match level="QueryCoverage=91%, HitCoverage=16%, E-value=9e-32, Identity=43%"; Hit description =Chromosome chr17 scaffold_12, whole genome shotgun sequence
MDAKKEYNIMNTLQHMTMVATTYQTSHGCLEETTIDILVAGFSGQSKECAIKTNLNGKVIKNDDNRKIPDAVNTLIFTIAQHFIGDLSLWKDRLAELSSNLKCRTLGDFRWYRDTFLTRVYTREDSQQPFWKEKFLADLPRSLGDKKVALKICLDDKIQRQLAKEKA

SEQ ID NO: 117103 - protein, 69 aa, Glycine max
  Coding DNA Sequence Number=SeqID_25418
MSLATLFGKLQEHEMELLRLHQHEENDKKKKGIALKASSSIQEESDQDNDPDDDDDLSLFVRRFNKFLK

SEQ ID NO: 117104 - protein, 87 aa, Glycine max
  Coding DNA Sequence Number=SeqID_25419
MDITTIQATEEWTRFRDALAMNMFANYQVRRNFDFFFVFINRKPFAIADKIWYGIVSDILGQSGFDWDGTKHMITVENENAWNEYCS

SEQ ID NO: 117105 - protein, 80 aa, Glycine max
  Coding DNA Sequence Number=SeqID_25420
MSEAQIIAHATQLHEAQQKKRAEDVVVVAITEKELVAILGREAISTIQVKTYAKVVGDTLCVGSLLVVQFDFYAEIFPSM

SEQ ID NO: 117106 - protein, 49 aa, Glycine max
  Coding DNA Sequence Number=SeqID_25421
MKIFRRSSPLFVRSVVFNRSDFLIAIEDTYEQKPRFCRPPQEIVNGPTP

SEQ ID NO: 117107 - protein, 66 aa, Glycine max
  Coding DNA Sequence Number=SeqID_25422
MDRPKHLSPRDDKGVALAPTYPQQNRAFGVMTARPGELLLHFEATLLAQTSQRLAWDSQGLETALK

SEQ ID NO: 117108 - protein, 91 aa, Glycine max
  Coding DNA Sequence Number=SeqID_25423
MSSVLVYYGTQSDNRVKSYCRLIFLRASVLNFERLDILRDTIGHPSKNISIYYGTQSDIRVKSYYRLILLTASILNFKHLDILRDTIGTTE

SEQ ID NO: 117109 - protein, 157 aa, Glycine max
  Coding DNA Sequence Number=SeqID_25424
MKRWWAAHPQSFADLVFASERINVGPKRGKFDHPTRTTEKTGANKEGEDEGETHAVTAIPVRPNFPPTQQYLYPANNKLSPYPPPSYPQRPSLNLPQSLSTALPMTNTTFSTNQKHQPRTITLAKVHQPPFLREYNSNATCACHGEAPGVPLSMVGL

SEQ ID NO: 117110 - protein, 227 aa, Glycine max
  Coding DNA Sequence Number=SeqID_25425
VKLPAFIVDHRVVPGDMSRGSGDLGDVRRAPGSQQIKGTKTTKQGGLWWLASCEFCVICGLWPLVIDYQGLENEVRKLREPLIVMAAQLIHDRVEMECLEGAWETLEGNTRCRFRGTIRFTATSLVHPDEPVRTLQRTVEWILPTPTPYRLVEPVQVIEVTSSEEDPEEDPEELPPEPAVDALDFLEGDEDPLPEVDSPEEVMSASEADSTEDSGPREMATSGGSSS

SEQ ID NO: 117111 - protein, 141 aa, Glycine max
  Coding DNA Sequence Number=SeqID_25426
MPFAWASSEDSNGGVRLEVSIASFYAGSSSDQSLQQPQYFPTRNSITVLVLELNTLYALLFVEYPRNIPASLLGSIFLLLLSICQNVAWTSKDVEVLDSWLPPFPDFIQCGWSASSKCDSVVDVACCVHGFRPKIIGKSLA

SEQ ID NO: 117112 - protein, 233 aa, Glycine max
  Coding DNA Sequence Number=SeqID_25427
  Gene Ontology: Mol. function=phosphoglycerate kinase activity; Cellular component=integral to membrane; Biological process=two -component signal transduction system (phosphorelay)
  Homolog annotation: Hit_ID=Q7AFM0; Match level="QueryCoverage=95%, HitCoverage=46%, E-value=2e-58, Identity=48%"; Hit description=Rtn -like protein
  Pfam annotation: Domain name=EAL; Domain location=1-213; Score=206.3; E_value=7.3e-59; Accession=PF00563.11; Description=EAL domain
MKEGEFFVCYQPVCDDLGRCRGAEALMRWKRADGRLIPPDVFVPAAESENMMAPLTRHLMRLIANDVKQWIPTREFHLSINISSEHLSGDEFIEDIRVFRDNLPPALSLVVEITERTFIEDTEKTVAHLSLLREAGIKVAIDDFGTGYCSLSILQILPADYLKIDRCFTETIDFADGSPPVLDAIIALSKRLNLTMIAEGVSTKKQGFLFSRPLDAVDFWSWYHGNVDETNLS

SEQ ID NO: 117113 - protein, 112 aa, Glycine max
  Coding DNA Sequence Number=SeqID_25428
MNEDLKKLRDMNKDGANSQANVVKSVEDEDEDEDDVFLETNDEVAKTKWVMDFVASKHICKDQEMERKMKLYDGAIRTFSNVRFVPSAIVNMIFIEEMTSQGYKYVGSKWGY

SEQ ID NO: 117114 - protein, 350 aa, Glycine max
  Coding DNA Sequence Number=SeqID_25429
MPPKKLSTKRSRKEATGEGSSAALEFDSHWFQSAEHQQRFEAIKGWSFHRERHAISQFLGDPLILDEDQQCEFSQRRNQENGFDEEAIAQLLCIPGQDFAQTAAGRRVWIMCTSMTTLTQIWMTLLLSNVLPNDHNSDLPLPKCQLVYAILTRMSVHVAQVIVDAIYLFAGMAPTRHPLNPEKSNRALGFPALITGLCQSFGVQVTPSKVIRPPITRSFIEKYCTPRQAQGDAPQGTGAPPPPRQADPVEPLGVERYLQHLVCQQAANHRGQVQIHECLYRFSRSQQGQGSSPFVCPTPEQFAVEVAWPGDWPNAQVEEEPVGSPDGMDEPHMDEDMTNLFDFLGGSGAT

SEQ ID NO: 117115 - protein, 148 aa, Glycine max
  Coding DNA Sequence Number=SeqID_25430
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=65%, HitCoverage=10%, E-value=2e-09, Identity=37%"; Hit description =Gag/pol polyprotein, 3'-partial, putative
  Pfam annotation: Domain name=G-patch; Domain location=38-82; Score =23.0; E_value=0.00032; Accession=PF01585.14; Description=G-patch domain
MPHVEAAEESLETAFQSFEVVSIASVDSLPRQPRLSNAAMMVARVMLGHGYEPGMGLGKNNGNRTSLVSTRGNRRKFGLGYKPTQADIRKNISERKNKGQGPRSGQQAKEALRCHISRSFVSASLRREGQVAAICDEDSPRRSDLVQP

SEQ ID NO: 117116 - protein, 106 aa, Glycine max
  Coding DNA Sequence Number=SeqID_25431
  Subcellular localization annotation: CTP_CleavageSite=67; ConfidenceScore=5.16e-01
MSFKESTPLCTRIGSLYGWTEGLSQTRFNSFFAGIPGSSSREEKRKRNSLLSSYSFSLPCGGLSGVYGGSDQSREEVFSDLPLRKQVGDANLWFLCFNRVPIAWMR

SEQ ID NO: 117117 - protein, 215 aa, Glycine max
  Coding DNA Sequence Number=SeqID_25432
  Homolog annotation: Hit_ID=Q2HW90; Match level="QueryCoverage=69%, HitCoverage=35%, E-value=2e-15, Identity=29%"; Hit description =Putative uncharacterized protein
MEPIASLAQYYDQPLRCFIFGDFQLSPMVEEFEEILGCPLGGRKPYLFSGFYPSLARISKKVQISAQELDRQRQSKMGGRNTEKYLEGVLFPNVDGLVDLAAIDVFLAYHNHKESPVAAMLADLYDTFDRRCEERNARIVCCTPALYVGLVSHHFLQEGRPVYPLQGYRSCVEKGKANWDQLLASMGGRLLIGSLARRKEESGFYLHAKDVQMFP

SEQ ID NO: 117118 - protein, 107 aa, Glycine max
  Coding DNA Sequence Number=SeqID_25433
  Subcellular localization annotation: CTP_CleavageSite=27; ConfidenceScore=5.43e-01
MVHDISVKVKLEVTGTSTALNVFGSRRSSDVTQSTFCPNFCKMVTSILQLDSMNLFIKARAWFNPITQGMEILIANTSSTFHRDERLGNTHAMHGKWESARVTHEQT

SEQ ID NO: 117119 - protein, 161 aa, Glycine max
  Coding DNA Sequence Number=SeqID_25434
MASNSQQFSARNDAIVIRGVHEVATNPSASSETKKLEGKLDALVKLGNPAVLESEICTCRKDLCPSMQQPGAIEQPEAYAANIYNRPPQPQQQNQPQQSNYDLSSNRYNPGWRNHPNLRWSSPQQQQQQPAPSFQNVAGPSRPYIPPPNPTTATTPETANS

SEQ ID NO: 117120 - protein, 33 aa, Glycine max
  Coding DNA Sequence Number=SeqID_25435
MEAMKEQITIMMEAMIGKSGFSENAPERQVFKN

SEQ ID NO: 117121 - protein, 144 aa, Glycine max
  Coding DNA Sequence Number=SeqID_25436
MGEVEVVQEQMEADMEAMKEHMAAMMEAMMSMKKIMEANAVAVAATNAVAKVNPMPPSDLNQMNHPTSDMVGKDLGSTDDPIVATYPSAGGRRVTRGMSVPRKEYARSRHQRLFEENVGKTGKDAIYELLSERFGSCIYARGRC

SEQ ID NO: 117122 - protein, 109 aa, Glycine max
  Coding DNA Sequence Number=SeqID_25437
MPISPCESIGWFVPFQHRDRAHNTLGGPGGAQQGPGVSSSSYGPLWITPARHPVDPKKSNMVLGFPALITGPCKFYGVRVAPCKFIRPPINRVFIKKYCAPRQAEGETP

SEQ ID NO: 117123 - protein, 200 aa, Glycine max
  Coding DNA Sequence Number=SeqID_25438
MGNPVKERSRARGIRNGIIGGYHEWLKVRIRAKRILKHRKRTRKSKLSKRVRKGKLAKEKFKLAATHVRKECAGLREENAITARSLERETKRARKEEYGRNKFRGALWGSNNELKLRREERDQSRAHGMVLKEELVACSRSKRSLSQRLCETETNMIAIIAKCQEELGLAAAHEHRIADEYAQVYAEKEDRGRVIDSLHQ

SEQ ID NO: 117124 - protein, 52 aa, Glycine max
  Coding DNA Sequence Number=SeqID_25439
MEACLWGFYGGWIFELQWGPLMVIFHHGDAAEDKGEETMVFREVSEDKTLPV

SEQ ID NO: 117125 - protein, 23 aa, Glycine max
  Coding DNA Sequence Number=SeqID_25440
MEKMKKLYGGEAMELQQKIKEKR

SEQ ID NO: 117126 - protein, 70 aa, Glycine max
  Coding DNA Sequence Number=SeqID_25441
MSESDIRVKVMSIRICRELPLFNFESLDELCPRIAYPCEKVMTIRISRELQLFNSERLDELCTRIGTSCE

SEQ ID NO: 117127 - protein, 34 aa, Glycine max
  Coding DNA Sequence Number=SeqID_25442
MADQQATKSKAKAQDVKEALQGGNLVPFKFPLVI

SEQ ID NO: 117128 - protein, 91 aa, Glycine max
  Coding DNA Sequence Number=SeqID_25443
MQGYRMVTRTFRKLGENEPVDTQRLTSSSAPFAIQGQRVRWQAEIPYGFTLVVLKHSSPATCKILLCWAATIECNGEGKCRGCPTLLLSRH

SEQ ID NO: 117129 - protein, 33 aa, Glycine max
  Coding DNA Sequence Number=SeqID_25444
MTKKRQHSLVPLAQYWARGKAESSMLFTMPARF

SEQ ID NO: 117130 - protein, 111 aa, Glycine max
  Coding DNA Sequence Number=SeqID_25445
  Subcellular localization annotation: CTP_CleavageSite=85; ConfidenceScore=5.36e-01
MQNGEKSSRNHSWKCLGSVTKAPWLGFSSRKHFFSLILSESQISGGLNGACSPLMVRTCSPLNARTCSPLKVRMCSPLLERTCSPLMARTCSPLKVRACNPTKSRTRSPLK

SEQ ID NO: 117131 - protein, 37 aa, Glycine max
  Coding DNA Sequence Number=SeqID_25446
GIGKGGLVPYLEEFESRSKGPTTLRAIGTKESTSKIE

SEQ ID NO: 117132 - protein, 157 aa, Glycine max
  Coding DNA Sequence Number=SeqID_25447
MDNKEGVQEQMKNDMSALKDQMASIMEAMLKIQKSIEDNATAAASNTSKEAEPVLQPTMNLGRDRSAMGFNRRYSPQAYPYGLPLDFTPRTTPDDLSQAPTFEGQLPPHADYPLQEDDEGDAHLSLLLPQREPTPHELPQPNIIRHAPSQSAPIKEL

SEQ ID NO: 117133 - protein, 126 aa, Glycine max
  Coding DNA Sequence Number=SeqID_25448
MNSVITVLYFNGRVYEDNDGVIFEGSKKAIQIKRGISFNALKKKIGDKENILPCKFVTTKTLKQCWKVLNNKTKYKPATNMSNLHIDEDDDDDDDYLVSNSYVEESLDENDSVDGISDTDDEGGIL

SEQ ID NO: 117134 - protein, 125 aa, Glycine max
  Coding DNA Sequence Number=SeqID_25449
  Subcellular localization annotation: CTP_CleavageSite=53; ConfidenceScore=5.33e-01
MTMQNMQFQQETRASIQSLTNQMGQLATQLNQQQSQNSDKLPSQSVQNPKNVSAITLRSRKQCQGPQPATSSSSANEPVQLHSTPEKEKDDDKNLKKAAYPSSIPSKSNFQQKNGRGRKGDLGNI

SEQ ID NO: 117135 - protein, 22 aa, Glycine max
  Coding DNA Sequence Number=SeqID_25450
HARIIVSHDFGSRVCRMARHDT

SEQ ID NO: 117136 - protein, 215 aa, Glycine max
  Coding DNA Sequence Number=SeqID_25451
  Homolog annotation: Hit_ID=Q6WAY6; Match level="QueryCoverage=40%, HitCoverage=15%, E-value=2e-09, Identity=38%"; Hit description =Putative uncharacterized protein
MFLNGTRGCINYNPVLAIRQLGYPMRGAPSEESITPFIAWGFSDPNARVLQEVQKAWGAVQSKDKELRGSSNGIAGGYHKWLRVRTQKLDWLPKLKAAREEEAETLEESEEVQTLKAKLERAQVVKENFKSMAIKVWKEYDELTDINMATAEALERETKRARKEEHDRNKFRGALWGSNSELRLLRAKKDQSRVKGMILKDELKACHWSKRCLSE

SEQ ID NO: 117137 - protein, 127 aa, Glycine max
  Coding DNA Sequence Number=SeqID_25452
MVAITPTKVHQPPFLREYDSNATCACHGEAPGHSIEHCRGLKHKVQGLIDAGWLKFEENLTMLNEMDKVDIFVPHPLTNASLLIQLSPECGCKPLVCLFNQRLLVLHVDGGAVKQQVKFKTNKFQNK

SEQ ID NO: 117138 - protein, 167 aa, Glycine max
  Coding DNA Sequence Number=SeqID_25453
  Gene Ontology: Mol. function=aspartic-type endopeptidase activity; Cellular component=small subunit processome; Biological process=DNA integration
  Homolog annotation: Hit_ID=A5B1K9; Match level="QueryCoverage=98%, HitCoverage=14%, E-value=1e-25, Identity=37%"; Hit description =Putative uncharacterized protein
MASSGPVFCFSGTPTITTAKLNWKNYPSWSASVELWFLGQGHHDYLEKTSNSVSDDKRPEWEKLDYQLCAKAQEFFVNDIQSLFDTTMKVTTLKQTSHDMITHVGKAQAAVEELRKFLVADSLEEVNRKLDKFYMVLILRSLHSDFDHVRDQVLAGDQIPSMDSLDH

SEQ ID NO: 117139 - protein, 123 aa, Glycine max
  Coding DNA Sequence Number=SeqID_25454
VIRPPITRAFIEKYCTQRQGQGDAPQAAGAPPPPHQAGQAGAFDMEQYLRHLVRQQAANHRAHGFAPFSCPTPDQFRAEVAWPGDWPEAQAGEAPPEAPGDGEEAHEDEEMADLLDFLGGSGD

SEQ ID NO: 117140 - protein, 241 aa, Glycine max
  Coding DNA Sequence Number=SeqID_25455
  Gene Ontology: Mol. function=transporter activity; Cellular component= integral to membrane; Biological process=transport
  Homolog annotation: Hit_ID=A8GFK7; Match level="QueryCoverage=41%, HitCoverage=24%, E-value=6e-34, Identity=72%"; Hit description =Multidrug resistance protein mdtH
MQSDSRTSFPPQSKRFDKKYLLGSRADHYPVPIFCHGFFVVFPLISIRFVDQLGWAALIVGIALGLRQLLQQGLGIFGGAIADRFGAKPMIVTGMLLRAAGFATMAMADEPWILWFSCALSALGGTLFDPPRTALRRSGGRRADRQLAAAVRFPLCLLGRGGDLRAGRRLERLATAGLPHLYRAYTDEGRHAAGPARSPFPHLCPDADRLLHVSGTGDADDADRGQRNRRFTGGGEMDVCD

SEQ ID NO: 117141 - protein, 95 aa, Glycine max
  Coding DNA Sequence Number=SeqID_25456
MSLHSSSSVNAEGSTPKDPLYKILDDLRSLKLWKEKQERKEKVVITLARAYVKNFVTIMKEGIGHILNLTPIGEKMKESLKRLTLNSHTSMGRTM

SEQ ID NO: 117142 - protein, 84 aa, Glycine max
  Coding DNA Sequence Number=SeqID_25457
MLKNGRKSSRNYSRKRYGSASAWIFFTKTIFLSNFERIRSAKKADPFSLHSSPIYSKIGEELATQLAQASKVASSRSNRRPKWA

SEQ ID NO: 117143 - protein, 47 aa, Glycine max
  Coding DNA Sequence Number=SeqID_25458
  Gene Ontology: Mol. function=structural constituent of ribosome; Cellular component=ribonucleoprotein complex; Biological process =translation
  Homolog annotation: Hit_ID=Q2PMP7; Match level="QueryCoverage=80%, HitCoverage=17%, E-value=2e-13, Identity=100%"; Hit description =Chloroplast 30S ribosomal protein S3
MKKAIELTEQAGTKGVQVQIAGRIDGKEIARVEWIREGIKGLGYFSK

SEQ ID NO: 117144 - protein, 119 aa, Glycine max
  Coding DNA Sequence Number=SeqID_25459
MIMRGQDIYSSQDEATTSPSSSKSEEAKGEESSEEIYPQEEGQPLMVKEECKEVSVSSQRLAKKERHFEIKTNIKEISLLREPPHFLLCKKTLVSIATSLRLEFNPQVKELLDGLVHKS

SEQ ID NO: 117145 - protein, 35 aa, Glycine max
  Coding DNA Sequence Number=SeqID_25460
LASHLKEVCLAIREEVFSKKLFKEVFSRKLLKEAT

SEQ ID NO: 117146 - protein, 204 aa, Glycine max
  Coding DNA Sequence Number=SeqID_25461
  Homolog annotation: Hit_ID=A5AKA7; Match level="QueryCoverage=62%, HitCoverage=24%, E-value=3e-08, Identity=32%"; Hit description =Putative uncharacterized protein
MTGRLLAGSLAFESRILHYLIVHILLPRSSNLAQVSEEDLIIMWAFHTGRQLNWAHLVRYRMHKALRLNAPLPYPQLVTLFLRHFEIPLDSESYIPIKRSFLIGAAAIVSFGYRKERDGSWVRKGTQPANEEGNLPNEDNCTLLRRLMDKFDGLQTFVGDKFDAMELQVDMRFDAMESRITRVEEDVSFIRTCFDPPPPPPSSS

SEQ ID NO: 117147 - protein, 123 aa, Glycine max
  Coding DNA Sequence Number=SeqID_25462
  Homolog annotation: Hit_ID=A2QBL2; Match level="QueryCoverage=82%, HitCoverage=39%, E-value=9e-17, Identity=44%"; Hit description =Similarity to dihydrofolate reductase dfr1p - Schizosaccharomyces pombe
MALSWLVNWYQTKQANGSEVAPFKVAVFFSNARQPFDHDALAMDRIAYLDSVQMGKVIDIPTAHIWGSADPQAEEAQRAVNFCDSERRSIFVHEKGHEIPSSVEDTVSIAKVINRAIYQVEGK

SEQ ID NO: 117148 - protein, 93 aa, Glycine max
  Coding DNA Sequence Number=SeqID_25463
MNKYFPSWHTFKTALKGNEEFIFTRNINERKPNKGGKSRGVANCRNPTLRREGRRETRGMRVPRKEYARSRHQRLFGENVGKTGKDAIYELFK

SEQ ID NO: 117149 - protein, 93 aa, Glycine max
  Coding DNA Sequence Number=SeqID_25464
  Subcellular localization annotation: CTP_CleavageSite=60; ConfidenceScore=5.06e-01
MTKFCLCVSSGPPPLDDKRVRITVSLHQKMPTSPERAQMTILASAYQSHSRCDNRKVSPRATSSWVMVTESSVVDKSEAFAPTYPPNEELRPT

SEQ ID NO: 117150 - protein, 108 aa, Glycine max
  Coding DNA Sequence Number=SeqID_25465
MDAKELPSPVNSDVVKQILCLEAGAIKDVAACSLSLCIFWISPQGFPGQDHLGLPSGVETKHERQKPIKVLKDECERGWGHDRPIVALLCAKQAGNVAARQPRILCIL

SEQ ID NO: 117151 - protein, 353 aa, Glycine max
  Coding DNA Sequence Number=SeqID_25466
  Gene Ontology: Mol. function=protein transporter activity; Cellular component=membrane; Biological process=protein secretion
  Homolog annotation: Hit_ID=A8GEP0; Match level="QueryCoverage=99%, HitCoverage=91%, E-value=1e-136, Identity=71%"; Hit description =Efflux transporter, RND family, MFP subunit precursor
  Pfam annotation: Domain name=HlyD; Domain location=29-324; Score =246.5; E_value=5.9e-71; Accession=PF00529.11; Description=HlyD family secretion protein
MTTEVGVKTLQSQSVTLDSELAGRVTGSMTADVRPQVDGIILKRLFNEGDEVKAGEVLYQIDPASYQASYDQAVAQLKNAQALVKSSKLKAERYAALVKENGVSRQDADDALATYQQNAASVDQYRATVESARINLNYTQIKAPISGRIGISSVTPGALVTASQTTALATIRALDPIYVDLTQSSVQLLKLKRQQASLQQSTDAVPVTVKLEDGSNYDHPGKLELTEVSVDEATGTVTLRAIFPNPQHELLPGMYVRASVSNGVKNDAILAPQQGITRDAKGGATALVVDKENRVESRDVIADRVIGNKWLITSGLNSGDKLIVEGTGKVQPGMSVKAVEVTSDNKSATSEGN

SEQ ID NO: 117152 - protein, 50 aa, Glycine max
  Coding DNA Sequence Number=SeqID_25467
MEDEVHCSLVGNYSVIPDRRASPASKNSPSNSTRTTERCICLVLFGDEKK

SEQ ID NO: 117153 - protein, 240 aa, Glycine max
  Coding DNA Sequence Number=SeqID_25468
  Homolog annotation: Hit_ID=A5B939; Match level="QueryCoverage=33%, HitCoverage=63%, E-value=2e-12, Identity=46%"; Hit description =Putative uncharacterized protein
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALLCAYSESESDVGGGPGTELSFLFNSLPTLETAQPEVGSSGWKSTARRVVSASGRWNNVGKGSRQNGSVTSGNGSALRAGHGAPSPEPVGCRWTARAASAARAGRRVPVGGRIGNGPFGASSPGVEQSTQN

SEQ ID NO: 117154 - protein, 110 aa, Glycine max
  Coding DNA Sequence Number=SeqID_25469
MRLGVYEQFKQRDPCWSFIQLLDYLKLALLDEAKELMGLFQSHRLSLKTFFLFSPSYHWRIYFFRGGGYVCGLLDHGRFPLGGQLRLVRGSEHPTTAGYATEAGDAGHLS

SEQ ID NO: 117155 - protein, 182 aa, Glycine max
  Coding DNA Sequence Number=SeqID_25470
MGPDNVEANLDWEIRVEQQLKMKSTSKSYGSHSYPKKDQGQVILGVTSSKPKDDKGKAIEKQAPKAKDTLLLRGGTTKTMIRRGQDIYSSQDEATTSPSSSESEEAKGEESSGEIYPQEDGQPLVVKEKCKEVSVSSKRNNQHENTEKGVPMNPKRIKVIPEWPAPPSVLRKKAQRFKNLGI

SEQ ID NO: 117156 - protein, 84 aa, Glycine max
  Coding DNA Sequence Number=SeqID_25471
MRSIWAHEIQLSCFQKKNEKSGGRNFKENEEEKGYITWEDNAINSSSDLENKIISLGIMMKEYENGEEQSRYIDSNFSINTWHA

SEQ ID NO: 117157 - protein, 62 aa, Glycine max
  Coding DNA Sequence Number=SeqID_25472
MGLRGEYVSSVGGGQQGMVEWYLEICRGGQETLGTSGGVLLPKTKLDQSRPNPGHSRVSENL

SEQ ID NO: 117158 - protein, 95 aa, Glycine max
  Coding DNA Sequence Number=SeqID_25473
MGMGTMPNVSLVGYSSTTTNAPLAFRWLGGEFHHIGNENLLDFHQKLDVMKRDEVPYSGHVEMNMRQVCFIGKWNDTNRIESRDNLECNNLFRAE

SEQ ID NO: 117159 - protein, 79 aa, Glycine max
  Coding DNA Sequence Number=SeqID_25474
CWIYEHFLMVHQCVVDDAYAEASPRASRWLTSKAHMRGIKGAPYQARIEALTVMDVCWMPYQSTGELRASTWSHPTRAS

SEQ ID NO: 117160 - protein, 84 aa, Glycine max
  Coding DNA Sequence Number=SeqID_25475
MAQKNDVSLYVLSRLLVLPDNQKVYTDTHSDSKTVYTDNHSGISAGQRDSKVSMTDLVSAEDDVNHRVSTGLSAVIDEGRRRRR

SEQ ID NO: 117161 - protein, 90 aa, Glycine max
  Coding DNA Sequence Number=SeqID_25476
  Subcellular localization annotation: CTP_CleavageSite=18; ConfidenceScore=5.04e-01
MSLPSAVHVSSVNKRGASAKKVVETRIVITERAGRTKSVSYLCFPLISDERRFLQKAVASGGSNLARLGELSGKLLPYFAINGGRSEEEK

SEQ ID NO: 117162 - protein, 108 aa, Glycine max
  Coding DNA Sequence Number=SeqID_25477
HTSHRLVQNRRIQDERPSGHWRHTHRRVHETLFDPSKRFLTILVLPDGLETSDLPLGTGFRHLKDGLHLFGVHLYVDKGSSRCFDDAKRSHASQSFIQDKAIKDIQDG

SEQ ID NO: 117163 - protein, 69 aa, Glycine max
  Coding DNA Sequence Number=SeqID_25478
MDSGRFQVSIPGDSCPSKTFLEEMYQQFPIFAYAPIIRQYIFRWFLGQVVPLYLSKSNTLNLGMTMFGY

SEQ ID NO: 117164 - protein, 94 aa, Glycine max
  Coding DNA Sequence Number=SeqID_25479
  Subcellular localization annotation: CTP_CleavageSite=78; ConfidenceScore=5.10e-01
MVKVGTSYVPINVSFSPKVGQGFPGINRDTQDLFILRSDLPSQGAPVASVFYQLSPPVQLLTGVGGVTAKSTRRTSALASVAVPAARNHHTRRA

SEQ ID NO: 117165 - protein, 64 aa, Glycine max
  Coding DNA Sequence Number=SeqID_25480
MTVSYKDWHEMFAFRPTRIQNLGTNFYWGQRRIPWFMGMEAEDNGGVGALKRVRMGLKYATDQL

SEQ ID NO: 117166 - protein, 106 aa, Glycine max
  Coding DNA Sequence Number=SeqID_25481
MSGLTRDSPQISASPHQLDFAPYASRSYSARWNAPGLLHDKHTLRSSRILGKMEVEEPWLGLWLPLNYLVDMGARMAFVDNWVVGKEKGCYWLSNDIVGPVGSLVM

SEQ ID NO: 117167 - protein, 15 aa, Glycine max
  Coding DNA Sequence Number=SeqID_25482
ARLDLEEILNQGFVC

SEQ ID NO: 117168 - protein, 121 aa, Glycine max
  Coding DNA Sequence Number=SeqID_25483
  Subcellular localization annotation: CTP_CleavageSite=38; ConfidenceScore=5.01e-01
DKGILKEDFQASSRVLIIKKDSGGHTLAISSTKTRVTMSNHKSTESALKNLKVQVEQLAKQIADRSSNSFVANIEKNPKEECKVVMTRSKRFVEVEDEESVVHKKKVVEKKGTDGEKNDMR

SEQ ID NO: 117169 - protein, 250 aa, Glycine max
  Coding DNA Sequence Number=SeqID_25484
MAPRKLSAKRSRRDAATEGTGAAPEFDSHRFRSAEHQQRFEAIKGWSFHRERHVQLRDDEYADFQEEIARRRWTSLVTPMAKLGPQRRAYGTCDALSQFLGDPIVLEEGQECEFSQRRNRADGFDKEAIAQLLCIPGQDFARTAAGRRVRIMRTSMTTLTQMWMTLLLNNVLPSDHNFDLPLPKCQLVYAILTRMSVHVAQLIADAIYLFVGMPPTRHPLDPDKSNRALGFPALITGLCQSFGVPVTPSK

SEQ ID NO: 117170 - protein, 77 aa, Glycine max
  Coding DNA Sequence Number=SeqID_25485
MAERRRKLLQDITVASILEEETHFSNSLSPDSPSSRESATQLPEATTMADEQHQRITLEDYSSSSVPQLFTSIAYPE

SEQ ID NO: 117171 - protein, 91 aa, Glycine max
  Coding DNA Sequence Number=SeqID_25486
  Homolog annotation: Hit_ID=Q6WAY6; Match level="QueryCoverage=87%, HitCoverage=14%, E-value=7e-12, Identity=41%"; Hit description =Putative uncharacterized protein
MASQEDWVPFMDVLALLIFGGRPLSKRGRTINWFPRWKEGKEGVLFSCKGYPNIPLIGTRGCINYNPALAIRQLGYPMRGAPMEESMSPFL

SEQ ID NO: 117172 - protein, 121 aa, Glycine max
  Coding DNA Sequence Number=SeqID_25487
MAQHESSRLGFPALINALCKARGVHSDSLTHERLSPAINLAYIKKNCWNLDDPIVNFRGPRKARGKRSEAPSTSTPSEAPAPSSSIPPSSSTQIPLIPPTPIQMPLPAPLSTGPSDFIFTP

SEQ ID NO: 117173 - protein, 321 aa, Glycine max
  Coding DNA Sequence Number=SeqID_25488
  Gene Ontology: Mol. function=oxidoreductase activity; Cellular component=mitochondrial nucleoid; Biological process=metabolic process
  Homolog annotation: Hit_ID=P37685; Match level="QueryCoverage=98%, HitCoverage=61%, E-value=1e-165, Identity=91%"; Hit description =Aldehyde dehydrogenase B
  Pfam annotation: Domain name=Aldedh; Domain location=1-320; Score =251.5; E_value=1.8e-72; Accession=PF00171.13; Description=Aldehyde dehydrogenase family
MAPALAAGNCIVLKPARLTPLSVLLLMEIVGDLLPPGVINVVNGAGGEIGEYLATSKRIAKVAFTGSTEVGQQIMQYATQNIIPVTLELGGKSPNIFFADVMEEEDAFFDKALEGFALFAFNQGEVCTCPSRALVQESIYERFMERAIRRVESIRSGNPLDNVTQMGAQVSHGQLETILNYIDIGKKEGADILTGGRRKVLGGDLQEGYYLEPTILFGQNNMRVFQEEIFGPVLAVTTFKTMEEALEIANDTPYGLARRPSGAATVIWAYKMGRGIQAGRVWTNCYHAYPAHAAFGGYKQSGIGRETHKMMLEHYQQRNVC

SEQ ID NO: 117174 - protein, 90 aa, Glycine max
  Coding DNA Sequence Number=SeqID_25489
MPQQHMPSLYDRTTKLEETLAKFMQVSMSNQKSTESAIKNLEVQLADELALEPVDDLVELEEIVEEAEGDEEGETPIRDCQEKTKKKEEK

SEQ ID NO: 117175 - protein, 63 aa, Glycine max
  Coding DNA Sequence Number=SeqID_25490
DDKKLKGQFKKFKMFKMFKIESRTLQGSRGNLISRIKNQDSRFKLSRIKIKIQDSRFKNQEKT

SEQ ID NO: 117176 - protein, 441 aa, Glycine max
  Coding DNA Sequence Number=SeqID_25491
  Gene Ontology: Mol. function=ATP binding; Cellular component =intrinsic to membrane; Biological process=defense response
  Homolog annotation: Hit_ID=A2Q6G3; Match level="QueryCoverage=80%, HitCoverage=58%, E-value=1e-110, Identity=54%"; Hit description=TIR; AAA ATPase
  Pfam annotation: Domain name=NACHT; Domain location=88-242; Score= -40.8; E_value=0.091; Accession=PF05729.3; Description=NACHT domain
  Pfam annotation: Domain name=NB-ARC; Domain location=56-345; Score =138.9; E_value=1.5e-38; Accession=PF00931.13; Description=NB-ARC domain
  Pfam module annotation: Pfam domain module=NACHT::NB-ARC; Domain location=88-242::56-345
MVHLLGLLTENKRGYISCGSVLVEGTSTRLFKEHKGGNESEAIKTIVENVMRLLDKTELFIADNPVDVEPRVQEMIELIDQKQSNDVLLLGMWGMGGIGKMTIEKAIYNKIGHNFEGESFLAHIREVWEQDAGQVYLQEQLLFDIEKETNTKIRNVESGKVMLKERLRHKRVLLILDDVNKLHQLNVLCESREWFGSGSRIIITTRDMHILRGRRVDKVFRMIGMDEDESIELFSWHAFKQASPRENFIGLSRNIVAYSAGLPLALEVLGSYLFDMEVTEWKNVLEKLKKIPNDEVQEKLKISYDGLTDDTEKGIFLDIACFFIGMDRNDVIHILNGCGLCAENGIHVLVERSLVTVDYKNKLRMHDLLRDMGREIIRSKTPMELEEHSRNRGSKDNQQADSEHNSKSRGAQAQKKDHQAYIPQGLPLKKRTKPTMQCNLA

SEQ ID NO: 117177 - protein, 196 aa, Glycine max
  Coding DNA Sequence Number=SeqID_25492
MAREGETVVTSGSHPTEKRHIDDRLMKRGTRRDQGSITNNQKRKWWALLTSPAKNLEDLKLELPLAWKPMGSESSSPWVSFLTNTKVEIEGELEGLLRLEEVLWRQRLKVEWLMYVDRNTTFFNRKISHRKQVNTIKKIQDDDGNVYRNVEDIGEVLTKNCKPCGGEKLWRDVILCGCGVFKSRCTPPKLLGKMAI

SEQ ID NO: 117178 - protein, 115 aa, Glycine max
  Coding DNA Sequence Number=SeqID_25493
MFVGCVGRSRGANTQPLWVTLLSPVMLVTFADNELISVASSPFSLGGVYLYGTAWLFWYGKGTGLAAEGYRGFCEAASLVKYITKGLGLPKLLSSTNCIHICCSSLPSSPTSSRP

SEQ ID NO: 117179 - protein, 92 aa, Glycine max
  Coding DNA Sequence Number=SeqID_25494
MAAEWRRKRERRCHFKEKMSLEEAHHHRRPWIRAWRKKEMNEGRGREDHKILCSKRALKSEISGPNLDPWAQKFTLRFMRTLGCWIKWPRNN

SEQ ID NO: 117180 - protein, 56 aa, Glycine max
  Coding DNA Sequence Number=SeqID_25495
MEEIHIEEAKEYHLDEDALIPHSVAPCRACRPWIFFINEVLCFLKINGSKMEKEER

SEQ ID NO: 117181 - protein, 139 aa, Glycine max
  Coding DNA Sequence Number=SeqID_25496
MASTTCLFPHLLFTVLQDCYCLTVGTVDEIIIDAPWSYDSCPNCTTTFDPLKGGSACRSCHTSVVDTVPRYKLNVKMEHNGDKGNFLLWDATCIKLFGKTAGECRDELIAVGDDIKEQSSKGKGIAVEPESSPPIFVPT

SEQ ID NO: 117182 - protein, 159 aa, Glycine max
  Coding DNA Sequence Number=SeqID_25497
MGSPPKPSLKKRFYQVKIKSLEVTSLRKLGQLMGQLQRQAFRKAYAIDVFLAYHNHKESPIVAMLADLYDTFDRRCEESNARIVCCTPALYVGLVSHLFLQEGRPVYPLQGYRSCVEKGKANWDQLLASMGGRLLIGSLARRKEESGFYLHAKDVQMFP

SEQ ID NO: 117183 - protein, 35 aa, Glycine max
  Coding DNA Sequence Number=SeqID_25498
MSKVGRFEGLGMEGRRKEEEVVQGFLKNVVEATYW

SEQ ID NO: 117184 - protein, 124 aa, Glycine max
  Coding DNA Sequence Number=SeqID_25499
MQSEFEMSLVGELTYFLGLPSEADGRHHIPLTEGSLQDQGRTLRFVSGKFMLCLHKMSPSKNVKEALTDASKDEGVDFEICKLSPVDLSPQISYLVSLSQIQCWYGYCEVLMAGSADEQKKGTS

SEQ ID NO: 117185 - protein, 51 aa, Glycine max
  Coding DNA Sequence Number=SeqID_25500
MGSGRSHGHVASHCHRTLGVTGTKSGGGPTKGRAFGSLRILQFCDEEPQTY

SEQ ID NO: 117186 - protein, 151 aa, Glycine max
  Coding DNA Sequence Number=SeqID_25501
TPTYLALLILLPVAAASGDKSCLPGWTQDDSYRDKAQRATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 117187 - protein, 282 aa, Glycine max
  Coding DNA Sequence Number=SeqID_25502
MAPRKLASKRSRKDKAAEGTSSAPEYDNHRFRSAEHQQRFEAIKGWSFLRERRVQLRDDEYTNFQEEIVRRRWASLVTPMAKFDPDIVLEFYAQCLAYGGRCARYEVLGKGSMDPFDADAIGQLLGYPLVLEEGQECEYGQRRNRSDGFDEEAIAQLVCIPGQDFAWTAAGRRVQIMRTNMTTLTQILMTLLLSNIQPSDHNSDLPLPKCQLVYAILTRMNIHVAQLIADAIYIFAGMAPTRHPLDPDKSNRALGFPALITGLCQSFGVPVAPSKVIRPPIT

SEQ ID NO: 117188 - protein, 111 aa, Glycine max
  Coding DNA Sequence Number=SeqID_25503
MDDANPVGTPLECGSKLSKHEKGENESLSRYQEASKHKVERESLRRTSKVNQTVGLPTYSSYEDTKQLVSIVRQSIDDSDEWRLRYESKHWFCVLYGRYCFTGVKEATNVD

SEQ ID NO: 117189 - protein, 138 aa, Glycine max
  Coding DNA Sequence Number=SeqID_25504
NVYTDNHSGISARQHDSKVSMTDLVSAEDDVNLRVSTGLSAAIDEGCRMTTLAAACPPPLDDTRVRITVRCLRVSSGPPPLDDTRVRITVRVRITVRYLRVSSGPSPLDDTRVRITARCLRVSSGPPPLDDKRVRITA

SEQ ID NO: 117190 - protein, 68 aa, Glycine max
  Coding DNA Sequence Number=SeqID_25505
  Subcellular localization annotation: CTP_CleavageSite=37; ConfidenceScore=5.28e-01
MACTHIPGPTMLLVPSGVANCRNLPFCGRARRDSRVRLPKEENARSRHQRLFVENVGKTEGNRSCGIL

SEQ ID NO: 117191 - protein, 49 aa, Glycine max
  Coding DNA Sequence Number=SeqID_25506
MGCKTKRKKKGVRKVSATKRKEGGGGGSKKIEDKDQDFKKLIAPSSMET

SEQ ID NO: 117192 - protein, 81 aa, Glycine max
  Coding DNA Sequence Number=SeqID_25507
  Gene Ontology: Mol. function=DNA binding; Cellular component=nucleus; Biological process=regulation of transcription, DNA-dependent
  Homolog annotation: Hit_ID=A5B6S3; Match level="QueryCoverage=61%, HitCoverage=20%, E-value=1e-19, Identity=88%"; Hit description =Putative uncharacterized protein
  Pfam annotation: Domain name=NAM; Domain location=25-79; Score=-11.4; E_value=2e-06; Accession=PF02365.6; Description=No apical meristem (NAM) protein
MGVNEDFNKDIDDHHHEYVDDDDVPLPGFRFHPTDEELVSFYLRRKLHKKPISIELIKQIDIYKYDPWDLPSLAIERINFD

SEQ ID NO: 117193 - protein, 166 aa, Glycine max
  Coding DNA Sequence Number=SeqID_25508
  Gene Ontology: Mol. function=translation elongation factor activity; Cellular component=cytoplasm; Biological process=translation
  Homolog annotation: Hit_ID=O23755; Match level="QueryCoverage=99%, HitCoverage=19%, E-value=4e-70, Identity=75%"; Hit description =Elongation factor 2
  Pfam annotation: Domain name=GTP_EFTU; Domain location=1-113; Score= -2.1; E_value=6.7e-08; Accession=PF00009.18; Description=Elongation factor Tu GTP binding domain
MAALHVTDGALVVVDCVEGVCVQTETVLRQALGERVKPVLVVNKMDRCFLELHLDAEEAYLTFQRVVESANVIMATYEDAALGDIQVYPEKGTVAFSAGLHGWGFTLTNFAKMHASKFGVDEAKMMSRLWGENFFDSATRKWTYKHTGTSTCKRGFVMFCYEPIKQ

SEQ ID NO: 117194 - protein, 442 aa, Glycine max
  Coding DNA Sequence Number=SeqID_25509
  Gene Ontology: Mol. function=sugar binding; Cellular component =cytoplasm; Biological process=ethylene biosynthetic process
  Homolog annotation: Hit_ID=A7Q2Z4; Match level="QueryCoverage=73%, HitCoverage=97%, E-value=1e-138, Identity=47%"; Hit description =Chromosome chr12 scaffold_47, whole genome shotgun sequence
  Pfam annotation: Domain name=Kelch_1; Domain location=123-168; Score =50.7; E_value=4.9e-12; Accession=PF01344.16; Description=Kelch motif
  Pfam annotation: Domain name=Kelch_1; Domain location=173-217; Score =29.1; E_value=1.6e-05; Accession=PF01344.16; Description=Kelch motif
  Pfam annotation: Domain name=Kelch_1; Domain location=20-67; Score =24.5; E_value=0.00041; Accession=PF01344.16; Description=Kelch motif
  Pfam annotation: Domain name=Kelch_1; Domain location=222-276; Score =10.9; E_value=0.15; Accession=PF01344.16; Description=Kelch motif
  Pfam annotation: Domain name=Kelch_1; Domain location=72-118; Score =44.1; E_value=4.9e-10; Accession=PF01344.16; Description=Kelch motif
  Pfam annotation: Domain name=Kelch_2; Domain location=123-168; Score =18.8; E_value=0.02; Accession=PF07646.6; Description=Kelch motif
  Pfam annotation: Domain name=Kelch_2; Domain location=173-217; Score =2.5; E_value=23; Accession=PF07646.6; Description=Kelch motif
  Pfam annotation: Domain name=Kelch_2; Domain location=20-67; Score =20.3; E_value=0.0073; Accession=PF07646.6; Description=Kelch motif
  Pfam annotation: Domain name=Kelch_2; Domain location=220-276; Score =11.3; E_value=1.9; Accession=PF07646.6; Description=Kelch motif
  Pfam annotation: Domain name=Kelch_2; Domain location=72-118; Score =22.1; E_value=0.0021; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=123-168::173-217::20-67::222-276::72-118::123 -168::173-217::20-67::220-276::72-118
MAVVHGSWVKLDQRGEGQGARSSHAIAIVAQKVYAFGGEFVPRVPVDNKLHVFDLETLTWSVADASGDAPPPRVGVTMAVVGETIYVFGGRDGEHKELNELYSFDTRANKWALISSGDIGPPHRSYHSMTADDQHVYVFGGCGVHGRLNDLWAFDVVENKWVEFPSPGENCKGRGGPGLVVARGKIWVVYGFAGMEMDDVHCFDPAQKTWAQVETSGQKPTARSVFCSFSDGKHIIVYGGEIDPSDQGHMGAGQFSGEVYALDMETLAWKRLEDKVDFGGHPGPRGWCAFARAWRGGHEGLLVYGGNSPSNDRLDDIFFLALSQGKSEIKAFDDSKVGVQGLVENGIHDDPILRDGVLGKLRHACEKWGFFQVTNHGIPTHILDEMIKGTRRFHEQDAKVRKEYYTRDMSRKVIYLSNFSLYQDPSTDWRDTLAFFWAPNPP

SEQ ID NO: 117195 - protein, 369 aa, Glycine max
  Coding DNA Sequence Number=SeqID_25510
  Gene Ontology: Mol. function=metal ion binding
  Homolog annotation: Hit_ID=A9PIP1; Match level="QueryCoverage=81%, HitCoverage=87%, E-value=5e-35, Identity=37%"; Hit description =Putative uncharacterized protein
MAVEARHLNLFPSQFIPNREVMNSVEANMNMYNNTTPMGGYSSFLPLSGAVTETVLPSSVFNNHSLGNAVKSESGVTYNNNNNHHHHHINNVVMTPTSRKRSRDNSNNYGYNNNINNDSFSFLGQDVSLQIQQQQLDIEHLIMQRMEKVRMEIDEKRKRQARRFIEAIEVGVMKKLKAKEEEIEKIGKLNWALEEKVKHLCMENQVWRNLAEANEATANALRCNLEQVLAQCGGIAAEEDRGGATVCGGAEMDDAESCCGSTEEDCEGKKVGWRTLAGCAGVKDKDEGGESSNVVLCIGCCYDLKSEKHVRVLRDCPIKVDWIEIDFNFLKSFTIVDEKKHIISRMEKLGKRKGRVGTERDRSAAKADT

SEQ ID NO: 117196 - protein, 68 aa, Glycine max
  Coding DNA Sequence Number=SeqID_25511
  Homolog annotation: Hit_ID=Q2HTZ6; Match level="QueryCoverage=80%, HitCoverage=75%, E-value=1e-07, Identity=46%"; Hit description =Putative uncharacterized protein
MNHQQQSPAVTAYPAGAQSNLAAPPPPVGYPTKDDLPSQQNVPVKTTTRGDGFWKGWSVNLYPKSYFV

SEQ ID NO: 117197 - protein, 160 aa, Glycine max
  Coding DNA Sequence Number=SeqID_25512
  Subcellular localization annotation: CTP_CleavageSite=21; ConfidenceScore=5.41e-01
MVRKKVFISAVVASVVAKLCCGSYASNQRFHFSSFFRTEVPIVVVRVFPRRWREMCWIRDDNPIPGRALCLCPYVFYFLDHRRREEMLGVVGTSMAVTEAQNPLLVENTCGSLLKKLQLVDPFIALFFDIFLSDEIHGYHVKYVDPISHLGSQSKLVRPT

SEQ ID NO: 117198 - protein, 172 aa, Glycine max
  Coding DNA Sequence Number=SeqID_25513
  Homolog annotation: Hit_ID=A7PWT2; Match level="QueryCoverage=40%, HitCoverage=16%, E-value=5e-12, Identity=50%"; Hit description =Chromosome chr19 scaffold_35, whole genome shotgun sequence
MKSDREKEKEKEKDRCISSHMQTLHRRLLHALNLGTRSQLAPPTPPKTTVSPNPLVRELSARGVWLLLSQENFAHDILMKRLVDGSGSVPTLKCRQMCYDQLEPVANILGAHYYGFFNAKGEETVKKLKILAKRCKLQPLLQMLYRQRPKWGTPFPSINLTSSLGIASYKIS

SEQ ID NO: 117199 - protein, 469 aa, Glycine max
  Coding DNA Sequence Number=SeqID_25514
  Gene Ontology: Mol. function=catalytic activity; Cellular component =nucleus; Biological process=metabolic process
  Homolog annotation: Hit_ID=A2Q3P0; Match level="QueryCoverage=94%, HitCoverage=78%, E-value=0.0, Identity=63%"; Hit description =Tetratricopeptide-like helical
  Pfam annotation: Domain name=PPR; Domain location=213-247; Score =44.7; E_value=3.3e-10; Accession=PF01535.11; Description=PPR repeat
  Pfam annotation: Domain name=PPR; Domain location=314-348; Score =39.9; E_value=8.8e-09; Accession=PF01535.11; Description=PPR repeat
  Pfam annotation: Domain name=PPR; Domain location=349-383; Score =15.9; E_value=0.1; Accession=PF01535.11; Description=PPR repeat
  Pfam annotation: Domain name=PPR; Domain location=385-418; Score =11.6; E_value=0.33; Accession=PF01535.11; Description=PPR repeat
  Pfam annotation: Domain name=PPR; Domain location=70-104; Score=16.3; E_value=0.091; Accession=PF01535.11; Description=PPR repeat
  Pfam module annotation: Pfam domain module=PPR::PPR::PPR::PPR::PPR; Domain location=213-247::314-348::349-383::385-418::70-104
  Subcellular localization annotation: CTP_CleavageSite=46; ConfidenceScore=5.30e-01
MRFKGSITHITLLSKSSSIWKQLPSTKVAPSVPTNIPSYLGLRLLKAALNVGDFRRAQKLYDNITQPDPATCSTLISAFTTRGLPNESIRLYALLRARGIETHSSVFLAIAKACGASGDALRVKEVHAYGKCKYIEGARQAFDDLVARPDCISRNGVKPNLVSVSSILPACSVLKDLKSGRAIHGIAVRHEMMENVFVCSALVNLYARCLNEATWNAVIGGCMENGQTEKAVEMLSKMQNMGFKPNQITISSFLPACSILESLRMGKEIHCYVFRHWLIGDLTTMTALVYMYAKCGDLNLSRNVFDMILRKDVVAWNTMIIANAMHGNGKEVLLVFESMLQSGIKPNSVTFTGVLSGCSHSRLVEEGLHIFNSMSRDHQVEPDANHYACMVDVFSRAGRLDEAYEFIQKMPMEPTASAWGALLGACRVYKNLELAKISANKLFEIEPNNPGNYVLLFNILVTAKLWSEA

SEQ ID NO: 117200 - protein, 846 aa, Glycine max
  Coding DNA Sequence Number=SeqID_25515
  Homolog annotation: Hit_ID=A7PWT9; Match level="QueryCoverage=90%, HitCoverage=98%, E-value=0.0, Identity=61%"; Hit description =Chromosome chr19 scaffold_35, whole genome shotgun sequence
MGKKPESNTGGRASHKELNKVVSGPRSAGVIGERGSRENSTSEWSQREDSINWYDQNAYDSEGSTDGKRWSSQPHSSLAHLHDSKPLYRTSSYPEQQRQEQHYHLQHCSSEPVPNWFDQHIYDTETAHDHDGKRWSSQPHSSVAHLQESKPLYRTSSYPEKQQELPRFSSEPILVPKSSFTSYPPPGGLSQLGSPSHSTGHLNIPYHTGAAQMVLSSQNRSHFSNSALQPSALNLGSHFGVSTRQFPTGSHHNQRIQNQLVNQAGLYPGDHSNLLNNMLQQQLHLHNGSVAPHLMTQLQQQQHRLHHPGQRSAGYLSGFQSHLFNPRPSSGSSVISKYEHMHGITDGRDHKPKSTHKGKHSLRFSLHGSDASSQKSDSGSFQFRSKYMTSDEIESILRMQHAVTHSNDPYVDDYYHQACLAKKPNVAKLKHPFCPSQIREYPPRSRANTEPHSFVQIDALGRVSFSSIRCPRPLLEVDPPNTSSSDQKISEKPLEQEPRFAARVTIEDGLCLLLDVDDIDRYLQFNQPQDGGTHLRRRRQVLLEGLATSLQLVDPLGKNGHKVGLAAKDDLVFIRLVSLPKGRKLLAKYLQLLPPGSELMRIVCMTVFRHLRFLFGGLPSDPAALETTNNLAKVVCQCVRGMDLGALSACLAAVVCSAEQPPLRPIGSTSGDGASLVLISVLERATEVLTDPHAACNFNMGNRSFWQASFDEFFGLLTKYCMNKYHSIMQSMLIQSTSNVDDIGPDAAKSIGREMPVELLRASLPHTDEHQRKLLLDFAQRSVPVVGFNSNTGGSGGHVDDHTDVVRTTLDLFKYIWRKILNVESASCRVASMMEASASPLIVYLS

SEQ ID NO: 117201 - protein, 407 aa, Glycine max
  Coding DNA Sequence Number=SeqID_25516
  Gene Ontology: Mol. function=structural constituent of ribosome; Cellular component=intracellular; Biological process=translation
  Homolog annotation: Hit_ID=A7PJX4; Match level="QueryCoverage=80%, HitCoverage=85%, E-value=1e-80, Identity=49%"; Hit description =Chromosome chr12 scaffold_18, whole genome shotgun sequence
  Pfam annotation: Domain name=Ribosomal_L1; Domain location=6-236; Score=-113.5; E_value=0.044; Accession=PF00687.12; Description =Ribosomal protein L1pL10e family
MASENVSTDTVSKAVDALLKWRRSQSETLKPKLFDEDEEYVYLILTLKKIPSKSRVNPHKIPLPHSLFSPFSEQCLILDDRPNKARVTKAQAQARIQSESIPVNKILKLSKLASDYRPFEAKRKLCDSYDLFFAEKSIVPLLPRLLGKSFFKKRKIPVPVDLKKGNWKEQVEKACSSAMLFMRTGTCSVVRVAKVRMERDEIVENVVAAIEGAVEVVPKKWGNVRSLHLKLLESLALPVYQTVPDVKLKIDGFKVEEGATTTTKKKNETKEKDSEGEVSDSKKKKGRIHEVRYMDEIEDQLASDDSEDEMVSKKRKKGGSSELSGVEQLKKLVFNELTAKGKKKKKGLSVGGVKGDAIEGSGSELVVKDQESGVKKKKKKREEVKAKATKSVKATKGVKAKKIKKAA

SEQ ID NO: 117202 - protein, 29 aa, Glycine max
  Coding DNA Sequence Number=SeqID_25517
MFGEESINSKETMSSAAFKVGVLGSGRFY

SEQ ID NO: 117203 - protein, 52 aa, Glycine max
  Coding DNA Sequence Number=SeqID_25518
MESEARVHGGCAYDLEVAEMESDVGVQRIFKVRLSVRASSVSYGCNSNYPNQ

SEQ ID NO: 117204 - protein, 67 aa, Glycine max
  Coding DNA Sequence Number=SeqID_25519
  Gene Ontology: Mol. function=microtubule motor activity; Cellular component=microtubule associated complex; Biological process =microtubule-based movement
  Homolog annotation: Hit_ID=A7PWX2; Match level="QueryCoverage=85%, HitCoverage=13%, E-value=1e-14, Identity=64%"; Hit description =Chromosome chr19 scaffold_35, whole genome shotgun sequence
MVPPHVNENRLECERKELAETRRGLGQIKRENQHKSKECQEAWNSLKELQNELMQKTMHVGSLALWK

SEQ ID NO: 117205 - protein, 116 aa, Glycine max
  Coding DNA Sequence Number=SeqID_25520
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q9M6E8; Match level="QueryCoverage=100%, HitCoverage=18%, E-value=3e-56, Identity=89%"; Hit description=9-cis- epoxycarotenoid dioxygenase NCED1, chloroplast precursor
MVETALVSHERQHPLPKTADPRVQIAGNFAPVPEHPAHQSLPVTGKIPKCIEGVYVRNGANPLYEPVAGHHFFDGDGMVHAVKFHSGAASYACRFTETQRLSQEKSLGRHVFPKAI

SEQ ID NO: 117206 - protein, 133 aa, Glycine max
  Coding DNA Sequence Number=SeqID_25521
MGTILSHSAYAAVHMINEAAATRPTTTDPAAANPFETAAFSDGAGASDGGEEIDEGEDAGTKEGGDGGEIPPEGEGVGETAGGDLDEEGEGVAAFGGVAGDSGDDAGDCATPEKTKIAASRRTSAEEEEVILR

SEQ ID NO: 117207 - protein, 557 aa, Glycine max
  Coding DNA Sequence Number=SeqID_25522
  Gene Ontology: Mol. function=transporter activity; Cellular component= membrane; Biological process=sodium ion transport
  Homolog annotation: Hit_ID=A4UTS0; Match level="QueryCoverage=91%, HitCoverage=99%, E-value=0.0, Identity=77%"; Hit description =Chloroplast glutamate/malate translocator
  Pfam annotation: Domain name=CitMHS; Domain location=121-489; Score= -110.5; E_value=0.016; Accession=PF03600.7; Description=Citrate transporter
  Pfam annotation: Domain name=DctM; Domain location=124-544; Score= -228.8; E_value=0.022; Accession=PF06808.3; Description=DctM-like transporters
  Pfam annotation: Domain name=Na_sulph_symp; Domain location=87-557; Score=597.9; E_value=9.4e-177; Accession=PF00939.10; Description =Sodium:sulfate symporter transmembrane region
  Pfam module annotation: Pfam domain module=CitMHS::DctM::Na_sulph _symp; Domain location=121-489::124-544::87-557
  Subcellular localization annotation: CTP_CleavageSite=70; ConfidenceScore=5.68e-01
MESYALHSLSTSFSRFSQLHHPPPPVISRSQFNQSQSLSLRSPITISQRFSFPSSTFKFNPFSKPHYPIQASPSSPPPPPPPTPIQGAKPIPFIISISIGLIVRFLVPKPVQVTPEAWQLLSIFLSTIAGLVLSPLPVGAWAFLGLTASVVTKTLTFTEAFGAFTNEVIWLIVISFFFARGFVKTGLGDRIATFFVKWMGKSTLGLSYGLTFSEVLIAPAMPSTTARAGGVFLPIIKSLSLSAGSEPASPTSKKLGAYLIQNQFQSAGNSSALFLTAAAQNLLCLKLAEELGVIVPNPWVTWFKAASLPAIVCLLLTPLILYKLYPPVIKDTPEAPALAAKKLESMGPVTKNEWIMVGTMLLAVSLWIFGDTIGIASAVAAMIGLSILLLLGVLDWNDCLNEKSAWDTLAWFAILVGMASQLTNLGIVSWMSDCVADNLRSFSLSWPASLAVLQAAYFFIHYLFASQTGHVGALYSAFLAMHRAAGVPGILAALALGYNTNLFGAITHYSSGQAAVYYGAGYVDLPDIFKMGFIMAFINAIIWGGVGSVWWKFLGLY

SEQ ID NO: 117208 - protein, 99 aa, Glycine max
  Coding DNA Sequence Number=SeqID_25523
MVNNPSIRISHWRSEFQESHYLSSLSAWLVGILSKVPSVAANMPKRVLLELLCRCLLTSQLCNKQLVDSTLQLAELIDERYLVDKVQKFFIDFKEHFPS

SEQ ID NO: 117209 - protein, 86 aa, Glycine max
  Coding DNA Sequence Number=SeqID_25524
MIEQQYMKPWGAAENKCCQAFFGTQVKTGADSSITIASVLYLSDLTQGSTVRQYNSLWSFIKQEELDRTTNDEDLLNRWPLPTLKR

SEQ ID NO: 117210 - protein, 68 aa, Glycine max
  Coding DNA Sequence Number=SeqID_25525
MGDSNGKVMMPEVWQVQVSVLGSGFWDYHARGGWDGNVHRCPLDMIVILHHVSPRLNSSSRWIIMEIM

SEQ ID NO: 117211 - protein, 608 aa, Glycine max
  Coding DNA Sequence Number=SeqID_25526
  Gene Ontology: Mol. function=transferase activity, transferring glycosyl groups; Cellular component=cytoplasm; Biological process =metabolic process
  Homolog annotation: Hit_ID=A6XNC5; Match level="QueryCoverage=76%, HitCoverage=96%, E-value=0.0, Identity=73%"; Hit description =(Iso)flavonoid glycosyltransferase
  Pfam annotation: Domain name=UDPGT; Domain location=12-483; Score= -12.1; E_value=5.4e-10; Accession=PF00201.9; Description=UDP -glucoronosyl and UDP-glucosyl transferase
MSLLNEERKPHAVVTPYPVQGHVNPLFKLAKLLHLRGFHITFVHTEYNYKRLLKSRGPNALDGLPDFRFESIPDGLPPLDDDNVTQHVPSLCDSIRKNFLKPFCKLVHRLNHSSATEGLIPPVTCLVSDGCMPFTIQAAQELGLPNFIFWPASACSFLSIINFPTLVEKGLTPLKDESYLTNGYLDSKVDWIPGMKNFRLKDIPDFIRTTDLNDVMLQFFIEVANRIQRNTTILFNTFDGLESDVMNALSSMFPSLYPIGPFPLLLNQSPQSHLTSLGSNLWNEDLECLEWLESKESRSVVYVNFGSITVMSAEQLLEFAWGLANSKKPFLWIIRPDLVIGGSVILSSEFVSETRDRSLIASWCPQEQVLNHPSIGVFLTHCGWNSTTESVCAGVPMLCWPFFAEQPTNCRYICNEWEIGMEIDTSAKREEVEKLVNELMVGEKGKKMREKVMELKRKAEEVTKPGGCSYMNLDKNFLHCRNGALEVPLCVLFIVAEDGEAGGGGAAGGHGNALFPVGAHKKTSTQTKRFYFYEHTKKIVENVLIFYMPVLLPITHLSSSPLSLVVPFRKRRWPRAAIIGISLQAVKMMVSMLSLISLSTEQFRVVEG

SEQ ID NO: 117212 - protein, 92 aa, Glycine max
  Coding DNA Sequence Number=SeqID_25527
MQTKIQQYNTKTCGEGFSNLEGDQEDQRNNGQIRQKHHNSNHGPPRKQEQEALPKKRGTTATNAGEQRKKKHQRKKEEEVVPKKKKGHRRGE

SEQ ID NO: 117213 - protein, 319 aa, Glycine max
  Coding DNA Sequence Number=SeqID_25528
  Gene Ontology: Mol. function=hydrolase activity
  Homolog annotation: Hit_ID=A7QIF0; Match level="QueryCoverage=73%, HitCoverage=75%, E-value=9e-97, Identity=68%"; Hit description =Chromosome chr12 scaffold_103, whole genome shotgun sequence
  Pfam annotation: Domain name=Abhydrolase_1; Domain location=81-286; Score=3.6; E_value=0.0026; Accession=PF00561.11; Description =alphabeta hydrolase fold
MLPKLSKCISFTASRDWLYRHLFAAAGLRSVATDLGEGTIVHCWVPKMHKPCKPSLVLIHGFGANAMWQYGEHIRLFMGHFNVYVPDLVFFGESFTLRAERSEYFQAECMVKMMEAHGVHKMSLVGISYGGFVGYRVAAHFPDVVEKIVLCCAGVCLEEVDMENGLFRVSNLDEASSILLPQTPDKLRELMKLSFVRPARGVPTWFLQDFIQVMCTDYIEQKRELLEAILKGRHLSDLPKIQQNSNPPSIPPSLHSLPPTHSNFMGRARSDIPSGVRTQIKKAYRGKCSNGSHQECRACSEPRKGQRVWQALESIPYRF

SEQ ID NO: 117214 - protein, 911 aa, Glycine max
  Coding DNA Sequence Number=SeqID_25529
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=99%, HitCoverage=81%, E-value=0.0, Identity=48%"; Hit description =Calmodulin-binding transcription activator 2
  Pfam annotation: Domain name=Ank; Domain location=700-732; Score =11.9; E_value=0.63; Accession=PF00023.21; Description=Ankyrin repeat
  Pfam annotation: Domain name=Ank; Domain location=733-765; Score =37.8; E_value=3.8e-08; Accession=PF00023.21; Description=Ankyrin repeat
  Pfam annotation: Domain name=CG-1; Domain location=11-134; Score =290.1; E_value=4.4e-84; Accession=PF03859.7; Description=CG-1 domain
  Pfam module annotation: Pfam domain module=Ank::Ank::CG-1; Domain location=700-732::733-765::11-134
MWVFFSYIQQLQFEAQHRWLRPAEICEILRNYRMFHITSEPHNRPPSMVTACGSLFLFDRKVLRYFRKDGHNWRKKKDGKTVKEAHEKLKIGSVDVLHCYYAHGEENENFQRRSYWMLEPDMMHIVFVHYLEVKGNKNIVVNTEGDEIPSDSQKVTSSSSSLPTHHSSVPSLSTDSVSPTTSLMSLREDADSEDIHQASSGLRPLYESQHSGNGPLTEKIGAGSNSSYLIHPFSGDYEQSSISGTDYIPVVHGDKFRGNDTAYIDGQKTHDVATWSTVLQSTAKLHNDPSLASSPSIPSSSMGDVLEQEHTIFSDLLMSKSGLTEVAESSQSLQSNWQIPFEDNSGGMPMLTQTQTFGLQFRSDYGTGLLGNETRNACSESAAILYSFNGEPKEQPMQQNYLQELEDGQSQHALKSNSANKVPDEETINYGLTVKRTLLDKDESLKKVDSFSRWITKELGEVADLNMQSSPGISWSTDECQHVIDDTSLSPSLSQDQLFSINDFSPKWAYAESEIEVLIIGSFLKSQPEVTTCNWSCMFGEVEIPAKVLADGILCCQAPRHKVGRVPFYVTCSNRLACSEVREFDFREGFARNVDFADFYNSSEILLHLRLEDFLSLKPVDPSNHSFEGDMEKRNLIFQLISLREVEEYSIKDEVTTELDISQHMVKEHLFHKQFKEKLYSWLLHKVTESGKGPNVLDEDGQGVLHLAAFLGYDWAINPIISAGVNINFRDVNGWTALHWAASCGRERTVAVLVSMGADCGALTDPSPSSPAGRTAADLASSYGHKGISGFLAESSLTHHLETLTMDDQKGGRQEISGMKAVQTVSERSATPVHFGDMPDLCLKDSLTAVRNATQAADRIHQVYRMQSFQRKQLTQYESDELGLSDQQALSLLASRACKSGQGDGLANAAA

SEQ ID NO: 117215 - protein, 218 aa, Glycine max
  Coding DNA Sequence Number=SeqID_25530
  Homolog annotation: Hit_ID=Q9SZC9; Match level="QueryCoverage=28%, HitCoverage=6%, E-value=2e-10, Identity=60%"; Hit description =Putative copper-transporting ATPase PAA1
MEYLYLFLKLGIDDVIYDGDASGEAGGAEPLRGDGGLQQQTRMQDHVLEVLLANVEECEDVVLHRELALVDNGGCERCFVSVLIMSSSLSIPIPFPIAMDSASSLTVTQIALFKPLKQKHHFVRGRVSVIRPLHRRLNSVSPPRCSSAVDCGQPQVLSAHVNLTSETATVSLVPEQKTAPDGLKQLGEELAQHLTTCGFTSTLRVLCNIERSAKWVFL

SEQ ID NO: 117216 - protein, 842 aa, Glycine max
  Coding DNA Sequence Number=SeqID_25531
  Gene Ontology: Mol. function=potassium ion transmembrane transporter activity; Cellular component=integral to membrane; Biological process=potassium ion transport
  Homolog annotation: Hit_ID=A7QII3; Match level="QueryCoverage=99%, HitCoverage=99%, E-value=0.0, Identity=75%"; Hit description =Chromosome chr12 scaffold_103, whole genome shotgun sequence
  Pfam annotation: Domain name=K_trans; Domain location=95-842; Score =1169.9; E_value=0; Accession=PF02705.7; Description=K+ potassium transporter
MAEEINGGTSMDSTESRWVIQDEDEDASDLENFDADLRFRRHAGVVDSEDEDDNAEQRLIRTGPRIDSFDVEALEVPGAAHRTDYEDISVGKKIVLAFQTLGVVFGDVGTSPLYTFSVMFRKAPINGNEDILGALSLVLYTLILIPLVKYVLVVLWANDDGEGGTFALYSLICRHAKVSLLPNQLPSDARISSFRLKVPSPELERSLKIKERLENSLTLKKTLLFFVLAGTSMVIANGVVTPAMSVLSSVGGLKVGVDAIKKDEVVMISVACLIILFSVQKYGTSKMGLAVGPALFLWFCSLAGIGIYNLVKYDSSVLRAFNPIHIYYFFKRNSTKAWYSLGGCLLSATGSEAMFADLCYFSVRSVQLSFVFLVLPCLLLGYLGQAAYLMENHADAGQAFFSSVPSGAFWPTFLIANIAALIASRAMTTATFSCIKQSTALGCFPRLKIIHTSRKFMGQIYIPVINWFLLALSLVLVCTISSIDEIGNAYGIAELGVMMMTTILATLVMLLIWQIHIIIVLSFVVVFLGLELTFFSSVLWSVTDGSWIILVFAIIMFLIMYVWNYGSNLKYETEVKQRLSTDLMQELGCNLGTIRAPGIGLLYNELVKGIPAIFGHFLTTLPAIHSMIIFVSIKYVPVPMVPQSERFLFRRVCPKSYHIFRCIARYGYKDVRKENHQTFEQLLIESLEKFIRREAQERSLESDGDGDTGSEDEYPNSRVLIAPNGSVYSLGVPLLAGFKDTSNPVLEESTLDVISPVSTDPLVFDAEQSLESELSFIHKAKESGVVYLLGHGDIRARKESWFIKKLVINYFYAFLRKNCRRGITTLSVPHSHLMQVSMTYMV

SEQ ID NO: 117217 - protein, 232 aa, Glycine max
  Coding DNA Sequence Number=SeqID_25532
  Gene Ontology: Mol. function=protein kinase activity; Cellular component=integral to membrane; Biological process=protein amino acid phosphorylation
  Homolog annotation: Hit_ID=A7Q6Y2; Match level="QueryCoverage=39%, HitCoverage=28%, E-value=8e-26, Identity=64%"; Hit description =Chromosome chr12 scaffold_57, whole genome shotgun sequence
  Pfam annotation: Domain name=Pkinase_Tyr; Domain location=5-167; Score=-164.9; E_value=0.026; Accession=PF07714.8; Description =Protein tyrosine kinase
MGELLRASAEALGHGILGNSYKAMLNDGSTIVVKRLRDLKPLSKEEFAKILNVIADMKHPNLLSLLAYYHSRDEKLMLYRYAENGNLFSRLHVQIIIPILKKEQKEKRLRRWKPSSIQLELKIVSCKRSGTSIGVPAAQPQQHRPTRQLAVFQRRRHSSCFRLRPSLLDSTTDCSSAHGCLQVTRMFGATLHKGAVREEWTAEIFDKEICGQKSALAGMLMLLQIAMRCIER

SEQ ID NO: 117218 - protein, 657 aa, Glycine max
  Coding DNA Sequence Number=SeqID_25533
  Gene Ontology: Mol. function=secondary active sulfate transmembrane transporter activity; Cellular component=integral to membrane; Biological process=sulfate transport
  Homolog annotation: Hit_ID=P53391; Match level="QueryCoverage=99%, HitCoverage=99%, E-value=0.0, Identity=78%"; Hit description=High affinity sulfate transporter 1
  Pfam annotation: Domain name=STAS; Domain location=528-645; Score =144.6; E_value=2.8e-40; Accession=PF01740.12; Description=STAS domain
  Pfam annotation: Domain name=Sulfate_transp; Domain location=194-505; Score=524.5; E_value=1.2e-154; Accession=PF00916.11; Description =Sulfate transporter family
  Pfam annotation: Domain name=Voltage_CLC; Domain location=179-505; Score=-183.0; E_value=0.076; Accession=PF00654.11; Description =Voltage gated chloride channel
  Pfam annotation: Domain name=Xan_ur_permease; Domain location=97-492; Score=-139.7; E_value=0.0068; Accession=PF00860.11; Description =Permease family
  Pfam module annotation: Pfam domain module=STAS::Sulfate _transp::Voltage_CLC::Xan_ur_permease; Domain location=528-645::194 -505::179-505::97-492
MSQHVSDEVVAKDMGEIRSGPSSRRHGDTLPHIHKVGTPPKQTLFQEIKHSVVDTFFPDKPFEQFKDQTGGRKFLLGLQSLFPLFEWGRDYNLKKFRGDFISGLTIASLCIPQDIAYAKLANLEPQYALYTSFVCPLVYAFMGSSRDIAIGPVAVVSLLLGTMLTDEISDFKSHEYLRLAFTATFFAGVTQMALGVLRLGFLIDFLSHAAIVGFMAGAAITIALQQLKGFLGIKAFTKKTDIVSVLRSVFNEAHHGWNWETIVIGVAFLVFLLITKYIAKKNKKLFWVAAISPMISVIVSTFFVYITRADKKGVAIVRHVKKGVNPSSASEIFFSGKYLGPGIRVGVVAGMVALTEAVAIGRTFAAMKDYSLDGNKEMMAMGTMNIIGSLTSCYVATGSFSRSAVNYMAGCKTAVSNIVMSIVVLLTLLLITPLFKYTPNAVLASIIIAAVLGLVNIEAVILLWKIDKFDFVACMGAFFGVIFISVEIGLLIAVAISFAKILLQVTRPRTAVLGKLPGTTVYRNILQYPKATQINGMLIIRVDSAIYFSNSNYIKERILRWLADEAAQRTNGSSRIEYAIVEMSPVTDIDTSGIHAFEELYKTLQKRKIQLILANPGPIVMEKLHASKLADLIGEDKIFLTVADAVSTFGPKGEAVV

SEQ ID NO: 117219 - protein, 33 aa, Glycine max
  Coding DNA Sequence Number=SeqID_25534
VKSFNGVDMMTKALLRGKFEACYEISGLAVTSA

SEQ ID NO: 117220 - protein, 77 aa, Glycine max
  Coding DNA Sequence Number=SeqID_25535
  Subcellular localization annotation: CTP_CleavageSite=33; ConfidenceScore=5.05e-01
MDAVLSSKSSTNNQRKKQLEGKKRKLTSTPKMQVKMEKTKMDKTKGRNEQEDVAEEVLGAPAIVLGAPSNTPNTKAS

SEQ ID NO: 117221 - protein, 171 aa, Glycine max
  Coding DNA Sequence Number=SeqID_25536
MAAIITGQAVAIDFRLAAVTVEVIVEGGEVGFGGDAVIVRIDGDQAYCAVAAVIAARLDAVAGDFAGYAVLVVDQELEDRLAILVVGDVGFCAIAEDMTGEGHDDVRITGQQDAGDIFAVVCAALVGAHTVIVAGAFVIERQGQIVLTAGIARQRMRCEHHAMVGKLLDHI

SEQ ID NO: 117222 - protein, 81 aa, Glycine max
  Coding DNA Sequence Number=SeqID_25537
MYRSPTGNLVPLDLEIEATLRRNGAERRRKLLQDRTMITKDDDKGDDKKLKGQSKKEIKISRIKIQEIKIQDSRFKNQEKA

SEQ ID NO: 117223 - protein, 104 aa, Glycine max
  Coding DNA Sequence Number=SeqID_25538
QENELHFMENAMNSAFSEELAKRTYRAKRVHPLRMNTHCRNVPFCGRAKARLTGALSKGGKMRGVATNEGISTFHVDKSGALAPTYPPSKRKSNLRSSSLFYLK

SEQ ID NO: 117224 - protein, 109 aa, Glycine max
  Coding DNA Sequence Number=SeqID_25539
MGSEWTKLSECLVLSPKTSLHFNSLELGLARMLVVATYPSAGGRRVTRGMRVPRKEYARSRHQRLFEENVGKTGKDAIYELFSEKVRELYLRTGKVLAPHTSVPRDGSL

SEQ ID NO: 117225 - protein, 110 aa, Glycine max
  Coding DNA Sequence Number=SeqID_25540
MGIAPTKTPSGPEEGARPPSSSCHHDIGKDCARKTPSGPEEGQQCLGVASSKYGSLSVQGSACCPQQGHQAPLPIEFSSRSDASPGRRRAKHHSSLGMAGSGQQTHRHHL

SEQ ID NO: 117226 - protein, 360 aa, Glycine max
  Coding DNA Sequence Number=SeqID_25541
  Homolog annotation: Hit_ID=Q2HW90; Match level="QueryCoverage=84%, HitCoverage=71%, E-value=3e-29, Identity=31%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMANQGEWVPFMDVLALLIFGVVLFPNVDGLVGLAAIDAFLAYHHSKESPVVAVLADLFDTFDRRCEKSSARDHLLLTPPSVFEENGLGPALGRDRRGCINYNPMLAIRQLGYPMRGAPTEESMSPFLVRDLGAQNSKTIQRIHKAWETPLRKDQELRGIRNGIIGEYHEWLKIRIRGLDWLAKLKVVSEENFEAPEEDEEVQALKSELGKAKL

SEQ ID NO: 117227 - protein, 100 aa, Glycine max
  Coding DNA Sequence Number=SeqID_25542
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q2PMN2; Match level="QueryCoverage=35%, HitCoverage=7%, E-value=6e-11, Identity=91%"; Hit description =NAD(P)H-quinone oxidoreductase chain 4, chloroplast (EC 1.6.5.-) (NAD(P)H dehydrogenase, chain 4)
MVTRHPRRGTLQHLNWFYKRYRSQRGYFTNNISRIYWRCAFFLGGNEYDRLRLLYLDEMGGMAIPMPKIFTVFTIYRWLLLHCRHERFCCRIDSLIGNNY

SEQ ID NO: 117228 - protein, 67 aa, Glycine max
  Coding DNA Sequence Number=SeqID_25543
MDATVMSCRSFLLLSTLFLHNVALISKSRGTKLPVGDLCIYTTNRTTVIQFNKKRQIGIKNKYSQKQ

SEQ ID NO: 117229 - protein, 52 aa, Glycine max
  Coding DNA Sequence Number=SeqID_25544
MKIQLLMNSLTSLLAKPVLSGRVVALCAPCCAKRKSFSVLKICGVGLSEPTR

SEQ ID NO: 117230 - protein, 97 aa, Glycine max
  Coding DNA Sequence Number=SeqID_25545
  Gene Ontology: Mol. function=C4-dicarboxylate transmembrane transporter activity; Cellular component=integral to membrane; Biological process=C4-dicarboxylate transport
  Homolog annotation: Hit_ID=P0ABP1; Match level="QueryCoverage=100%, HitCoverage=21%, E-value=2e-30, Identity=75%"; Hit description =Anaerobic C4-dicarboxylate transporter dcuB
  Pfam annotation: Domain name=DcuA_DcuB; Domain location=6-97; Score= -161.9; E_value=1.3e-08; Accession=PF03605.5; Description=Anaerobic c4-dicarboxylate membrane t
MEFAIQLIIILICLFYGAKKGGIALGLLGGIGLVILVFVFHLKPGKPPVDVMLVIIAVVAASATLQASGGLDVMLQIAEKLLRRNPKYVSIVAPFVT

SEQ ID NO: 117231 - protein, 128 aa, Glycine max
  Coding DNA Sequence Number=SeqID_25546
MAQKKLSEKRSRRDAAAEGTSAAPEFDSHCFRSAEHQQRFEAIKGWSFHRERRVQLRNDEYTDFQEEIARQRWTSLVTPMAKFDPDIVLEFYANAWPTEEGVRDMRSWVRGQWIPFDADALSQFLGTR

SEQ ID NO: 117232 - protein, 103 aa, Glycine max
  Coding DNA Sequence Number=SeqID_25547
MGSFIAGTQSGYLGRNEFGCQGVGLGPNFHIIPQGTRDNDDLKTTCKISHGYSQVGTQASRLWHCDTTVGNLHRQTQCFQIMFFHQFNEFIHSYLGSFRKINS

SEQ ID NO: 117233 - protein, 159 aa, Glycine max
  Coding DNA Sequence Number=SeqID_25548
MPISPCRCIGWDRAHKSPSGPEVVLQGARFPRQGHVIIGIAPAKHPVDPKKSNRFYGVPVTSSKGIRPPTNRAFIRSTASPGRRRAKHHSSLGMAGSGNRRTAITSRVHLSSSAKRLERCLRHMADQQATKSKAKGKQSTRSMTYKPSCVQLKTLKKRY

SEQ ID NO: 117234 - protein, 168 aa, Glycine max
  Coding DNA Sequence Number=SeqID_25549
  Homolog annotation: Hit_ID=Q6WAY6; Match level="QueryCoverage=95%, HitCoverage=26%, E-value=4e-08, Identity=26%"; Hit description =Putative uncharacterized protein
MGMRGCINYNPVLAIRQLGYPMRGAPLEEGLTAFIARGFNSTNAGVLQRVRKAWEMVQKKDEELRGSSHGPIGGYHRCLKAYAQGLDWLPNLRTTKEVEGEAPEEDKEVQALKTKLEKAQIAKEKFKSTAIRIRKENAKLRDVNIATTKALEQETKRAHKEEHGWNKF

SEQ ID NO: 117235 - protein, 333 aa, Glycine max
  Coding DNA Sequence Number=SeqID_25550
  Gene Ontology: Mol. function=transporter activity; Cellular component= membrane; Biological process=transport
  Homolog annotation: Hit_ID=A0GEL0; Match level="QueryCoverage=71%, HitCoverage=29%, E-value=3e-44, Identity=40%"; Hit description =Fimbrial biogenesis outer membrane usher protein precursor
  Pfam annotation: Domain name=Usher; Domain location=72-333; Score= -489.3; E_value=0.024; Accession=PF00577.11; Description=Fimbrial Usher protein
MGGRRGAVYASAHFDYERCRLWPHRVTFSMQKRAFPCRNHCRLISRPLRVAIAVAMAMAVASHAHAVDGEPLQFSAGFLIGGKAIDMQRYAQGNPMEPGDYPLDVVVNGQFLENRDIRFVEAPAPVGATPCLPMALLGRLNLKDSYLADLQEDAEGCIALPALVEGATVEFDAGNLQLLVNVPQAAQARNARGYVAPDQRDHGVTAAFFDYNVNHNRAQGQDATYLGLNTGLNLGAWRLRHRSSFSQSSHGTRHDVISSYLQRDLPVCNSQLLLGQGNTGGELFESLSFTGARVASDERLLPDSLRGVRAGGAGHCRGQCAGDHPPERQHHLR

SEQ ID NO: 117236 - protein, 91 aa, Glycine max
  Coding DNA Sequence Number=SeqID_25551
MSPVESPTVATCPFAGGRRVTRGMRVPRKEYARSRHQHLFEENVGKTEGKPVKKKILSSGVVFTLEEGDHFKALDLENDPFYLVRNRNDKL

SEQ ID NO: 117237 - protein, 83 aa, Glycine max
  Coding DNA Sequence Number=SeqID_25552
MEKEDNWRHLLKEKMSQEEAHHHRKNLLKEASQGGELSYERASSPSFLSKAHLGGEAPSSMAYSLVDGASSHLFSFVFRCISM

SEQ ID NO: 117238 - protein, 204 aa, Glycine max
  Coding DNA Sequence Number=SeqID_25553
MGEVEEVQEKMKADMEAIKEKMATMMEAMMSVKKIMEANAVAIAATSVVAKVNPTSPSGLKQMNHPTSNMVGKDLGSTGGPHDVQIQNEHAFPSYGLPLNYTPPNVAYTPNKNVNNSTPIPIESQQPQTDHAHEWEKLDHLEERLRAIEGGEDYAFANLEELFLIPKHGHSQVQGAGLWQVQGDYSLQEPSKDVLSEDGGIRKR

SEQ ID NO: 117239 - protein, 153 aa, Glycine max
  Coding DNA Sequence Number=SeqID_25554
  Homolog annotation: Hit_ID=Q84VH5; Match level="QueryCoverage=49%, HitCoverage=11%, E-value=6e-23, Identity=75%"; Hit description =Envelope-like protein
MLSQHPNILNNIDSVKKRESPLSLHYKLFEGTHVPDIVLTSGKAAASGAVSKDDLIAELKDTCKVLEAIIKANTEKIIIAGTPDQKTLRHMAFDDGEAAEEEEDAAEDTKSDDDDSDATPMTIRPLILLCLITLIMKVADPTCMTARTCSGSV

SEQ ID NO: 117240 - protein, 57 aa, Glycine max
  Coding DNA Sequence Number=SeqID_25555
MREDAEKARMHEVGCERKCSKFRSCRLADDAILPRRALDRRLQEDWAKDARECPRVS

SEQ ID NO: 117241 - protein, 169 aa, Glycine max
  Coding DNA Sequence Number=SeqID_25556
MRGLHLLAIRGLHALTSRGLHILALRGLHALTIRGLRVLIFNVLHIHTLREFKGSHPQRHPVDLKKSNRALGFPALVTGLYQPYRAPVPPASSCHHDIGIVPARHLVDSKKANRVLELPALNTGLYQFKGVPVAPSRVIRPPTNRAFIKKCCAPRQAQGETPQQHWDGR

SEQ ID NO: 117242 - protein, 213 aa, Glycine max
  Coding DNA Sequence Number=SeqID_25557
EYVKRLYDQVKVQIAKKNESYVKQAHKKRKEVGMMRIMKLAKYRLKAQVEKDEGPSGEGQSPRVEKDEGSSNPCGVYPDLSSFTGSGVYPDLSSFTRSGVYPDLSSFTGSGVIQKLYTCIKQSAPTQISDSLVISPSAFMIMVLLVGHSEAICPLPKHLKHFMFLVPVLDEEVEVLCLLPPTLGVADFPCGDVAAGRNELPPSILDLLAQFWL

SEQ ID NO: 117243 - protein, 104 aa, Glycine max
  Coding DNA Sequence Number=SeqID_25558
MATCKSVNVNPMNYMSPLFTLQHILHVYDNSFGLVPHKSMWQEYEGDKWGPNPRRKRTAKGRLVSPGVSSEMDGNENKRKSRKKMLNFRQHGHNKNNCPNIFSS

SEQ ID NO: 117244 - protein, 204 aa, Glycine max
  Coding DNA Sequence Number=SeqID_25559
MSVLELYIEKDVAGGSMFHSANSLTSCGNYVSNDYTQPPTNMSNLNLDEDDDHDDDDYLVSNSYVEESLDEDDSVDGISDTDDEVPDIPQPVRIVHPAEGAQRIENPFWNDALHYNNINWSYPDEEDICGLEMPSTFNVGQELYVGMEFDSKDAVKNALKQYVMKVHQSFKVVESKSNKYVESHTMGWTTHMSEYDHDTRSRET

SEQ ID NO: 117245 - protein, 86 aa, Glycine max
  Coding DNA Sequence Number=SeqID_25560
  Subcellular localization annotation: CTP_CleavageSite=45; ConfidenceScore=5.73e-01
MATPPASPPPPPPPPPPADASTSPFTLKWTRKATRLRSLATRPPRVERPVVNIDPTTGKADSPHKKKLRTYLGIVTRDKVDVTYDT

SEQ ID NO: 117246 - protein, 104 aa, Glycine max
  Coding DNA Sequence Number=SeqID_25561
  Subcellular localization annotation: CTP_CleavageSite=32; ConfidenceScore=5.46e-01
MKNKKNGPQHQGKPYSTPPKQYGNRPNNQRTVAMGFAGGSGSKPNTFPTQIIFYKCDKRGIFREIVHIPRRSIMVGARMTKLDIRRPREKSLPLMVPKLQNPKI

SEQ ID NO: 117247 - protein, 65 aa, Glycine max
  Coding DNA Sequence Number=SeqID_25562
MAEQAKQVFMFKTYVMKGKWLPHPALLLLLLLLLLLIVARDKLDVTYENWKQVPAAQKDLIWEDI

SEQ ID NO: 117248 - protein, 169 aa, Glycine max
  Coding DNA Sequence Number=SeqID_25563
MEGFLVSGKYVALQICDDEDVETMLESFQQQDQMSVLELYIEKDVSNLHGDEDDDDDDDYLVSNSYVEESLEKDDNIDGISNTDDDDEVTDMIQPVRIVHPVEGVQGIQNPFWNDALHYNNINWSHPDEEDICGLEMPSSFNVGQKLYVGMDFDSNDAVKNVVKQYVMK

SEQ ID NO: 117249 - protein, 44 aa, Glycine max
  Coding DNA Sequence Number=SeqID_25564
MGGKWPEVETVPWWRPVLSAQTPASQGDWLAKLAMGKLSPIQYD

SEQ ID NO: 117250 - protein, 138 aa, Glycine max
  Coding DNA Sequence Number=SeqID_25565
MKAQVEKDEGPEAEALSRQLMLLKAQTNLKAQTYQGNPCGVCLDLSSFTGSGVYPDLSSFTGSGVYPDLSSFIGSGVYPDLSSSLGSGVYPDLSSLTGSGVYPDLSSFTGSGVYHDLSSFTGSGVIQTFVACIKRSAP

SEQ ID NO: 117251 - protein, 286 aa, Glycine max
  Coding DNA Sequence Number=SeqID_25566
  Gene Ontology: Mol. function=protein binding; Cellular component =integral to membrane; Biological process=defense response to fungus
  Homolog annotation: Hit_ID=Q1SWI7; Match level="QueryCoverage=100%, HitCoverage=80%, E-value=2e-58, Identity=36%"; Hit description =Leucine-rich repeat
  Pfam annotation: Domain name=LRR_1; Domain location=113-136; Score =11.9; E_value=1.9; Accession=PF00560.24; Description=Leucine Rich Repeat
  Pfam annotation: Domain name=LRR_1; Domain location=138-166; Score =6.1; E_value=22; Accession=PF00560.24; Description=Leucine Rich Repeat
  Pfam annotation: Domain name=LRR_1; Domain location=186-205; Score =5.3; E_value=32; Accession=PF00560.24; Description=Leucine Rich Repeat
  Pfam annotation: Domain name=LRR_1; Domain location=40-62; Score=1.7; E_value=1.5e+02; Accession=PF00560.24; Description=Leucine Rich Repeat
  Pfam annotation: Domain name=LRR_1; Domain location=64-86; Score =10.3; E_value=3.8; Accession=PF00560.24; Description=Leucine Rich Repeat
  Pfam annotation: Domain name=LRR_1; Domain location=88-110; Score =10.4; E_value=3.6; Accession=PF00560.24; Description=Leucine Rich Repeat
  Pfam module annotation: Pfam domain module=LRR_1::LRR_1::LRR_1::LRR _1::LRR_1::LRR_1; Domain location=113-136::138-166::186-205::40 -62::64-86::88-110
TIPTSLANLCNLREIGLSYLKLNQQVNELLEILAPCISHGLTTLAVRSSQLSGNLTDQIGAFKNIDMLDFSNNLIGGALPRSFVKLSSLRYLYLSINKFSGNPFESIGSLLSKLSSLRIDGNNFQGVVKEDDLANLKSLKEFHASGNNFTLKVGSNWLPSFQLTYLDVGSWQLGPSFPSWIQSQKKLKYLGMSNTGIIDSIPTQMWEAQSQVLYLNHSHNHIHGELVTTLKNPISIPTVDLSTNHLCGKLPYLSNDVYGLDLSRESLKTTIYCILNERPFAELPSS

SEQ ID NO: 117252 - protein, 109 aa, Glycine max
  Coding DNA Sequence Number=SeqID_25567
  Homolog annotation: Hit_ID=A7QIT8; Match level="QueryCoverage=45%, HitCoverage=13%, E-value=1e-13, Identity=64%"; Hit description =Chromosome chr2 scaffold_105, whole genome shotgun sequence
MAYFVGRVERSTTRIPWLNREPYAYWKGNPAVAETRQDLMKCNVYENQDWNARLFAQIITEFEDNRIWEKHYLCPLTNCSALMLSRLNLIPEVSGSVVWRRNQLVAPID

SEQ ID NO: 117253 - protein, 126 aa, Glycine max
  Coding DNA Sequence Number=SeqID_25568
AHLRPHSHWREKERKPQEANINLPYFHGKDNVEANLDWEIWVEQQLKRKSTSKSYGSHSYPKKDQDIYSSQDEATTSPSSSESEEAKGHLLALPHQGLEFIPQVKELLDEGLHGSLLVELLWRLDL

SEQ ID NO: 117254 - protein, 116 aa, Glycine max
  Coding DNA Sequence Number=SeqID_25569
MSLGNYFLKIPSGNQLQDLCNQLQDGPLGTSTLVSRGLYVLALRGLHVLTIRGLHAFTSRGLHVLALRGLHALTLGTSYPHRQRTTRPHHQRAARPHLQRTIRPRLERDTRPHLGY

SEQ ID NO: 117255 - protein, 180 aa, Glycine max
  Coding DNA Sequence Number=SeqID_25570
AHKNPRAFSCIFGPIYLEFSIQCPCGGETLPTYSRFTRMRIDPQEFASRLCIPGRGFVLNAGGHPWKLLRKDLTTLAQTWSVLSYNNLTPTSHTSDLNMDRDRLVYGLVTGMDVNIRALISGQISTIAKSNSFRLGFPALITALYRARGVTSDSLTYESLSPTINLAYIKKNCWNVDDLT

SEQ ID NO: 117256 - protein, 133 aa, Glycine max
  Coding DNA Sequence Number=SeqID_25571
MVKEECKEVSVSSKRLAKKERHFEIKTNIKEISLLRQPPHFLLCKKTLVSIATSLRLEFIPQVKELLDEGLVRKRLNPCALLVPKIVSIQTLGTHMGHLRGPMNPKRIKVIPEWPAPPSVLRKKAQRFKNLGI

SEQ ID NO: 117257 - protein, 150 aa, Glycine max
  Coding DNA Sequence Number=SeqID_25572
  Gene Ontology: Mol. function=arsenite transmembrane transporter activity; Cellular component=integral to membrane; Biological process=response to arsenic
  Homolog annotation: Hit_ID=Q68GK2; Match level="QueryCoverage=100%, HitCoverage=34%, E-value=4e-68, Identity=86%"; Hit description=ArsB
  Pfam annotation: Domain name=ArsB; Domain location=1-146; Score= -35.7; E_value=1.3e-09; Accession=PF02040.6; Description=Arsenical pump membrane protein
MADRYFLAGHVPRGLWLRNAGLTEYLSGVLNLLADKGLWAATFGTGFLTACLSSVMNNMPTVLIGALSIDGSTATSVVKEAMIYANVIGCDLGPKITPIGSLATLLWLHVLAQKNMTITWGYYFRTGIIMTLPVLFITLAALALRLSITL

SEQ ID NO: 117258 - protein, 74 aa, Glycine max
  Coding DNA Sequence Number=SeqID_25573
MVIIFKALDLKNDPFYLLKTEENEERTMNVEERLKSSRNYSRNLTERYGSASAWIFFTETIFLWISRDKKCQEG

SEQ ID NO: 117259 - protein, 83 aa, Glycine max
  Coding DNA Sequence Number=SeqID_25574
  Subcellular localization annotation: CTP_CleavageSite=43; ConfidenceScore=5.31e-01
MNCVFVHVSSTFEFGATFHDCLSADPQGYPPFSPFFRSSMNCVFVHVSSTFEFGAMFHDCLSADPQGNPPFSPFFGATVNVIA

SEQ ID NO: 117260 - protein, 201 aa, Glycine max
  Coding DNA Sequence Number=SeqID_25575
  Homolog annotation: Hit_ID=A5AZG1; Match level="QueryCoverage=47%, HitCoverage=30%, E-value=3e-07, Identity=33%"; Hit description =Putative uncharacterized protein
  Pfam annotation: Domain name=zf-CCHC; Domain location=132-149; Score =17.7; E_value=0.0032; Accession=PF00098.14; Description=Zinc knuckle
MKREKHASYSSHNSCKSLSEELRDYYEGMHRSHLRPHSHRREKKRKPQEVNINLPCWGGKDNVEANLDWEIRVEQQLKKKSTSKSYGSHSYPNKYQGQDILVVTPSKPKDVKGNTIEKQAPKASMQEKTSSIKCFKCLGRGHITSQCLTTKTMILRGQDIYSSQDKATTSPSSSESEKAKGEESSEEIYPQEEGQPLVVKE

SEQ ID NO: 117261 - protein, 175 aa, Glycine max
  Coding DNA Sequence Number=SeqID_25576
  Homolog annotation: Hit_ID=Q6WAY4; Match level="QueryCoverage=88%, HitCoverage=28%, E-value=1e-18, Identity=37%"; Hit description =Putative uncharacterized protein
MGTNQNGKRFYQVKVKSLDVTSLKELGRLMGPLQRQAFRKVYGKILDLTAAEVFTEAVVSLAQYYDQPLRCFTFGDFQMVPTIEEFEEILGCPLGGRKPYLFSGFLPSLSKIAVVVGDSAKELDRMKQTRNGVVGLPWKYLEGKARDMASQEKWGPFANILALLIFGVVLFPNVD

SEQ ID NO: 117262 - protein, 44 aa, Glycine max
  Coding DNA Sequence Number=SeqID_25577
MELQMHAYMQPLADQQAANHMGQQCQDPNPYPWPTPEQFRATVA

SEQ ID NO: 117263 - protein, 98 aa, Glycine max
  Coding DNA Sequence Number=SeqID_25578
QKSWDEVVEKFLKKYFHESKTVEGKAAISSFHQQLNIFIDGLRPQSKQLLDASAGGKIKMKTPKEAMDLIKSMAASDIAILRDRAHIPTKKSLLELTS

SEQ ID NO: 117264 - protein, 49 aa, Glycine max
  Coding DNA Sequence Number=SeqID_25579
MTTGDPPQQKTSQGNEKKKEDENITQGDPTQQKRSRKIGIKKKFKNIAQ

SEQ ID NO: 117265 - protein, 43 aa, Glycine max
  Coding DNA Sequence Number=SeqID_25580
RTREPRLARPQKGTLRHRSMENSISLSGGRPNISSGNTSGNYA

SEQ ID NO: 117266 - protein, 178 aa, Glycine max
  Coding DNA Sequence Number=SeqID_25581
MERSMIDATSCGALGDMTPIEARNLIEKMTSNSQQFSARNDAIVLRGVHDVATDSSLFAENKKLEGKLDALVNLVTQLAINQKSTCAPVTVARVCGLCSSTDHHTDLCPSMQQSGVNEEPETYAANIYNRPTQQQNQQQQNNYDLSNNRYNPGHMFLLQCSSSNNKDNKQLRPLLNLP

SEQ ID NO: 117267 - protein, 177 aa, Glycine max
  Coding DNA Sequence Number=SeqID_25582
  Homolog annotation: Hit_ID=A5BKB8; Match level="QueryCoverage=56%, HitCoverage=30%, E-value=2e-19, Identity=56%"; Hit description =Putative uncharacterized protein
IIAIVGLQRGIPSKRESSARVDYVPALCTHRPSLLPIEWSGEVFGLRRREPAEGSLSMPHNQIDPRTCLFIYRREGGDDHGAPNSNLLSATPGGPETVSRGSRHDTTFTYNDSRQRISRALASMKNVAKCDTWCELQNPVNHRVFERKLRPKPLGRGHACLGGTHRFPNANMYNVAA

SEQ ID NO: 117268 - protein, 117 aa, Glycine max
  Coding DNA Sequence Number=SeqID_25583
MNIEQAIGHGTEIAMDVHEAMSRETNEVEFMGLGATTTIDLEEPSSNTKGKRQGLTSSSTDSHRRKIGEKEGITISLDKMVNSFDRMVEKMDGKIDDEDSQEMLREVALIPDLSRQQ

SEQ ID NO: 117269 - protein, 64 aa, Glycine max
  Coding DNA Sequence Number=SeqID_25584
MCGVATNVYLWKTSENPKETGQNENSKFGSVFTLRKVDKSGAFAPTYPPSKRKSDLRSSSLRVN

SEQ ID NO: 117270 - protein, 78 aa, Glycine max
  Coding DNA Sequence Number=SeqID_25585
MPSKIILMMSKNQELSKSQRIRSQKASRLEIQESREVSIKFQESRFKNNQDQNSKFKIQESREDSIKISTKKVFQNIE

SEQ ID NO: 117271 - protein, 77 aa, Glycine max
  Coding DNA Sequence Number=SeqID_25586
AGAVTSFGYCKDHDGQWLKKDALPQQDEQLRGLHTYVGERFDSLDGRFEGMDTLITQLEEDVTYLRRCFDLPPPSKS

SEQ ID NO: 117272 - protein, 171 aa, Glycine max
  Coding DNA Sequence Number=SeqID_25587
MQLPQEPSNKRPRGLARKSMAGTNFAELYGVAIVNSSCGGKKETSREPIAWSKRSLSQRLCETETNMLAIIAKYQEELDLAAAHEHRMADEYAQVYAEKEARGRVIDSLHQEATMWMDRFALTLNGSQELPRLLVKAKAMADTYSAPEEIHGLLGYCQHMIDLMAHIIRNR

SEQ ID NO: 117273 - protein, 77 aa, Glycine max
  Coding DNA Sequence Number=SeqID_25588
  Subcellular localization annotation: CTP_CleavageSite=38; ConfidenceScore=5.29e-01
MSLRRLGGSSPESYSLHPATVILLPRTRMMHAPDSTLRCNVVRTNNNLISGNSLSVSTRHSHLGNCAEFFETTRLCT

SEQ ID NO: 117274 - protein, 57 aa, Glycine max
  Coding DNA Sequence Number=SeqID_25589
MVTKRVMQAPLELVGLGSSSSMDSFAPWKMNGSGMEKKEREETPLQGEDESRRSSPP

SEQ ID NO: 117275 - protein, 105 aa, Glycine max
  Coding DNA Sequence Number=SeqID_25590
  Homolog annotation: Hit_ID=Q84VH6; Match level="QueryCoverage=25%, HitCoverage=1%, E-value=8e-08, Identity=100%"; Hit description=Gag -pol polyprotein
MKSWTEKKSKNLAFVSNDEGEEDEYDLDTDEVQQSDEQNGQEAETTCPEHPFSTSGKVVNTRKGQMKSPVTAKEFNAVGVKAMDTSKLNVPLISEAEERTFCMSV

SEQ ID NO: 117276 - protein, 276 aa, Glycine max
  Coding DNA Sequence Number=SeqID_25591
MAPRKACLKEVQERIKRPKEPVPLPSMTATALGALSTSRASRPSRGGHFLRERRVQLRDDEYTDFQEEIVRRRWASLVTPMAKFNPDIVLEFYANAWPTEEGVRDMRSWVRGQWIPFDADAIGQFLGYPLVLEEGQECEYGQRRNRSDGFDEEAIAQLLCIPGQDFARTAAGRRVRIMRTNMTPLTQIWMTLLLSNIQPSDHNSDLPLPKCQLVYAILTRMSIHMAQLIADAIYIFAGMAPTRHLLDPDKSNRALRFPALITGLCQSFGVPVAPSK

SEQ ID NO: 117277 - protein, 97 aa, Glycine max
  Coding DNA Sequence Number=SeqID_25592
  Gene Ontology: Cellular component=mitochondrion
  Homolog annotation: Hit_ID=Q5M9T4; Match level="QueryCoverage=100%, HitCoverage=100%, E-value=3e-38, Identity=68%"; Hit description =Putative uncharacterized protein orf122b
  Subcellular localization annotation: CTP_CleavageSite=22; ConfidenceScore=5.38e-01
MDEVIGVTNGFGCGNRRKSGTVASLPRRFFLATSFSSGWLGKQATFSIGQIPINNRPKWWGRRPSLLKWKGANRRFTAAPLQLPFAQHDHERRQRIA

SEQ ID NO: 117278 - protein, 87 aa, Glycine max
  Coding DNA Sequence Number=SeqID_25593
MSNEELKLQDPRCRIQCPDILPENTGVAAQCISQDKIFSGRMIDLLQHKPLQPRNAHCYINMEAARLFVPSPGLKSYFVSFWDLSVL

SEQ ID NO: 117279 - protein, 160 aa, Glycine max
  Coding DNA Sequence Number=SeqID_25594
  Homolog annotation: Hit_ID=A5B7B4; Match level="QueryCoverage=68%, HitCoverage=6%, E-value=4e-12, Identity=37%"; Hit description =Putative uncharacterized protein
MAQPPPRERTLREMAAPDFTYESLCIQYPHEDVPYVLKTGLIHLLPKFHGLAGEDPHKHLKEFHIVCSTMKPPDVQEDHIFLKAFPHSLEGVAKDWLYYLAPRTTAIRKESQVLANSVERACMSPGRDLRNYVPVAPTIRFQNNFFSNIFLKDLVIWREV

SEQ ID NO: 117280 - protein, 82 aa, Glycine max
  Coding DNA Sequence Number=SeqID_25595
MTEWYIFKIGAIQIMLYDCHHLNGGDCGSNDFQDYFDDAKESRVKQVPKNRESKSFKNQVSRFKNNQDQDSRIKRRLNQDKY

SEQ ID NO: 117281 - protein, 34 aa, Glycine max
  Coding DNA Sequence Number=SeqID_25596
SNALTFLSFQKSRGRFKVQHLNDSPPFKVEKIIS

SEQ ID NO: 117282 - protein, 62 aa, Glycine max
  Coding DNA Sequence Number=SeqID_25597
METNKGSPVESPTVATYPSAGGRRETRGMRVPRKEYARSRHQRLFEENVGKTGKDAIYELLS

SEQ ID NO: 117283 - protein, 47 aa, Glycine max
  Coding DNA Sequence Number=SeqID_25598
MKTSIQRKSIASASKPHAKREISALSAAGAFSQAKLETGAKRSVTIS

SEQ ID NO: 117284 - protein, 116 aa, Glycine max
  Coding DNA Sequence Number=SeqID_25599
MSQGNFNGGLSESAPDRQPKLLNLRSLVRLNIQASSVDPSCKIRLDLDNCHTLISSGDLCSMTCDHSLVLVRCLAPIIRQFVKFQDMPKKPKNIDAQSVSFRDTPEIKWKHRCIIK

SEQ ID NO: 117285 - protein, 219 aa, Glycine max
  Coding DNA Sequence Number=SeqID_25600
  Homolog annotation: Hit_ID=A5BSR3; Match level="QueryCoverage=65%, HitCoverage=46%, E-value=7e-13, Identity=35%"; Hit description =Putative uncharacterized protein
MKKWALAADQDGVEDTVCDKYDISKEKWAQFCQTRRDPSWEAQAIQKQNTAPHVLSRGGYDYLEQKLLAEKTKKKMQEAAQSGSVNGIIDPPSLVRRHVKWKMARTKKTGEMTTEAAKEIAEKIDSFEEQATQGSFVPHGRQDVLAAAIGRPEHPGCVRAVGAGVTIKQYFGSAPWTSHSASSLPPDELQQLTQQIRDQLEESITKKVTRQVMASFSQL

SEQ ID NO: 117286 - protein, 61 aa, Glycine max
  Coding DNA Sequence Number=SeqID_25601
MGGKCAESPPTFIRGKRRKNRKRCGLRTLSVKGSGVVFTHGEGCFPCSYVFLNCDKKIRPT

SEQ ID NO: 117287 - protein, 103 aa, Glycine max
  Coding DNA Sequence Number=SeqID_25602
MECMSWGAECTDLVGWPRRGEHLWAPRLIIYGRGAVTCTTGWVSINLAQFPKLECRVDTLRLFPEVWLLLGRTTLHLSVELGACIILCSLDWVHGWMMSNCWM

SEQ ID NO: 117288 - protein, 92 aa, Glycine max
  Coding DNA Sequence Number=SeqID_25603
MEDEGNEDVGLPLELERMVSHEDQEMGPHQEETELVDLGIGSGKREVKIGTGRRVTRGMRVPRKEYARSRHQRLFEENVGKTGKDAIYELLS

SEQ ID NO: 117289 - protein, 189 aa, Glycine max
  Coding DNA Sequence Number=SeqID_25604
MAASDIAILKDRTHVPTKKSLMELTSLLGVPSVVELTIMAAVSPMKNQLMKSTIWGTSQDKISMQMDIPNFSMASHIIHNKDNGKITLVSMSNHKSTESTIKNLEVQVGQLAKQLADRLSSSFTANTEKNPKEECKALMIRRKMTIQADEGKAEKKAEGYKQQSAVEPALEPVSDFVELEEVVEDEDDQ

SEQ ID NO: 117290 - protein, 283 aa, Glycine max
  Coding DNA Sequence Number=SeqID_25605
  Homolog annotation: Hit_ID=Q6WAY6; Match level="QueryCoverage=95%, HitCoverage=45%, E-value=2e-28, Identity=29%"; Hit description =Putative uncharacterized protein
MIEVFVEVIASFTQYYDQPLRCFTFGDFQLVPTVEEFEGILGCSLGGRKSYLFSGFYPSMARVAKVVKISVQELERVKQNRNGVVGIPKKRLEEKAKALADQGEWTSFIDVLALLVFGVVLFPNVDGLMDLAAINAFLAYHHSKESSAVVVLVDAYDTFDQRCKKNNARIVCCTLALYVWLVFHIFHHESRHVCPLQGHYICAEKGKANWEQLMAGMVGASVNWFPRWKEGGARVLSSCEGFPNVPLMGTRGCINYNPVLVIRQLGYPMKGAPSEESIAPFIA

SEQ ID NO: 117291 - protein, 123 aa, Glycine max
  Coding DNA Sequence Number=SeqID_25606
MKATGKDTFQKLRLKEFFSARCIHKVMRDNDREKISRHLRKKFAKRRPHDQPQLAKPMPFPIERPKVKSGNSDYGRQCAQALDLSVRNLMSKAVASGWDEVEVALQVISLCESYIYGPFDRER

SEQ ID NO: 117292 - protein, 48 aa, Glycine max
  Coding DNA Sequence Number=SeqID_25607
MEDCLEGPHLGIMKHSSKLQGGGHMNSARQPNFHGAPKKGGDWMIALR

SEQ ID NO: 117293 - protein, 49 aa, Glycine max
  Coding DNA Sequence Number=SeqID_25608
MTKARQKGGTERKGKRCLPPSSPKRARLLPPEAPPFGGTSWKANGPGCY

SEQ ID NO: 117294 - protein, 157 aa, Glycine max
  Coding DNA Sequence Number=SeqID_25609
MSILTSEEKSGRKQKEKKESSQSKSGRKQKKRKEGKFPIKEWEKKKKEKKENSQIKEWEKEKDGKKIPDQGSKENRGNVQKGRWTRRYLNNTELSPNKQKEERKPQPKVIFSLRLPTKILCVGDLFASRKTKTEKKRGRKLKAKFPTKRTHSQEESY

SEQ ID NO: 117295 - protein, 211 aa, Glycine max
  Coding DNA Sequence Number=SeqID_25610
MGEVEKTQENMKADMEAIKEKMATMMEAMMSVKKIMEANAVAIAATSVVAKVNPTSPSGINQMNHPTSDMVGKDLGSTGGPHNVQIQNEHAFPPYGLPLNYTPPNVAYTPNEISITPLPYSLRANNLNLIMHMSLMEETHEIPHHNLADFEPWLGYATEGQAVGGIPLQNTLEGPQFRPQPQPSRSTVVKNPHDYGRNGKVGSSRGKAQGH

SEQ ID NO: 117296 - protein, 243 aa, Glycine max
  Coding DNA Sequence Number=SeqID_25611
  Gene Ontology: Mol. function=sorbitol-6-phosphate 2-dehydrogenase activity; Cellular component=cellular_component; Biological process =metabolic process
  Homolog annotation: Hit_ID=P05707; Match level="QueryCoverage=55%, HitCoverage=52%, E-value=3e-67, Identity=93%"; Hit description =Sorbitol-6-phosphate 2-dehydrogenase
  Pfam annotation: Domain name=GutM; Domain location=158-242; Score =112.0; E_value=1.8e-30; Accession=PF06923.2; Description=Glucitol operon activator protein (Gu
FSRLMIRDGIKGRIIQINSKSGKVGSKHNSGYSAAKFGGVGLTQSLALDLAEYGITVHSLMLGNLLKSPMFQSLLPQYATKLGIDESEVEQYYIDKVPLKRGCDYQDVLNVLMFYASPQASYCTGQSINVTGGQVIRHPTKNGTRVVPGITPSGDIMVTALITVAAIAWLCQLAFGGWQIRRFNHAFDSLCQQGRVGVGRSSGRFKPRAIVAIAVDENDRICDTLLMKGLTVFASPQKIPTLS

SEQ ID NO: 117297 - protein, 52 aa, Glycine max
  Coding DNA Sequence Number=SeqID_25612
MSSRMRCTLVSSFVMGSRKVHITFLTAHMEHCAPKCASTMSQPCKDHKPVFT

SEQ ID NO: 117298 - protein, 65 aa, Glycine max
  Coding DNA Sequence Number=SeqID_25613
MERCHNFDNGKRSQEEKNEKKSHEERRSKKAYIAWNDNDSSDGSVKEINLLSKDYESDEKISQED

SEQ ID NO: 117299 - protein, 225 aa, Glycine max
  Coding DNA Sequence Number=SeqID_25614
  Homolog annotation: Hit_ID=UPI00006A2D9E; Match level="QueryCoverage =39%, HitCoverage=62%, E-value=3e-07, Identity=17%"; Hit description =UPI00006A2D9E related cluster
DCIRRLHALTFRELHILTFEGLHALTFRGLHVLAFRGLHTLAFRGLHVLSFRGLHALAFRGLHVLAFKGLHVLAFGGLHVLAFIGLYICTFRELNEEAITQLLCIPGQDFTRAAAKRRVWIMRTNMTTLTQIWMTLLLSNILSNDHNADLPLRKDRAHKTPSGPGGVPQGPRVSSSSYGPLITPTRHPVDPKKSNRVLGFPALIMGLCQSYRVSVPPAGSCHHDI

SEQ ID NO: 117300 - protein, 207 aa, Glycine max
  Coding DNA Sequence Number=SeqID_25615
  Gene Ontology: Mol. function=3-oxoacyl-[acyl-carrier-protein] reductase activity; Cellular component=cytoplasm; Biological process= fatty acid biosynthetic process
  Homolog annotation: Hit_ID=P0AEK2; Match level="QueryCoverage=96%, HitCoverage=81%, E-value=7e-86, Identity=84%"; Hit description=3 -oxoacyl-[acyl-carrier-protein] reductase
  Pfam annotation: Domain name=Epimerase; Domain location=5-201; Score=- 67.6; E_value=0.039; Accession=PF01370.12; Description=NAD dependent epimerasedehydratase family
  Pfam annotation: Domain name=KR; Domain location=1-145; Score=-37.9; E_value=3.9e-05; Accession=PF08659.1; Description=KR domain
  Pfam annotation: Domain name=adh_short; Domain location=5-133; Score =64.3; E_value=4e-16; Accession=PF00106.16; Description=short chain dehydrogenase
  Pfam module annotation: Pfam domain module=Epimerase::KR::adh_short; Domain location=5-201::1-145::5-133
VDSRGSHISAYLGDEGKGLLLNVTDAASIESVLEKVRAEFGEVDILVNNAGITRDNLLMRMKDDEWADILDTNLTSVFRLSKAVMRAMMKKRVGRIITIGSVVGTMGNAGQANYAAAKAGLIGFSKSLAREVASRGITVNVVAPGFIETDMTRALNEDQRSGILAEVPAGRLGDPQEIANAVAFLASDEAAYITGETLHVNGGMYMV

SEQ ID NO: 117301 - protein, 110 aa, Glycine max
  Coding DNA Sequence Number=SeqID_25616
MVREAWSNDQQGGWGGIVLKNKLKNLKAAIKQWSKGEGNFDVNKIFSIQQKLNEVEDLASNRVLSDQELKDYSRPYLDGVPFNSISHGQREQMPVPFPDQEIKEAVWSCG

SEQ ID NO: 117302 - protein, 54 aa, Glycine max
  Coding DNA Sequence Number=SeqID_25617
MSWNFTDCLTMGVKFLEAVKQRLHAIKQWSPDEIRGLIRQVLRKESMSFKNLWI

SEQ ID NO: 117303 - protein, 109 aa, Glycine max
  Coding DNA Sequence Number=SeqID_25618
MAAQLIHDRVVMECLEGVWETLEGNERCRFHGTIQLTATSLVSSSEEDPEEDLEELPPEPVVDDLDLPEDDEDPLPDVDSPEDIMSASEVDSTEESGPGGTTSSEDSSS

SEQ ID NO: 117304 - protein, 107 aa, Glycine max
  Coding DNA Sequence Number=SeqID_25619
MTRGNPSDLQPFDPEIDRTFHRLVRHHFVSFEHPEHYVIGESEHYVVGNFEHSENMTQPLPHERTLREMAAPDFTYESLCIQYLDEDVPYVLKTGLIHLLPKFHGLA

SEQ ID NO: 117305 - protein, 170 aa, Glycine max
  Coding DNA Sequence Number=SeqID_25620
  Homolog annotation: Hit_ID=Q2XNY0; Match level="QueryCoverage=88%, HitCoverage=40%, E-value=2e-07, Identity=25%"; Hit description =Putative uncharacterized protein
MIGRLLAGSLAFESRILQYLIVRILLPRSSNFAQVSEEDLIVMWAFHKGLQIDWAHLVRYRMHKPLRLNAPLPYPHLVTLFLQHFNIPLDSEPYVPIKRSFLIGTLVIASFGHDGEDSSLLSKILDRFDTLELQVDMRFNEMESRITKVEEDVSYIRSSFDLPPPPPPSS

SEQ ID NO: 117306 - protein, 159 aa, Glycine max
  Coding DNA Sequence Number=SeqID_25621
  Homolog annotation: Hit_ID=Q2HW90; Match level="QueryCoverage=54%, HitCoverage=17%, E-value=3e-11, Identity=39%"; Hit description =Putative uncharacterized protein
MGTNQNGKRFYQVKVKSLDVTSLKELGRLMGPLQRQAFRKVYGKILDLAAAEVFTEVVVSLVQYYDHPLRCFTFGDFQMVPTIEEFEEILGCPLGGRKPYLFFGFLPSLSKVAAVIGDSAKELDRMKQIRNGVVGLPRNTGRQGKGYGEPEKWGPFADI

SEQ ID NO: 117307 - protein, 73 aa, Glycine max
  Coding DNA Sequence Number=SeqID_25622
MEDCLEGPLLGNHETQLQLESGGHMNDNAIHSWGSGKKAIMKHSSKLKSGGHMNDLTQFIHVAPEKDENGGLP

SEQ ID NO: 117308 - protein, 139 aa, Glycine max
  Coding DNA Sequence Number=SeqID_25623
DAATKGTSAAPEFDIHRFKSTEHQQRFKAIKEEIARRRWTSLVTPMAKFDPDIVLEFYANAWPTEEGVRDMRSWVRGQWIPFDAGALNQLLGYPLVLEEGQECEYSQRRNRADEFDEEAIARLLCIPGQDFTRTAAGRR

SEQ ID NO: 117309 - protein, 89 aa, Glycine max
  Coding DNA Sequence Number=SeqID_25624
MMIWKQRAKLVMATTRWALKHPVYGIVILWLGIYTNRPNVSKLCSFIDSMNPSILISVIQENKPLATMFLNEKLYTVPKFQQTLLTTTK

SEQ ID NO: 117310 - protein, 120 aa, Glycine max
  Coding DNA Sequence Number=SeqID_25625
  Pfam annotation: Domain name=zf-CCHC; Domain location=91-108; Score =30.9; E_value=4.7e-06; Accession=PF00098.14; Description=Zinc knuckle
MSLATLFGKLQEHEMELQRLNQNEENDKKNRSIALKASSSIQEENEEEDSDDEEDFSFFVKKFHKFIKKRRIDRRQNFINGRKSQDDSQVLRCYKCNQIGHIKTNCPSMKNGRRKVKIKI

SEQ ID NO: 117311 - protein, 78 aa, Glycine max
  Coding DNA Sequence Number=SeqID_25626
KPVVPAALMNRPTPGERGFAYWALKECILAYYVGPDEGYIPLPRSLTRYARSFYCGERKWLTNGAEISWKMPGIFLTG

SEQ ID NO: 117312 - protein, 60 aa, Glycine max
  Coding DNA Sequence Number=SeqID_25627
MAPEWRRRRVKRRCHFKEKMSQEEAHHHRKPWIRAWSLLIQDQVQDSPLSVLRYHEACKA

SEQ ID NO: 117313 - protein, 88 aa, Glycine max
  Coding DNA Sequence Number=SeqID_25628
MKMLLIPHDVSSIGACRPRIFFINGFLCFLEDESHGPEIYPKAHKNPRAFSCISGPIYLEFSIQCPCGVGLHHSLPLEKDLTSNPRGS

SEQ ID NO: 117314 - protein, 33 aa, Glycine max
  Coding DNA Sequence Number=SeqID_25629
MAEINQGKTMTGHDWLHIIWLLLAGLNRQNANP

SEQ ID NO: 117315 - protein, 364 aa, Glycine max
  Coding DNA Sequence Number=SeqID_25630
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=68%, HitCoverage=87%, E-value=1e-131, Identity=95%"; Hit description=Beta- lactamase TEM precursor
  Pfam annotation: Domain name=Beta-lactamase; Domain location=31-268; Score=126.1; E_value=9.9e-35; Accession=PF00144.15; Description=Beta- lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTRCCSMAQRAQLLTGELLTLASRQQLIDWMEADKVAGPLLRSALPAGWFIADKSGAGERGSRGIIAALGPDVFVPLSVRPRRKDQRIFLRSFFSARNLLLANKKTTATSGGLFAGSRATNSFSEGNWLQQSADTKYCSSSVAVVRPPLQELCSTAYIPRSANPVTSGCCQWRSVVSYRVGLKTIVTG

SEQ ID NO: 117316 - protein, 95 aa, Glycine max
  Coding DNA Sequence Number=SeqID_25631
MARHDTCRGLVWLKDKRGAPHYFHDTNAKMMIWKLYAKLVMHAPMRTLKWWRCVYCPLPAILMLLWCLALRLPGGAVPLDESSISRGPDALAGGD

SEQ ID NO: 117317 - protein, 87 aa, Glycine max
  Coding DNA Sequence Number=SeqID_25632
MWCTCRKPNKIFASLSGNFFLFGKSPTGNLVPLDLEIEATLRRNRAERRWKILQDRTVASILEEETHFSDLLSPGFTIIKGICHSIT

SEQ ID NO: 117318 - protein, 165 aa, Glycine max
  Coding DNA Sequence Number=SeqID_25633
  Gene Ontology: Mol. function=ribose-5-phosphate isomerase activity; Cellular component=integral to membrane; Biological process =carbohydrate metabolic process
  Homolog annotation: Hit_ID=Q6D8V9; Match level="QueryCoverage=80%, HitCoverage=86%, E-value=2e-46, Identity=66%"; Hit description =Ribose 5-phosphate isomerase
  Pfam annotation: Domain name=LacAB_rpiB; Domain location=16-156; Score=262.5; E_value=9e-76; Accession=PF02502.9; Description =RiboseGalactose Isomerase
MCRCQTLYHWRDVMKTIAIGADDAAIDLKNIIKKLLEEQDYQVTDYSNDAQNERPMYPDVAFALATAVQQKQFERGILLCGTGIGVAIVANKVEGVRAAQCHDTFSAERARKSNNAQIMTMGSRVIGPELAKNIVNAWLASEFEGGGSTAKVEKIGYYEQVSHAK

SEQ ID NO: 117319 - protein, 129 aa, Glycine max
  Coding DNA Sequence Number=SeqID_25634
PVVIDYTEGWVTGNRLQIVMAAQLIRDRVEMECLEGAWETLEGNTRCRFRGTIQFTATSLVHPDEPARTLQRTVEWILPTPTPYRLVESVQVIDVTSSEEDPEEDLEELPPEPAVDALDFLEGDEDPLL

SEQ ID NO: 117320 - protein, 55 aa, Glycine max
  Coding DNA Sequence Number=SeqID_25635
MGCNRNQAHLGPPPKAVASEEQPGSPGRAGRKHLPYFAINKGGKNLSRGASETFP

SEQ ID NO: 117321 - protein, 110 aa, Glycine max
  Coding DNA Sequence Number=SeqID_25636
MDTMMIVMLEMIWLRGLESVGCILRRKKQKTSVAAAQTSKKQAIIVGSSSRKQKAVQENDEDLDVEENIDVESEEEEIMVNFEASDGEEGDAPLSYDNNEDDYVGIGEDD

SEQ ID NO: 117322 - protein, 90 aa, Glycine max
  Coding DNA Sequence Number=SeqID_25637
ESHPQRHPVDPEKSNRALGFPALVTGLCSPTGCPFPPARSRHHDIEIVPARHPVDPKKSNRVLKFSSSNYGSLSVLRSACHLQQGHQAPY

SEQ ID NO: 117323 - protein, 212 aa, Glycine max
  Coding DNA Sequence Number=SeqID_25638
  Gene Ontology: Mol. function=hydrolase activity; Biological process =antibiotic biosynthetic process
  Homolog annotation: Hit_ID=A6TB98; Match level="QueryCoverage=76%, HitCoverage=58%, E-value=1e-87, Identity=94%"; Hit description =Putative non-heme chloroperoxidase
MMEQEILALFENVLSRKVGFHDELIDSDILDSILAVDMVLEVQDVYGFCGMAFVTTKDGVNIYYKDWGPKEAQPIVFHHGWPLSADDWDNQMLFFLAEGYRVIAIDRRGHGRSDQVSEGHDMDHYAADASAVVESLDLHNAVHVGHSTGGGQVARYVAKYGQPQGRVAKAVLVSAVPPLMVKTEDNPGGTPIEVFDGFRSALAANRAQFYLD

SEQ ID NO: 117324 - protein, 210 aa, Glycine max
  Coding DNA Sequence Number=SeqID_25639
SKGVASDSLVFKHLSPVINLAYIRKNCWNPDDLTVTIREARRVRTRLVEAPSTSTAPPPACTLAAPSAPAYADFQRLEAVLQNIHQGQIILLQSLQMVAPPNSIPSVEQFNEWDESSETTTPEPLVKRKKADQTQEAATTSEKSLEATFEPSEPVTNIASLQQAADPSTPEDQTTPVLSPKTSPTTTVVLHLTDEEDVQTQDTQDRSQDF

SEQ ID NO: 117325 - protein, 41 aa, Glycine max
  Coding DNA Sequence Number=SeqID_25640
MNPKRIKVIPKWPTPPSIRKIWGFHDLTNIYQRCSGKELRV

SEQ ID NO: 117326 - protein, 115 aa, Glycine max
  Coding DNA Sequence Number=SeqID_25641
  Pfam annotation: Domain name=G-patch; Domain location=1-37; Score =7.1; E_value=0.026; Accession=PF01585.14; Description=G-patch domain
MLKHGYEPGMGLGKDSHEDAVVVDIRGNPYKYGLGYEPGKPGRRNAPSRLRADRAWPGHVSQCFTSVGIMLEEEVAAIGEKSPQDPPSFVRPCHPNSQVGNWRVMSQSEVYTADS

SEQ ID NO: 117327 - protein, 110 aa, Glycine max
  Coding DNA Sequence Number=SeqID_25642
  Homolog annotation: Hit_ID=A2Q141; Match level="QueryCoverage=53%, HitCoverage=16%, E-value=1e-07, Identity=45%"; Hit description =Transposase, putative
MQHLMKLLERDQYIHWHRLKDEVVVRDLFWCHPDAVKLCNACHLVFFIDSTYKTNRFHIDKNVKAKCKSLIGEKNAWDYVMDSWGLNQLIGLSKEYYKIALETYVVFGMP

SEQ ID NO: 117328 - protein, 96 aa, Glycine max
  Coding DNA Sequence Number=SeqID_25643
MGIGVELFTFSLGVYATIAGVSWEASHMARRPDGGIGFTLATVLVATIVTILASIIFFMLIMASIIVAIFSYMASMSAFICSCTSSTSPITLALAR

SEQ ID NO: 117329 - protein, 121 aa, Glycine max
  Coding DNA Sequence Number=SeqID_25644
  Homolog annotation: Hit_ID=A5BP71; Match level="QueryCoverage=61%, HitCoverage=19%, E-value=6e-11, Identity=45%"; Hit description =Putative uncharacterized protein
  Pfam annotation: Domain name=zf-CCHC; Domain location=94-111; Score =18.9; E_value=0.0021; Accession=PF00098.14; Description=Zinc knuckle
MGSQLEWPLLVNAEACGYVSMNYYQYIDVVYTNEHILKAYSAQWWPLGNEAAIPPSDEAWTLIPDPTTIRAKGRPKSTRIRNEMDWVEPSDHRQKCSRCGAEGHNRRRCPMQSDRGSNSFN

SEQ ID NO: 117330 - protein, 110 aa, Glycine max
  Coding DNA Sequence Number=SeqID_25645
  Subcellular localization annotation: CTP_CleavageSite=30; ConfidenceScore=5.19e-01
MTSFSQMQSQMQSQGLALRFEPLVGPSGPRVSTKGSCVDPSRNYPETGDSDRCGLYIEADPARLVALGRVYEGSTIVHNSPFLRGQVKVGCGGRVQMQMLQFLYPLMRFP

SEQ ID NO: 117331 - protein, 195 aa, Glycine max
  Coding DNA Sequence Number=SeqID_25646
MSPPPLGVEAMSSKVILMMSKNQELSKGSSKDSRFKNNQYQDSRLKIQESREGSIKISIKMFFNTLSSTRSFHKIITKEFYSLVIDYQKVVIDYQCFKTLRFSKFKNEESHLLMCNRLHLNGYILCGTSRGYIYLGIFILRTRDGTSLVDEFKWRVHPLGFSKRTREGTFLVDLWLVKDFTRLKEISRTAGCLGT

SEQ ID NO: 117332 - protein, 154 aa, Glycine max
  Coding DNA Sequence Number=SeqID_25647
MTLLLSNIQPSDHNSDLPLPKCQLVYAILTRMSIHVAQLIADVIYLFAGMAPTRHPLYPDKSNRALGFPALITGLCQSFGVPVAPSKSQGFTSFPCPTPDQFRAEVAWPGDWPEAQAEEAPAEAPAEAPDEANEAREDEEMTDLLDFLGGSGAT

SEQ ID NO: 117333 - protein, 72 aa, Glycine max
  Coding DNA Sequence Number=SeqID_25648
MCMIRLRLLALNEYQSGVIDILIGSVRHIGWCIVGRQAIWREGVLVLNLHIMGAARTSQSLPTISKLDDSFG

SEQ ID NO: 117334 - protein, 213 aa, Glycine max
  Coding DNA Sequence Number=SeqID_25649
  Gene Ontology: Mol. function=motor activity; Cellular component=cell projection
  Homolog annotation: Hit_ID=UPI00016621D1; Match level="QueryCoverage =89%, HitCoverage=41%, E-value=4e-23, Identity=37%"; Hit description =UPI00016621D1 related cluster
MHVLTFRGLHVLTFRGLDALAFRGLLVLAIRGLHVLAFCGLHVLSFRGLHVLVFRGLHVLVFTRLHALSFRGLDVLAFRGLHVLTFNGLHVLTFRGLDVLAFRGLHAHAFRGLHVLTFRGLHVLTFRGLDVLAFRGLHALAFRGLHVLSFRGLHVLAFRGLHVLAFRGVHVLAFRGLHLLAFRGLHTLTLEDYASSLSEDCTSSPSQDNTSLP

SEQ ID NO: 117335 - protein, 144 aa, Glycine max
  Coding DNA Sequence Number=SeqID_25650
MKEFYANLYDPEDKSPKQVKVRGHLVKFDEDTLNTFLKTPVILEEGENLCTYSRFALLRPNPQELAAKLCIPGKGFELNADGHSLKILRKNMTTLAQTWSVLSFSNLIPTSHTSDVTLDRAKLIYGIIMKMDMKLGYLISHQIS

SEQ ID NO: 117336 - protein, 59 aa, Glycine max
  Coding DNA Sequence Number=SeqID_25651
MKAKCNQRWLGGAKTVNPGLLAQDTGLPCSDVFCLSNAQKGRRSVGRDPILYLHSSLST

SEQ ID NO: 117337 - protein, 201 aa, Glycine max
  Coding DNA Sequence Number=SeqID_25652
  Homolog annotation: Hit_ID=UPI00006A2D9E; Match level="QueryCoverage =68%, HitCoverage=85%, E-value=1e-11, Identity=17%"; Hit description =UPI00006A2D9E related cluster
SSPSEDYTSSPSEGNTPSPSEDYTSSPSDDYTLSTLEDFTGVQALTFKGLLPLTFKGLHALAIRGLHVLAFRGLHVLAFRGLHVLTFRGLHVLTFGGLHDLPFKGLHVLASIGLHALTFKGLHAHAFRGLHVLTFKGLHTLTFSGLHAITFRGYTPSRLADYTPSPSEGCTPSPLEDYTSSPSEGYTTSPLEGNTPSPSEG

SEQ ID NO: 117338 - protein, 128 aa, Glycine max
  Coding DNA Sequence Number=SeqID_25653
MTQPLRCFTFEDFQLVPTVKELEEILGCQLGGRKPYLFFGFYPSTTRVAKVVKISAQELERLKQNRNGVVEVPRKFVLFPNMEGLVDLAAIDAFLAFHHGKESPVVAILAMYDTFDRGCPSIRYKVTA

SEQ ID NO: 117339 - protein, 63 aa, Glycine max
  Coding DNA Sequence Number=SeqID_25654
MTLFRHWRGSTTMFIGSNSQRSVADSNDEGSANSRINPLQEGRDAGILPKVFMSLRVDFGPIG

SEQ ID NO: 117340 - protein, 151 aa, Glycine max
  Coding DNA Sequence Number=SeqID_25655
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPYVARYYPVLTPGTELEFVIMVIAVSFGKPVVPAALMNRPTRGERRFAYWALFRFLAH

SEQ ID NO: 117341 - protein, 294 aa, Glycine max
  Coding DNA Sequence Number=SeqID_25656
  Homolog annotation: Hit_ID=Q6WAY6; Match level="QueryCoverage=70%, HitCoverage=41%, E-value=6e-22, Identity=32%"; Hit description =Putative uncharacterized protein
HRKQVENGVVGIPRKYLEAKARISAGKGEWALFIDILALLIFGGVLFPNVDGLVDLAAIDAFLAYHNHKESPVVAMLADLYDTFDRRWANWDQLLASKEGASVNWFPRWKEGRTGVHISCGGFPIVPLMGTRGCISYNPVLAIRQLGYPMRGAPLEDELAPVVSRGFNKTNVETLQKVCKAWEVLQKKDKELRGNNNGPIGGYRKWLKAHVQGLDWLPSLRTAKREEVEAPEEDEEVQALRAELEQAQIVKERFKSVALKIRKENAELRDVNITTTKALEQETKRARREEHGRN

SEQ ID NO: 117342 - protein, 175 aa, Glycine max
  Coding DNA Sequence Number=SeqID_25657
  Homolog annotation: Hit_ID=Q6WAY4; Match level="QueryCoverage=88%, HitCoverage=28%, E-value=1e-17, Identity=35%"; Hit description =Putative uncharacterized protein
MGTNQNGKRFYQVKVKGLDVTSLKELGRLMGPLQRQDFRKVYGKILDLTAAEVFTEAVVSLAQYYDQPLRCFTFGDFQMVPTVEEFEEILGCPLGGRKPYLFSGFLPSLSKVAAVVGDSEKELDRMKQTRNGVVGLPRKYLEGKARDMVSQEKWGPFADTLALLIFGVALFPNVD

SEQ ID NO: 117343 - protein, 64 aa, Glycine max
  Coding DNA Sequence Number=SeqID_25658
MHFRKGYSEVITGGMGVVEGGVSSWWVCHRGRCRHKLIEGRKEVKKSLSFEMQKVAVGLSAYPS

SEQ ID NO: 117344 - protein, 69 aa, Glycine max
  Coding DNA Sequence Number=SeqID_25659
TFRGEKSFFYGCSDTHPHGWRGAALARELRWIPIHCTCLASLKRKDGRGVESSQATVRSQDKSMAEINQ

SEQ ID NO: 117345 - protein, 81 aa, Glycine max
  Coding DNA Sequence Number=SeqID_25660
MSYVPILTSIFVPFSTYMHICKAFSYLFNIHMYMVNNIFTPSRYKEIMVQPKPSAGLKGKPHQHALTFMPSCIPKIKGLGP

SEQ ID NO: 117346 - protein, 185 aa, Glycine max
  Coding DNA Sequence Number=SeqID_25661
MSKSCGFGMTGPLDESISCFLIRVDPWVLVPITFRGLHVLAIRGLHALTFRGLHVLTIRGLHALTSRGLHVLALRGLHALTLGTTYPHRERTTRPRLERTTRPHHQRAARPHLLEDYSPRLERATRPHLGGLHVLAVKGSCAFTFVGLHALTFRGLHVLTFRGLHVLAIRGLHVPHFQRGACPHL

SEQ ID NO: 117347 - protein, 103 aa, Glycine max
  Coding DNA Sequence Number=SeqID_25662
METCLGVEELLQRMIDQGRLEVGSEGREEKHICMQSTDGSSVAKPKPLVIYFTKGTASQKPGHPLVAKPVPFPYQNSHTVPWRYTPPREKEEEATDVSSLSAK

SEQ ID NO: 117348 - protein, 115 aa, Glycine max
  Coding DNA Sequence Number=SeqID_25663
  Homolog annotation: Hit_ID=A5ATL8; Match level="QueryCoverage=33%, HitCoverage=30%, E-value=1e-12, Identity=89%"; Hit description =Putative uncharacterized protein
RRQIPGLNPGQAVETTKLEYETKARGANGIRYPSSPSRKRWILGAVRIDPCNAVANALSIPPGEYRRTLPGLDMPRILLKERGAFGNADTGGAWLSSARAVRCWVKSRNERNPRV

SEQ ID NO: 117349 - protein, 145 aa, Glycine max
  Coding DNA Sequence Number=SeqID_25664
MASMPYTLRLVESSTQGLEDDSVSCICLTISLRMFDRGDKVLDTYPCQEVLVCMSCELSVVVLDNGMWEAIPAYDMFADEFLHLIGRNFPQWSCFYPLGEVVDGDYKWKRGARTVEIVMKGAWNVYKLLVSSIILCKVKGVCLEC

SEQ ID NO: 117350 - protein, 68 aa, Glycine max
  Coding DNA Sequence Number=SeqID_25665
  Homolog annotation: Hit_ID=O64438; Match level="QueryCoverage=89%, HitCoverage=18%, E-value=1e-12, Identity=65%"; Hit description=ARG10
STLEDPPTAVGGLRCYENPKNKITAIPAEEEEIWGAFFKVILELKKLELNILYVTRIVEGSAVLAGTE

SEQ ID NO: 117351 - protein, 48 aa, Glycine max
  Coding DNA Sequence Number=SeqID_25666
SIKFRAFLFLSDAILPRKGPVTRAMSKRLQEDWARAAEEGPRVLMNLR

SEQ ID NO: 117352 - protein, 312 aa, Glycine max
  Coding DNA Sequence Number=SeqID_25667
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILSRMSIHVAQLIADAIYIFAGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 117353 - protein, 47 aa, Glycine max
  Coding DNA Sequence Number=SeqID_25668
FRAECMPEIGLRPRQGSAAEAPDNADEARMDEEMTNLLDFLGGSGTT

SEQ ID NO: 117354 - protein, 87 aa, Glycine max
  Coding DNA Sequence Number=SeqID_25669
MYNGDENHETGGVYPDLSSLTGSGVYPNLSSFIGSGVYPDLSSLTGSGVYHDLSSFTGSGVIQSFVACIKRSAATQVHIIWYQSFGS

SEQ ID NO: 117355 - protein, 159 aa, Glycine max
  Coding DNA Sequence Number=SeqID_25670
MAQVIADATYLFAGMTPTRHPLDLEKSNRALGFPALITGLCQSYGVPITPSKVIRPPITRSFIEKYCMPRQTQGDAHQDAGAPPPPQQADSDGPLGVECLNQQGQGSAPFVCPTLEQFGAEVAWPGDWPDAQAGEEPAGSPGEADESRMDEDMTDLLGF

SEQ ID NO: 117356 - protein, 289 aa, Glycine max
  Coding DNA Sequence Number=SeqID_25671
  Gene Ontology: Mol. function=ATP binding; Cellular component=integral to membrane; Biological process=dicarboxylic acid transport
  Homolog annotation: Hit_ID=Q4UNP1; Match level="QueryCoverage=70%, HitCoverage=82%, E-value=1e-102, Identity=92%"; Hit description =Toluene tolerance protein
  Pfam annotation: Domain name=DUF140; Domain location=1-218; Score =178.4; E_value=1.8e-50; Accession=PF02405.7; Description=Domain of unknown function DUF140
TRDFQAELTREIYKIGARSLPIIAVGGAFVGLVLTLQGYRTLTTFGAADALSTLLGLSLYRELAPVLTALLFIGRAGSSIAAELGMMRATDQIKALELMAIDPVAKAVAPRFWAAVLTVPLLTGIFCSLAISASYFEAVHVLGLDNGVFWSALRNSVDFWDDFGVAMLKSAIFGGTAALVAAYVGFHAEPTIEGTSVATTRAVVNASLLARAATTTRSGNPHGHPRSQTRILRRRFPAAGPGLADGAGRGLDPTSAGAGAVKGYDLKARLLPGRPACAKQAPGEESAAS

SEQ ID NO: 117357 - protein, 61 aa, Glycine max
  Coding DNA Sequence Number=SeqID_25672
MGHLSDQGVPMNPKRIKVILEWPTPPSVEGRSPEYEEPRDLRSNPFQGGGNDAILPRKGIG

SEQ ID NO: 117358 - protein, 88 aa, Glycine max
  Coding DNA Sequence Number=SeqID_25673
  Subcellular localization annotation: CTP_CleavageSite=58; ConfidenceScore=5.26e-01
MHLRDQGSLLYNKEKNKMKDCKNTSGEDVSFTSRISQSLTNSSQALRTTPTSSSSLCRSSHNKMSDAMDCYQSHAPLKDGNGLLHFGI

SEQ ID NO: 117359 - protein, 54 aa, Glycine max
  Coding DNA Sequence Number=SeqID_25674
MTSEVVIIKKGEIVEAKLHDESKMIQRCFDDNNDDTKMMTKVMNKKLKDQRTTQ

SEQ ID NO: 117360 - protein, 88 aa, Glycine max
  Coding DNA Sequence Number=SeqID_25675
MASFSQMQSQFQSHMQSQGIALPLEPEVGPSGPRVSTKESCVDPSGNNPETGDSGKYVLYIEANRPRLVALGRLYEGSTVHNIHFLPG

SEQ ID NO: 117361 - protein, 93 aa, Glycine max
  Coding DNA Sequence Number=SeqID_25676
  Homolog annotation: Hit_ID=A6FJQ2; Match level="QueryCoverage=40%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLCNFHLSKPSGNRLQPIVIDYRGLFYGNRLQGVVIDY

SEQ ID NO: 117362 - protein, 169 aa, Glycine max
  Coding DNA Sequence Number=SeqID_25677
  Homolog annotation: Hit_ID=Q6WAY4; Match level="QueryCoverage=91%, HitCoverage=28%, E-value=4e-16, Identity=33%"; Hit description =Putative uncharacterized protein
MGPLQRQAFRKVYGKILDLTTAEVFTEAIVSLAQYYDQPLRCFTFGDFQIVPTVEEFEEILGCPLGGRKPYLFSGFLPSLSKIAAVVRDSARELDRMKQTRNDVVGLPRKYLEGMARDMANQEEWVPFADILALLIFGGCPLSNVDGLVDLAAIDAFLCIITIARRARW

SEQ ID NO: 117363 - protein, 179 aa, Glycine max
  Coding DNA Sequence Number=SeqID_25678
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQGMQAWHWPSFYNVVTGKTLALPNLIALQHIPLSPAGVIAKRPAPIALPNSCAA

SEQ ID NO: 117364 - protein, 90 aa, Glycine max
  Coding DNA Sequence Number=SeqID_25679
MTNFARYFQIIIVTCALWNNAEVRATSDPLTPKLSRPRYQDWGSHDLFEPWPIERILLLSPKQRTVKSPQGRANGMLKPDFPKKGMGKEN

SEQ ID NO: 117365 - protein, 75 aa, Glycine max
  Coding DNA Sequence Number=SeqID_25680
MDDKWMQFSDYIAPVGQICVVPSQCSSDYMDWFYMISHPFMSPAQPRDLPRVRLVQHMTHFVDQMSISTDGGSST

SEQ ID NO: 117366 - protein, 107 aa, Glycine max
  Coding DNA Sequence Number=SeqID_25681
MIPGQAPVLKNWFPIDNRIKMLWLGIVMLIGLEVQMTEKALPLVDASDLGNNLISHGSTRKIQNCVSSLSPSNRGSTAGRVSCSQQWTPAPRAPDCAQGVTSCDRKK

SEQ ID NO: 117367 - protein, 67 aa, Glycine max
  Coding DNA Sequence Number=SeqID_25682
MLSSDENNDPEGMEEGIGVPVTRNAVDSDSKCPFASSMVLPIEEIFEISIGSNKREWKKKKFGLCGE

SEQ ID NO: 117368 - protein, 28 aa, Glycine max
  Coding DNA Sequence Number=SeqID_25683
VLGTPVLSVRQFVKIPERSHGHPRLVNQ

SEQ ID NO: 117369 - protein, 169 aa, Glycine max
  Coding DNA Sequence Number=SeqID_25684
GGPDDTRDTLRLFAPFCHPEAAGPMTRRDKIWSFCTLVSSRGGGPDDTRRYLTVIRTLVSSRGGGPDDTRRYLTVIRTLLSSRGGGPDDTQRQNLAAGPMTRRDKIWSFCTLVSSRGGGPDDTQRYLTVIRTLLSSRGGGPDDTRRYLTVIRTLVSSRGGGPDDMQRLT

SEQ ID NO: 117370 - protein, 142 aa, Glycine max
  Coding DNA Sequence Number=SeqID_25685
MGDQEEIQEQMKADMSALKEKMASMMDAMLGMRQLMENNVAIAAAVSSTAEADPTLRATAHHPLPNVAGRERSTLGHINNPHLGYNRVAYPYGLPPNYTPPVMRDDAGHVPSLILEGSLLDSRTWFTRIVESMLKETSISTP

SEQ ID NO: 117371 - protein, 196 aa, Glycine max
  Coding DNA Sequence Number=SeqID_25686
  Homolog annotation: Hit_ID=A6FJQ2; Match level="QueryCoverage=19%, HitCoverage=84%, E-value=5e-11, Identity=92%"; Hit description=50S ribosomal protein L5
MRKEKIPHQAPFAIQAAQLLGRAIGAGLFAITPAGERGMCCKAIKLGNARAACNRLQHPEIDYQKAYYSCNRLPRLVIDYNSSSSINTHEIRVAAQPRPPLVPPPYLNRPTFVSYSNLHQITSRKAQSSSFSLLFHFHRLKSTKTSSNGRTIEEEKGIILHRHCCCPSPPRTIRSTHSTYSSLFVISKIIHIVFIR

SEQ ID NO: 117372 - protein, 159 aa, Glycine max
  Coding DNA Sequence Number=SeqID_25687
  Gene Ontology: Mol. function=metalloexopeptidase activity; Biological process=proteolysis
  Homolog annotation: Hit_ID=Q2AE98; Match level="QueryCoverage=72%, HitCoverage=31%, E-value=2e-17, Identity=38%"; Hit description =Peptidase M24
MLITLGAERTACMSADARGASWRTRRGAAPAHCDAGGDHADMLYATQAQRSWSAVFADITQAYQRHGHAEAWRDHHQGGPAGYGCRDWIITPESRGEVQPDTAVAWNPTLSGVKSEDTFLLTRSGLVPLTRSDSWPLIRLQRGDNTLELAGWLILPTSS

SEQ ID NO: 117373 - protein, 240 aa, Glycine max
  Coding DNA Sequence Number=SeqID_25688
  Homolog annotation: Hit_ID=Q2HW90; Match level="QueryCoverage=31%, HitCoverage=14%, E-value=7e-11, Identity=48%"; Hit description =Putative uncharacterized protein
MGSSKTPSLKKRFYQVKVKSLGITSLKELGQLMGQLQRQAFHKAYGKIWDLAMAEVSTEVIASLAQYYDQPLRCFTFGDFQLSPMMEEFEEILGCRGEWAPFIDILALLIFGGVLFPNVDGLVDLAAIDAFLGYHDRKESPVVTILADLYDTFDRRCEKSSTRIVCCTPALYVWLVSHLFCQEVRLACPLESHRSCTEKRGANWDRLLASKEERLSTGSLDGKKEEPRFLFRAEDFQMFP

SEQ ID NO: 117374 - protein, 69 aa, Glycine max
  Coding DNA Sequence Number=SeqID_25689
  Homolog annotation: Hit_ID=Q1S5K3; Match level="QueryCoverage=52%, HitCoverage=8%, E-value=5e-07, Identity=66%"; Hit description =Ribonuclease H
MYPFTARLGFDCTNNMAEYEACAFGIQAAIDFDVIKIDPEKVKPFLKSRPHTGRNKFEVSDRQVDTLHP

SEQ ID NO: 117375 - protein, 133 aa, Glycine max
  Coding DNA Sequence Number=SeqID_25690
MQDTIDCNKINKIREERMQTQFYTGSATTRAYVQYSSNPLEISTIFVKSITKSEPHRDNPSLVFRNPLQQETHSLLTNLINKKNGRRILSSREEYYNEDHTYGNRLHVENSNSKPFSTAISQSCLRVIDYTSW

SEQ ID NO: 117376 - protein, 91 aa, Glycine max
  Coding DNA Sequence Number=SeqID_25691
MQIADKSSNSFVANTEKNPREECKAVMTRSKRFVENEEEKSVGHKKKAVEEKGIDGRKNNVRGKLEITMALLEKLYRQNAHSTPKFLEGYG

SEQ ID NO: 117377 - protein, 173 aa, Glycine max
  Coding DNA Sequence Number=SeqID_25692
  Homolog annotation: Hit_ID=Q6WAY3; Match level="QueryCoverage=38%, HitCoverage=2%, E-value=2e-08, Identity=39%"; Hit description =Gag/pol polyprotein
MGLGKDNDDRTGPDKRPEETVGSLGLGYKLTQADIRKKRCRKEEWGSRLAIGARIEGGPPCHISRSFISTGLGHEGQVIAICEDDSLSGSDDKSLEGTNTWDPTINFEQETNQTEDKKDEDVELPPELEKIVAHEDQEMGPHQEETELVNLGTGSGKKEVKIGTGMTTPIREE

SEQ ID NO: 117378 - protein, 141 aa, Glycine max
  Coding DNA Sequence Number=SeqID_25693
  Homolog annotation: Hit_ID=Q7XGW8; Match level="QueryCoverage=42%, HitCoverage=4%, E-value=1e-07, Identity=45%"; Hit description =Retrotransposon protein, putative, Ty1-copia subclass
MEKSEKKNHSEKKLKKAYITWDENDLESSDDSENEEINLCLMAKRYESDEEKRTWHINLLLQKNYSNIKMIWVPKGSSVNTNMQGPNKIWVSLRKKWYIDSGCSKHMTGDASNFTHISPKKSGHVLSIACLALVNYVTKAI

SEQ ID NO: 117379 - protein, 107 aa, Glycine max
  Coding DNA Sequence Number=SeqID_25694
  Homolog annotation: Hit_ID=A2Y2J4; Match level="QueryCoverage=58%, HitCoverage=11%, E-value=5e-07, Identity=41%"; Hit description =Putative uncharacterized protein
MVGGIGPITRPHSQTREKDRRSRESIGMILRVPLGRETFPPTMKKELMDKLQRLRQGSVIVKEYRQQMEVLLLRVGLRQEERTSIATFLSGLNMKVRDKVPFIWGPR

SEQ ID NO: 117380 - protein, 35 aa, Glycine max
  Coding DNA Sequence Number=SeqID_25695
AILHSQSFFGAPLSYPNFVRGPLLDDVRPFFGPRE

SEQ ID NO: 117381 - protein, 214 aa, Glycine max
  Coding DNA Sequence Number=SeqID_25696
  Gene Ontology: Mol. function=transferase activity, transferring pentosyl groups; Cellular component=cytoplasm; Biological process =nucleobase, nucleoside, nucleotide and nucleic acid metabolic process
  Homolog annotation: Hit_ID=Q1H1A2; Match level="QueryCoverage=93%, HitCoverage=81%, E-value=1e-80, Identity=71%"; Hit description =Methylthioadenosine phosphorylase
  Pfam annotation: Domain name=Mtap_PNP; Domain location=1-214; Score =195.4; E_value=1.4e-55; Accession=PF00896.10; Description =Phosphorylase family 2
MLGIIGGTGLTALDNLNISKRLIVRTPYGEPSQPLVFGEINGKEVVFLARHGGGHTIPPHAVNYRANIWALHSVGVCDLLSVATVGGIARNLIPGDMVLPNQILDYTYGRSNTYHDGVELPVRHIDFTQPYSQAMRERCLKAAADVGYSLVDGGVYACVQGPRLETAAEIDRYERDGATLVGMTGMPEAALAREMGVSYAAICPVANYAAGRGD

SEQ ID NO: 117382 - protein, 288 aa, Glycine max
  Coding DNA Sequence Number=SeqID_25697
  Gene Ontology: Mol. function=transferase activity, transferring glycosyl groups; Biological process=lipid A biosynthetic process
  Homolog annotation: Hit_ID=Q1H152; Match level="QueryCoverage=100%, HitCoverage=74%, E-value=6e-97, Identity=63%"; Hit description=Lipid- A-disaccharide synthase
  Pfam annotation: Domain name=LpxB; Domain location=1-288; Score =216.6; E_value=5.9e-62; Accession=PF02684.6; Description=Lipid-A -disaccharide synthetase
MVAGEASGDLLGYHLIQELKSMQPGIEIFGIAGPKMISLGAKSLFPIERLSVRGYLEVLRHLWGLLKLRKQLYKQILKEKPDVFIGIDAPDFNFWLERKLKAKGIPTIHYVSPSIWAWRKNRIHKIKRAVSHMLALFPFESALYQQVGVPVTYIGHPLADALPMEPNAGQTREKLKLKKDSVVIAMLPGSRQSEVNFHATLVLETAIVFDRLMRENGKKVQFLVPLVTRETRDIFQNAWHELLTRLPDTSIDLQIMFGHAHDAMTAADAVLVASGTATLEAALLKKPM

SEQ ID NO: 117383 - protein, 98 aa, Glycine max
  Coding DNA Sequence Number=SeqID_25698
MDLIENMAASDIAILRDRAHIPTKKSLLDLTSKDALLAQNKLLSRQLEALAETLRCTICGGAHESGCCIPIEEHPTCEVNYMGNQPNNNFNTGGFSGF

SEQ ID NO: 117384 - protein, 157 aa, Glycine max
  Coding DNA Sequence Number=SeqID_25699
HKPLRRDLILMWAFLTGRQIDWAHLVWYRMHKALRANAPLPYPQLITLFLRHFQIPLDDEPFVQVKRSFAIGAGAMTSMGIKIGRQWLKKDALPPQDERLLPYLPLNIHKNFAGMDIEPYTAEEESRIHPPEFCPSPPQTIFHHHLRLLSKILFSSD

SEQ ID NO: 117385 - protein, 36 aa, Glycine max
  Coding DNA Sequence Number=SeqID_25700
MSPVESPTVATYLSREGNKGLTGASSKKGKCVESPP

SEQ ID NO: 117386 - protein, 91 aa, Glycine max
  Coding DNA Sequence Number=SeqID_25701
LGGVDGDPVLRGMRIGATWEVVPADMLRGSGDLGDVRRAPGSQPIKGQSPRSMEACVAAGHLCILGGIWKLASGNRLPFGDRTLVNDYTGW

SEQ ID NO: 117387 - protein, 201 aa, Glycine max
  Coding DNA Sequence Number=SeqID_25702
MRGNHYIDWMEYHAEWINIWKNKRSDVLAGQWVEGIVTHTPVYMEWYRKNTTLFLSVAQQLHDPRTAITHNVTGLGVEQTHFEIPHPWSMYSTPSPVHQTFGHTSESVTATTHEWMTDLFGVDFNTPNSVASYLATLQQFDAPHLFGEQGQSSSTATTNIENTNTEQQHHHDVGEPVILERRNLRRNRRPPPCGTGHRLGH

SEQ ID NO: 117388 - protein, 151 aa, Glycine max
  Coding DNA Sequence Number=SeqID_25703
MTRRDKIWSFCTLVSSRGGGPDDTQRYLTVIRTLLSSRGGGLDDTRRYLTVICTLVSSRGDGPDDTRRYLTVIRTLVSSRGGGPDDTRRYLTVIRTLLSSRGGGPDDTRRYLTVIRTLVSSRGGRPDDKQRPIPYGCHYRTLFVIQRWRAR

SEQ ID NO: 117389 - protein, 217 aa, Glycine max
  Coding DNA Sequence Number=SeqID_25704
  Homolog annotation: Hit_ID=A5C0V9; Match level="QueryCoverage=72%, HitCoverage=27%, E-value=8e-08, Identity=26%"; Hit description =Putative uncharacterized protein
MTLTIPELFLRPYQVRWDATVFGVINPDFPLYIKHEDLSKIAHGGQCLSISVLQLWILHLTETCMRAGNSDIYGFLEPQSIQRSGQSQFESESYIKSWMQSSQRDVYLGAYLMGSTAADIGRWWPDNYLKGIINSAIKGLDDAPQPKSKAPARWIVVKCNRQKGTTECGYYVMHWMSTIILGSFRNNWEAYFNDPRPLEPERLKALPDPVGTVLSPS

SEQ ID NO: 117390 - protein, 323 aa, Glycine max
  Coding DNA Sequence Number=SeqID_25705
  Pfam annotation: Domain name=Transposase_23; Domain location=110-180; Score=4.8; E_value=0.00035; Accession=PF03017.5; Description =TNP1ENSPM transposase
APWTCPCCWSRCHHQAILRIGSTDVPNSSSLPPKELQQLTQQIRDQLEESITEKVARQLIASFNQTQSQVQSQMQSQGLALPPKPLVGLSSPRVSTNESCVDPSGNDPETGDSDRCDLYIEANPARLVALGRVYEGSTIVHNTPLFPGQVKVGMEEVKDPDASILVPTDEVSIVGQAIHTFLAWPTHLVKSLSQQTVVSPTKPPPKLDPEVDDPLYLMTLTIPELFLRPYQVTWDATVFGVFNPDFPLYIKHEDLSEIAHGGQCLSISMLQLWILHLTETSMRVGNSDIYGFLELQSIQRSRQSQFETEMDIGRWRSSCPRNT

SEQ ID NO: 117391 - protein, 109 aa, Glycine max
  Coding DNA Sequence Number=SeqID_25706
MLRTREGTSLVDQFTWKVHPLGFSKRTREGTALVDLWLVKDFTWLKEILRTIGCLGTGYRHGVEERIPEFQEPMDLRALDRKLQEDWAKDAREGLKVLMSLRVDFGFMG

SEQ ID NO: 117392 - protein, 119 aa, Glycine max
  Coding DNA Sequence Number=SeqID_25707
MYETDDGITFEGPKKAIQIKRGISFESFKKGYTTRFLVAGKYIALQICDDEDVETMIQSFEQQQEMSVIELCVEVDVAGTSAINFTNSLLSCGNNMSHNESGSARVGTNSEEDFDDYYY

SEQ ID NO: 117393 - protein, 139 aa, Glycine max
  Coding DNA Sequence Number=SeqID_25708
  Homolog annotation: Hit_ID=Q84VH5; Match level="QueryCoverage=66%, HitCoverage=13%, E-value=2e-33, Identity=80%"; Hit description =Envelope-like protein
MLSQHPNMLNYTDSVMKRESPLSLHYKLFEGTHVPDIVSTSGKAAASGAVSKDALIAELKDTCKVLEATIKATTEKKMELERLITRLSESGIDDEEAAEEEEEAAEEDKEAAEEEEEAAEEEEDAAEETESDDDSEATP

SEQ ID NO: 117394 - protein, 216 aa, Glycine max
  Coding DNA Sequence Number=SeqID_25709
MAEQAKHLFYVQDPYDERWSVVLHGKTIGVNVEDDDSHIDTYVSPLSTQMLPNIVGEEEANNVHVNPNDCTTQLLSSSYWCSINSPPTLKRTRKATRLRSLATRPVGAKRPLVHVDPEIEKVDGPHRKKLRTYLGIVACDKMDAKFGIPEAFDLRKKKKLLQTVGERWRQFKSDLTLKWTLVVDKDNINDTVCEKYNISKEKWAQFCQSRKDPSWE

SEQ ID NO: 117395 - protein, 112 aa, Glycine max
  Coding DNA Sequence Number=SeqID_25710
  Gene Ontology: Mol. function=protein dimerization activity; Cellular component=nucleus; Biological process=regulation of transcription, DNA-dependent
  Homolog annotation: Hit_ID=A5BIU7; Match level="QueryCoverage=49%, HitCoverage=8%, E-value=5e-18, Identity=76%"; Hit description =Putative uncharacterized protein
DYKQQRPSQELVAKDLHGVEWKFQHIYRAKVASAHSIFVSQKNLVSGDAVLFLRGCRCNYTLELSPCYNYSKVGPALACGCTVVIKPSELTPLTALAAVELSIQVGIPPIVW

SEQ ID NO: 117396 - protein, 66 aa, Glycine max
  Coding DNA Sequence Number=SeqID_25711
MVLKRTIAVCGGYWWLWVVKKKLGTLRKGFERKKEKGISVFQGYTKNKACNTQVFLLSGKEALLTH

SEQ ID NO: 117397 - protein, 80 aa, Glycine max
  Coding DNA Sequence Number=SeqID_25712
MISHMNITVEAKLHGESKVIKRCFDDNNDDDKGDDKKLKDQSKNNSSESKNQSKNNSSESRTIQEFKIRIKKNSRLKKKV

SEQ ID NO: 117398 - protein, 143 aa, Glycine max
  Coding DNA Sequence Number=SeqID_25713
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MSGPSDKVSGPKQVTKTLEDQCTSPPMNIHNIQRMNVAQSKCQRPWKPKASAKDPGSPGDPLVLERPPPRWSSNSPYSESYYNSLAVVLQRRDWENPGVTQLNRLAAHPPFASWRNSEEARTDRPSQQLRSLNGEWDAPCSAH

SEQ ID NO: 117399 - protein, 471 aa, Glycine max
  Coding DNA Sequence Number=SeqID_25714
  Gene Ontology: Mol. function=motor activity; Cellular component=cell projection
  Homolog annotation: Hit_ID=UPI00006A2D9E; Match level="QueryCoverage =51%, HitCoverage=93%, E-value=2e-17, Identity=16%"; Hit description =UPI00006A2D9E related cluster
  Subcellular localization annotation: CTP_CleavageSite=19; ConfidenceScore=5.10e-01
MDTSEPYNGAMKGTMHKPQANLGADKKFSPNRFPTTRVDPWVLVPIAFRGLHTLNFRGLHILALRGLHVLAFRVLQALALRGLHALAFRGLHVLALRELHILVLRGLHALILRGLHVLASRGLHLLTFKGLHALAFRGLHALTFKGPRALTFRGPHALAFRGLHVFAFKGLHALTFRGLHAFTFRGLHVLAFRGLHVLAFRGLHALTFRGLHVLAYKGLHVLAFRGLHVLAFKGLHVLAFRGLHVLAFRELHIHTFRGLHILAFRGLHAVSFRGLHVLAFRGLHICAFRELKTAARRRVRIKRTNIWIMLLLSNILPSHHDSDLPLLKWIAPTRHPVDPKKSNRVLGFPALITGLCQFYRVLVALSKGEAPQRPGDGQQRATDTPLPPLEPLNSSTKDIALPMTRGRLAGDQVQSQSSSRRGPGRAPLKRVPVWPRKPAQALTNTDSRPWNISSVSRPSRDGHSSDRDKGS

SEQ ID NO: 117400 - protein, 121 aa, Glycine max
  Coding DNA Sequence Number=SeqID_25715
AGADDFGSSRTGVGDGDDLGTSSEASPPPEGEGWTLGQAILLMNSSTLMIELTVEGPEGTGAGTGKGVDEAGAKRAVVEVEGAKAGAGKDEATAAEAGAGKDEAGVDEAAVEVEGAGVGRP

SEQ ID NO: 117401 - protein, 167 aa, Glycine max
  Coding DNA Sequence Number=SeqID_25716
MIYHTEFDEFKAELERRNWHKELTNFMDGSIDVAIVKEFYTNLYDLEDKSPKQVRVRGHLIKFDEDTLNTFLRTPMIIEKGENLPTYSRFYRLRQDPQELAARLCIPGKGFELNADGLPLKILQKNLTMLAQTWSVLSFSNLAPSSHTSDITLDKAKLIYGIIQKMD

SEQ ID NO: 117402 - protein, 166 aa, Glycine max
  Coding DNA Sequence Number=SeqID_25717
VADDHNLSSHAIGLACLWIARVADDHNLSLHAIGVTCLWISRVADDHNLSSRAIGLPCLWIERVADDHNFSPRAIGLVCLWIARVADDYNLSFVIGLACLWMTNETVADDHNLSPRANGLAYLWLAKGDCNKKVADDHNLSQNAIGLACLWIARVADDHNVEAKLH

SEQ ID NO: 117403 - protein, 986 aa, Glycine max
  Coding DNA Sequence Number=SeqID_25718
  Homolog annotation: Hit_ID=A7P7M8; Match level="QueryCoverage=95%, HitCoverage=94%, E-value=1e-139, Identity=33%"; Hit description =Chromosome chr9 scaffold_7, whole genome shotgun sequence
MAKSSILSIFITLLQLLMVLCLSAAYKNFIEESSIVYTYDRVAEIEKHCNPYLTSSSKSIPDENRGYTLQTELSFTNGDWNQENGGFPLMPFDESDLQGHRIHHGTDPLQLVSFQVQDTNVAHQFENASVNVGGILSLAISRNTTFYPSLRSPSFTMIPGFSILTVVFEGVYFESGQDRLLCLLGNTALPISEPHVENWDIANSHWPGYSHLPHLLQDDQILLLLRYPQTFNLTSRAIKGEIRSISKHGSLKYFDDVHISSQLSRYSEYQFSPELMPRSCEDKHLCQEDLAQYDALTFSGYEFCRTLQSISEPFNVVPHNKFTDRYAYQSKVRPHQPGKEFGFGNWRLNHENFRLILQHVICEEEPRNHNIKNARISATLRLFPTSIPEDTARDRTGLSNLTLLAEGTWDSSSGKLCMIGCAGEVDPILEDCNYQIFLYFPRVYSIKQRSLMLGSISNIANETNMFFPLLINYAPRPVFLHLSHGPCGSHLSYNYSMIQLATSIRRRDQSSKFRLLKQSSFLKYPALDDEQDVLASQLRFLSANLIFDAFAICKHCSDKHNSRVFIHMDVFSLGPYVPWLRKDDGSKKQVETEKLTSIQILNISLHLIFNEGSSVFTIKQYRHLSPLFLEGVYDQLAGQMSLIGCRMVSNVSTNVGHGLDCLVDVKVQYPPLTGRWLKNPSVEMTITSQRHENDPLHFNAVTLQTDIIPYLKHHDDVAFRKLCDGVLRMLTSCALVGIILSQLSYMNRNVASIPHISLVMVAEQILGYGAELFGDTEILVESSHDLHDNKHMLNPIEIMTRLLVLIALLLTIRLYKKVSQAKKRQNAYGSAKEKRLPQHKNVVLWNFKVHIVVCLVLTGLLAIEPSLRNNLRSLSLIDFLLLSGILIRQAHILCAQDLFLVPQALEKSVWQRKVKPLRKMYYVGLTLLRLILFSYDYIRDPILDPYSDNGVEGRSLKYEEPRDLRSNPFQGGGDDAILPPAPKGIG

SEQ ID NO: 117404 - protein, 136 aa, Glycine max
  Coding DNA Sequence Number=SeqID_25719
MFASGQFYAQVLNKVIKDAQRKANVHIVLEFDQCNTRFMVQEAIIEREVRPAGDFTVRLDERWCDYDKFQKLHMFLLLCLQCIQMICPDPDKKRNSKGCPTFSRIHTEMDIQEPGQPKRYSMCRISGHSKKNCPSV

SEQ ID NO: 117405 - protein, 295 aa, Glycine max
  Coding DNA Sequence Number=SeqID_25720
  Homolog annotation: Hit_ID=A2X5W1; Match level="QueryCoverage=27%, HitCoverage=44%, E-value=7e-13, Identity=47%"; Hit description =Putative uncharacterized protein
MSKVEGFKYEELRMQRITENQAKIEALGLSKLAIIFKDRIQKAKKKDKKPIMMMKTMYLNMKGDLDQILSENYKNDKRDEFAATNDLKSRKRKVIKSSILNSKRVYNDSSIHHSLDKEVKESLPNNASHASELTNVEQVESNAGQHVIKKGRGHTINAKFQKKKENLMAKEKSIDIQFPPPFYKIYEKHAKYFKSETQVRIHQKAPLQVNGWSEISKDDVDEMWRHMKERSLTNKANRSKQEIKSIIGTKSIVQKAFEMKEDSISGEWSDVVEVWKATHMSSNGTWCIPKGEEIM

SEQ ID NO: 117406 - protein, 31 aa, Glycine max
  Coding DNA Sequence Number=SeqID_25721
MKKECPKVACGADCQVMMKGSSLWVMARSLR

SEQ ID NO: 117407 - protein, 91 aa, Glycine max
  Coding DNA Sequence Number=SeqID_25722
MVHQKLFFWNDDANLEMVEADHSSYGIYVAFASEGDQAMAITAPFEVKDSFYVNKSGEFLGFVIHQKGIEVDKNKAKAILETSPSKNRKKL

SEQ ID NO: 117408 - protein, 135 aa, Glycine max
  Coding DNA Sequence Number=SeqID_25723
MDVAVVVVAVFLIVVLDIVMVAPEEVEVVADLPIFSVKFALNMATLQMFVASTTLQPIPYSSSFARTSNTWINPNSKPVVPASNQPSAMLTNSSSHGNGHASSTWIPDSAVSFHVTGESQNIRQFTHFGGLIRFS

SEQ ID NO: 117409 - protein, 277 aa, Glycine max
  Coding DNA Sequence Number=SeqID_25724
  Homolog annotation: Hit_ID=Q8IKV2; Match level="QueryCoverage=57%, HitCoverage=18%, E-value=2e-08, Identity=27%"; Hit description =Putative uncharacterized protein
MSIDRDYFSLPLVIQRQSSPMKHKDQHSCLHPFSKTQCPSTETTLVYPFVIQRQSSPMTHRDQPGRLHPLSKTQYLSIETTLVSISSSRDNQSPSAIQRQASPLAYGDHHGHHLHFKDDNVFSHCMLSKGDNDLHLYFEDDNVFSHCMLSKGDNDLHLHFKDEKVFSHCMLSKGDNDLLLHFKDDDVFSHCMLSKGDNDLHLCFEDDNVFTHCMPSKGDNDHHLQFEDDNVFSHCMPSKGDNATIYAFEDDNATIYAFEDDNVFISKISNVFCPCAS

SEQ ID NO: 117410 - protein, 91 aa, Glycine max
  Coding DNA Sequence Number=SeqID_25725
MKDKGEDFESYESEARTLSPMKVRTLSPMKARTLSPLQARILSPMKARTLNLLQVMTLSPMKARTLSPLKARTLSPLKARTLSPLKEANRY

SEQ ID NO: 117411 - protein, 235 aa, Glycine max
  Coding DNA Sequence Number=SeqID_25726
MALHQPQQGNAFQNGILWRQNQIIQQMGAHKDTGWEWNFIWRRPLFDSEIAMAGSFQRDVEGKSIHPHRRDDWVWKADPSEDNHDGAFEELWKLKIPSKISVFAWSNMKEDAAHLFLHCSKILPIWWESLSWVNILGAFLQNPRQHFLQHVTGLADGIRANRWKCWWLALTLTIWQQRNKILFSNDNKLLDDATFLLWTWLRNLEKDFVIHFNQWSSNLTEGFVYQPRVAAIGYQ

SEQ ID NO: 117412 - protein, 276 aa, Glycine max
  Coding DNA Sequence Number=SeqID_25727
MTDVHRLEWQLDSIVVGGLKLYVNIPKYGRELARNVEQEAAGKAKGFNARHETGAGGQRQPQYTITLASYATVAARNTRNSGQRWTQETVIHRQEGSHLSVQLNISMDEKKWFNDVWVGVEDELSWEVGVEIVSKYMGDDLVLLLGLTDARAEHMIQEETTNGSSLFHSLEKWNPTMRIGYSLGHDANPEDCRYDRGHGGGVFFFFPHLVEAPRVDRVRVLIKTMWRPPIQHMVNAHIGGEIYRIHIVEENGPSTGTCNCRFRSAFRSSEEIEGIL

SEQ ID NO: 117413 - protein, 239 aa, Glycine max
  Coding DNA Sequence Number=SeqID_25728
MHRTYFHSTSQGSQKTWEKRNYRSSSRSGALSGRYSSQGIEIGVLVDTGLKLHVNLPKHGRKQNPTETINKKHKEKEEIAIEKVEERDKGKGKGTAEHMTMTKGLQQQNPQRATGFRSYVNVVATGSKHLTKRWTPKYVQASNMTAHSSIQLTISMDKTWLTKAWVGRLRNLMAFDRLEEELMWDEGEEIKPKYIGGNMVMCWGIPLHACGKHHKERGWDWGGGGCDEDVDDLQRLDRT

SEQ ID NO: 117414 - protein, 64 aa, Glycine max
  Coding DNA Sequence Number=SeqID_25729
MGEEEKKPEENKVEEKKVEEEEKKEEEKKPEESKDDKESKEESALPEIVQGTTFAMHEHFEHNF

SEQ ID NO: 117415 - protein, 136 aa, Glycine max
  Coding DNA Sequence Number=SeqID_25730
  Homolog annotation: Hit_ID=A7UQT1; Match level="QueryCoverage=62%, HitCoverage=83%, E-value=6e-08, Identity=40%"; Hit description =Putative uncharacterized protein
  Pfam annotation: Domain name=zf-GRF; Domain location=16-60; Score =40.7; E_value=5.1e-09; Accession=PF06839.3; Description=GRF zinc finger
MERSSSSYTSEARSRVFCMCNIEAPLVTSWTEENSGRRFYGCGLYKVGKGCNFFQWHDPVGNNRQKKIIVALMKEVDELKLREKGLQSRISDMKMKEKYCHSNDGILVNDVIFNCDGMGEGHFMKHRHFLFRLIKS

SEQ ID NO: 117416 - protein, 364 aa, Glycine max
  Coding DNA Sequence Number=SeqID_25731
MDDVAMSGTQNTCLNDETLWCQNPNKPVSTPTLRSMKNEAYSKSKATLNNIETIFIPGDDDDEFIKLLPMGMKGKFVTRETKTTYSSPKTVNLSGSNKVNTTDDSFPPKPFMSNYVTGLTAKDMPCCFKPTVDMNLTFEETQVCAYVFNPNVDPSGNEILYRVGNNLGTRQTFQSLCPNKLVREEIILFMALKVAYSQLYRTRSVWCMPPAFAVDVINGSPVETLIQHYGKDCMPPFSNLNLIYIPIVQNSDHWYLMANVMLSVLEIVFPTQEFVIGFDGMDSWDIVEARGIPNCGSSEKSALWVLEWMQMEKSFVSLLYGVLEERAVRMKVAMILLLGTHNQYKGDLIRNTKRNWHDCIHAKH

SEQ ID NO: 117417 - protein, 88 aa, Glycine max
  Coding DNA Sequence Number=SeqID_25732
MEALAGTRRRRHRTTEERCLPVQPRPVTAEATDTASHRSRTLMRVRCEFDAGHAGDEPRPFFIACIRVKIAALQVSEYKSYVLELMSH

SEQ ID NO: 117418 - protein, 49 aa, Glycine max
  Coding DNA Sequence Number=SeqID_25733
MTFRLAEVGGERKCWSNRGFDEVKMKKCNGLQATDTQNEIHIELILIGM

SEQ ID NO: 117419 - protein, 66 aa, Glycine max
  Coding DNA Sequence Number=SeqID_25734
MEGHTLMYHVSQRALCGRARARLTGALSKGGKMRGVATNVYLWKTSEKPKETGQNENSKFGSCIYV

SEQ ID NO: 117420 - protein, 502 aa, Glycine max
  Coding DNA Sequence Number=SeqID_25735
  Homolog annotation: Hit_ID=A7UQU7; Match level="QueryCoverage=60%, HitCoverage=68%, E-value=9e-31, Identity=28%"; Hit description=IMP dehydrogenase/GMP reductase, putative
  Pfam annotation: Domain name=DUF1723; Domain location=117-163; Score =11.4; E_value=0.024; Accession=PF08330.1; Description=Protein of unknown function (DUF1723)
MESKSKGERIERHNRNRKNENGFNSADPSGTGRGQTISSAQQQQEHVVEDPPMAVEELHEEQQKAPVEDPPTDVEGFLGGPHDTSVLSDYENHNAFKIWNGEERPELKLSSLGRKMTKFGRLALVIEGLETSSFHLPVGEVTITLDDMASLLHLPIVGAFHNFEQLHVDDAVEMLMKINACHWIVAARAYLLHLLGCTLFANKSVTHVHVVFLDALRDLTQSVTYAWGAAALVHMYDNLNEVLKSTHFSSIGSALAAEDYDGRRPRTCWWTFGKALPVSTYHRYLERLTPDIVCWIPYGDHRSFREFEVITLFSGHLRWGPLMVIHRPERVVRQFGYIQTISSHPATTSVSFEEMDDRWMQFSDYIAPVGQICVVPGQCSPNYMDWLCMISHPFMSPAQLGDPPRVLSVQQYDTFVEPDVHQQQVAATTLDEADADVHHVGHAMDAFAAIIDKLERLLNLRILTEGIEAYIVVEECVGITRRFTSQPAVGHRSRRRRRTDGH

SEQ ID NO: 117421 - protein, 271 aa, Glycine max
  Coding DNA Sequence Number=SeqID_25736
  Gene Ontology: Mol. function=RNA-directed DNA polymerase activity; Biological process=regulation of transcription, DNA-dependent
  Homolog annotation: Hit_ID=A5B388; Match level="QueryCoverage=57%, HitCoverage=15%, E-value=6e-24, Identity=33%"; Hit description =Putative uncharacterized protein
MALFDTGTDSNCILEGLVPTKFFEKTSEKLTTTNGLKLKINYKLSSAIIENQGLRINTNFLLVKNLKNEVIIDLPHAFWNRRKHIVDLPYEKDFRLKKIPPPWSDIHTQVVKDIKFKIQSIKCLYLPIPQAFKIIETDVSDIGYGGILKQRVHDQEHNTYRAPQILYLTISPVNSYRKTVMPPKATGTSLRGGRSTEYDKGDDKKLKGQSKNEFKIESRTLQDSRGKFISRIKIQEIKISRIKIQEIKIQDSRIKRKLNQDKYEKVFSKFE

SEQ ID NO: 117422 - protein, 261 aa, Glycine max
  Coding DNA Sequence Number=SeqID_25737
  Homolog annotation: Hit_ID=A5AJA0; Match level="QueryCoverage=91%, HitCoverage=52%, E-value=2e-30, Identity=35%"; Hit description =Putative uncharacterized protein
  Pfam annotation: Domain name=zf-XS; Domain location=141-181; Score =3.7; E_value=0.077; Accession=PF03470.5; Description=XS zinc finger domain
MEVIPNYWLTSLDVESHESLVSGAEWESESPKAGFSSTASGWPSFDDIKSSSLTYSLSAEEKATVAVLQLQHRALEACQKFLVGDAGSDSDEDDEEAEDDELLDNDSKESEEYKFFEKVFAEDGDLRRYYENNHKEGDFYCLVCGGIGNKVWKRFKDCIGLIQHSTAILRTRRKRAHRAYAQVICKVVGWDIDQMPAIVLKDLDSSLAGSRKLFVEPKNLVVGCTGDTNSNLSCFHRVKLLILLINHTEVEAKAEAANSTN

SEQ ID NO: 117423 - protein, 89 aa, Glycine max
  Coding DNA Sequence Number=SeqID_25738
MTMSVMMTTISVPIPMGVGDGVDVDGSNIGGNGGNVNGGVDVPSTCTTKDVPSNVLRQRSQAVKPLILCEWGYKKLSDGRRETPKNSGG

SEQ ID NO: 117424 - protein, 25 aa, Glycine max
  Coding DNA Sequence Number=SeqID_25739
MVVATEGGVCGSILVGDVRYVINQK

SEQ ID NO: 117425 - protein, 55 aa, Glycine max
  Coding DNA Sequence Number=SeqID_25740
MVNVISCSRSLKAIDEDVWEVLGAGPKYYLIMTPTPTTRTRPGCSSHPMATGSTS

SEQ ID NO: 117426 - protein, 59 aa, Glycine max
  Coding DNA Sequence Number=SeqID_25741
MEKLKRLSIPSGMLRFSNHASYPRTDHPTRFFKGSIRHAMAVPKAEKMQRQDETNKKQA

SEQ ID NO: 117427 - protein, 89 aa, Glycine max
  Coding DNA Sequence Number=SeqID_25742
MDKSLKVGKDEWREKEIRSTKFYASNEAHENPRVFSYISGPIFLESPSHGSSDGSFPWENCITGYGDAGNMYAAQSSGARASAKYFKLV

SEQ ID NO: 117428 - protein, 79 aa, Glycine max
  Coding DNA Sequence Number=SeqID_25743
MVEACVESTSKDEKESPSDATRNPRVAHNRGLSLGREHLWAPRLITYGRGAVTCTTGWSRQTQHSSLMRVSCGHAKAIS

SEQ ID NO: 117429 - protein, 158 aa, Glycine max
  Coding DNA Sequence Number=SeqID_25744
MAGQAHAANSNGETYANVERVPSLLLARPSKSNPTITVGGTGKYVALQICDDEDVETMIESFQQQQQMSVLELYVEKDVAGGSMYHFANSITSCGHNLSHHESELPRNISNLHDDDYLASNSYVEDSLDEDDSVDEISDTNDEVTDIIEPVSIVHPTE

SEQ ID NO: 117430 - protein, 145 aa, Glycine max
  Coding DNA Sequence Number=SeqID_25745
MIDQWNNHHAFRVDAYPRQEGLLSFNSDYMVWYRRKTKMFVDPQNANTATLAEVAETLQYMVSPQERNTWTVDDLVPYVEKITILSEEKERITEPVSHGPASERQFPAQEFHILLSSVETQGIGKRREAVEAEEYSQQMAERAME

SEQ ID NO: 117431 - protein, 91 aa, Glycine max
  Coding DNA Sequence Number=SeqID_25746
MTPPAALTEDLAPNGVVVAESLPPKGNMAEDIAAPNGVIIVEDEEAPNDAVAAPKIEEPMVSNAGAGEEKEAKEKKVTEEEEAKEKERWDR

SEQ ID NO: 117432 - protein, 51 aa, Glycine max
  Coding DNA Sequence Number=SeqID_25747
MASMSKAMTPEIKKHASCAEGDDYNGNINYVFAYMEGDDDDDGGYDYAPAA

SEQ ID NO: 117433 - protein, 51 aa, Glycine max
  Coding DNA Sequence Number=SeqID_25748
MLKDDCDSKVHLMLAAHADSLGFLLNPKPMSSSFSRIDRPLASLYDFKSVT

SEQ ID NO: 117434 - protein, 168 aa, Glycine max
  Coding DNA Sequence Number=SeqID_25749
MVGYMPVSFADLVFAGEWIEVSLKKGKFDYAASMNSSSLRPEMNGVKKKEKEAHVVVVVPTCANFSQTPYNPIRRRRSNQFNNVLLNVQDKVNCSKITEISEEKNANSIYTGLATCRAYVQSSSNPLEIFHYPCKSFTDFEHTLGSLTLVFKILQETTSLLITTAFLR

SEQ ID NO: 117435 - protein, 91 aa, Glycine max
  Coding DNA Sequence Number=SeqID_25750
  Subcellular localization annotation: CTP_CleavageSite=82; ConfidenceScore=5.00e-01
MASYGGEFLLDSSSPRSGVSNHLSSISIPLPLIFKKQMTPLMKKIQGLQAPHGATSCRNWKGGLMPSLEEFESRSKGPTTLRAIGLRSTPN

SEQ ID NO: 117436 - protein, 205 aa, Glycine max
  Coding DNA Sequence Number=SeqID_25751
  Homolog annotation: Hit_ID=A5AZ88; Match level="QueryCoverage=32%, HitCoverage=6%, E-value=2e-08, Identity=37%"; Hit description =Putative uncharacterized protein
MDIEKDSDIPLILGRSFMFIAKCVVDMGNGNLEMSVEDQKATFNLFKAIKHPSDNKIYFMVEAIEQEADLARRNLKSIPFHCLLGAKASQGRTTPDAPPAPPPVILPPITFSTADKPFSPSSPARASSLDDAEPSPWPSPHHLELAPAIHSPFYATSTDDTRGFSIAGCLARSPTLFYRGVTPLAWTLWPQGLTSGIRAGFLYKV

SEQ ID NO: 117437 - protein, 68 aa, Glycine max
  Coding DNA Sequence Number=SeqID_25752
MALTSKAINQECKKHACGNKDGDWYLYYAPTACTEGDDHKGNGDSCFGHIAYMKGDDDSDIYDYAPAA

SEQ ID NO: 117438 - protein, 97 aa, Glycine max
  Coding DNA Sequence Number=SeqID_25753
  Pfam annotation: Domain name=SAM_1; Domain location=4-65; Score=13.5; E_value=0.0071; Accession=PF00536.21; Description=SAM domain (Sterile alpha motif)
  Pfam annotation: Domain name=SAM_2; Domain location=7-67; Score=11.8; E_value=0.084; Accession=PF07647.8; Description=SAM domain (Sterile alpha motif)
  Pfam module annotation: Pfam domain module=SAM_1::SAM_2; Domain location=4-65::7-67
MDEEQWSEVLALRVRLSRYAPMFEIHEVDDELLLMLNLEDLKDMGMNIFGSRRKIDFPGEVQDMLAYQHGLCMKKTCAFNASIKCSNKLKTLDEEKE

SEQ ID NO: 117439 - protein, 30 aa, Glycine max
  Coding DNA Sequence Number=SeqID_25754
MAWIAPGWALSGLNSTIHPDVKHGRVAGEA

SEQ ID NO: 117440 - protein, 45 aa, Glycine max
  Coding DNA Sequence Number=SeqID_25755
MVCGEPKRFGARPMHMGVLDRRLQEDWAKDAREGPRVLMSLRVDF

SEQ ID NO: 117441 - protein, 186 aa, Glycine max
  Coding DNA Sequence Number=SeqID_25756
  Gene Ontology: Mol. function=protein dimerization activity
  Homolog annotation: Hit_ID=A5ASU7; Match level="QueryCoverage=72%, HitCoverage=25%, E-value=2e-16, Identity=38%"; Hit description =Putative uncharacterized protein
IHSKKNRLEHKRLHDLVFVKFNQQLKQRYNARDEIDPISLNDIDVCNEWLVGEMDEDDDNDAGNDLVFEDDDALNRASVYEASGVGECRMYTRRKKMERNQPTSVAAAAQTSKKRAIIVGSSSRKQNAIQENDEDLDFEKDIELESEEEEIMVNFEAYDGEEGEGDDAPLSYDNNEDDYVGIGEDD

SEQ ID NO: 117442 - protein, 229 aa, Glycine max
  Coding DNA Sequence Number=SeqID_25757
  Homolog annotation: Hit_ID=A5BMH4; Match level="QueryCoverage=90%, HitCoverage=22%, E-value=7e-21, Identity=31%"; Hit description =Putative uncharacterized protein
  Pfam annotation: Domain name=zf-C2HC_plant; Domain location=2-49; Score=16.7; E_value=0.00044; Accession=PF07567.3; Description =Protein of unknown function, DUF1544
MTHVAWDTNTIVCNFCGKITKGGITIPKERLIEKSGNVAACKKTPPNAVEELKEYMVNKKSGTTYNSSGSGNMANIRYFEFGEPIGCDGSEDEFADSCNATAKTKCGTKKGAMDKFCKNPKNAINRRKMEMLRQMNIRESMDKNEVLKVHQYIARFWYQAGLSFNLIKLKSFENMVVVIGQYGPYLPIPSYYDIRVPLLKKEVEYTKNLMKGHRAMGQVWLYYYVRCMD

SEQ ID NO: 117443 - protein, 134 aa, Glycine max
  Coding DNA Sequence Number=SeqID_25758
  Gene Ontology: Mol. function=1-aminocyclopropane-1-carboxylate oxidase activity; Cellular component=proton-transporting two-sector ATPase complex; Biological process=ethylene biosynthetic process
  Homolog annotation: Hit_ID=Q8L812; Match level="QueryCoverage=76%, HitCoverage=37%, E-value=3e-44, Identity=86%"; Hit description=Fruit ripening-related ACC oxidase
  Pfam annotation: Domain name=2OG-FeII_Oxy; Domain location=23-126; Score=123.7; E_value=5.2e-34; Accession=PF03171.11; Description=2OG -Fe(II) oxygenase superfamily
MVQEGDEGFWFEVRETSKTVAGPTFGTKVANYPPCPNPELLKGLRPHTDAGGIILLFQDDKVSGLQLLKDGQWVDVPPTHHSIVVNINIGDQLEVITNIGKYKSVVHCVIAQTDGTRMSIASFSTCDSTNRLKF

SEQ ID NO: 117444 - protein, 57 aa, Glycine max
  Coding DNA Sequence Number=SeqID_25759
MWPMYVAAIVVAEILILNPDWEIVRVLNQWMKRLSDGTEQIFVMSIDRVDGLKEDLA

SEQ ID NO: 117445 - protein, 38 aa, Glycine max
  Coding DNA Sequence Number=SeqID_25760
SREVLMMQSYPARALDRRPQVEWAKDAREGPRVLMSLR

SEQ ID NO: 117446 - protein, 101 aa, Glycine max
  Coding DNA Sequence Number=SeqID_25761
MRKDRERGVSTRRERSERWYWREECSEPPRKDREKGVSTLKERSECWYWRKEFSKPLRKYREREVSTRRERREHWYWREERIFNISFKMNYSVESIHPNIG

SEQ ID NO: 117447 - protein, 35 aa, Glycine max
  Coding DNA Sequence Number=SeqID_25762
MAGRNNRAIADALQALAQAIGNPNWGEAGGAVEYQ

SEQ ID NO: 117448 - protein, 49 aa, Glycine max
  Coding DNA Sequence Number=SeqID_25763
MEELINKTQLSPKIIPMPSRRLGGSSTKSHFLHPTAVILLPRTRFTIIT

SEQ ID NO: 117449 - protein, 176 aa, Glycine max
  Coding DNA Sequence Number=SeqID_25764
  Gene Ontology: Mol. function=metalloendopeptidase activity; Biological process=proteolysis
  Homolog annotation: Hit_ID=Q0WNY2; Match level="QueryCoverage=44%, HitCoverage=7%, E-value=1e-09, Identity=43%"; Hit description =Putative uncharacterized protein At1g06900
MRKDIDRPMAREECCIVGSAHPALLDYLEVAIKRQGSASESEDDNERNDVVEEETDDDDNAFFDTHDWYNSSYKWTNSLQLPFRLRPSKNCCLGCKIDLIHLLREDTPPEWIFKEIQNIGNIDFRFVEEQPPHDYSVELAVYWTYYVVEGHCLQAHIKTVPPNPSLLAELSKTVIR

SEQ ID NO: 117450 - protein, 101 aa, Glycine max
  Coding DNA Sequence Number=SeqID_25765
MNDARRSIVSHCAREGRLVDKGRGTSREVDVESTGSSASSCGGVKAIEDRLVDKGRGTSREVDVESTGSSASSRGGVKAIEGEAIRNIVVVPHPHVSLKWG

SEQ ID NO: 117451 - protein, 152 aa, Glycine max
  Coding DNA Sequence Number=SeqID_25766
  Gene Ontology: Mol. function=symporter activity; Cellular component =integral to membrane; Biological process=auxin mediated signaling pathway
  Homolog annotation: Hit_ID=Q2UZS4; Match level="QueryCoverage=39%, HitCoverage=12%, E-value=4e-23, Identity=83%"; Hit description=Auxin influx carrier-like protein 3
MLSQKQAEEAIVTNETKHEVGSTKEEENEQAHSIFSLKSILWHGGSCFFHPTMNIYYINDKLDKRTSTYIFGACCATIVFIPSFHNYRIYYFLGLGMTTYTAWYLVVVVTRPGDKSLVCNNSMQVAVEEKGIKGTNTIHCSKTVAFSSRTPD

SEQ ID NO: 117452 - protein, 153 aa, Glycine max
  Coding DNA Sequence Number=SeqID_25767
MFIWIGGPLIPLQVEWFPTWEYGSFHDAVDEGVLTSGPPCKTVDVGETWIILSVDCVSGVLFPLSVLRQSFSTPPHGVALSPQCDFGVAGEYQYLAWLDRVLTMGAKERENERPQGMFYCSPTVGAKCTYQNPKLSDVRVDVAKVGSRTSHVG

SEQ ID NO: 117453 - protein, 79 aa, Glycine max
  Coding DNA Sequence Number=SeqID_25768
MEPILATSTLTSVSQLQILIFSPMISTWSGLRRETPLESSNPPPTTMIDNDTLQQLQTRIAEIEQCHKEELKKLKIDHD

SEQ ID NO: 117454 - protein, 565 aa, Glycine max
  Coding DNA Sequence Number=SeqID_25769
  Gene Ontology: Mol. function=nucleic acid binding; Cellular component= cytoplasm; Biological process=stem cell maintenance
  Homolog annotation: Hit_ID=A7PEX3; Match level="QueryCoverage=100%, HitCoverage=60%, E-value=0.0, Identity=83%"; Hit description =Chromosome chr11 scaffold_13, whole genome shotgun sequence
  Pfam annotation: Domain name=PAZ; Domain location=1-57; Score=3.6; E _value=0.00076; Accession=PF02170.13; Description=PAZ domain
  Pfam annotation: Domain name=Piwi; Domain location=208-529; Score =527.9; E_value=1.1e-155; Accession=PF02171.8; Description=Piwi domain
  Pfam module annotation: Pfam domain module=PAZ::Piwi; Domain location= 1-57::208-529
MYGFTIKYSHLPCLQVGSQRKVNYLPMEACKIVGGQRYTKGLNEKQITSLLKVSCQRPREQETDILQTIQQNNYENNPYAKEFGISIDSKLASVEARVLPAPWLKYHDTGREKEYLPQVGQWNMMNKKVINGSTVRYWACINFSRSVQESAARGFCQQLVQMCQISGMEFSQDPAIPIHSARPDQVKKALKYVHSAVIDKLDGKELELLIALLPDNNGSLYGDLKRICETDLGLISQCCLTKHVFKINRQYLANVALKINVKMGGRNTVLLDALSWRIPLVSDIPTIIFGADVTHPESGEDSCPSIAAVVASQDWPEVTKYAGLVCAQPHREELIQDLFRCWKDPQRGVMYGGMIRELLLSFKKATGQKPLRIIFYRDGVSEGQFYQVLLYELDAIRKACASLEPSYQPPVTFVIVQKRHHTRLFANNHDDRNSTDKSGNILPGTVVDSKICHPSEFDFYLCSHAGIQGTSRPAHYHVLWDENNFTADEIQSLTNNLCYTYARCTRSVSVVPPAYYAHLAAYRARFYMEPDVAEISKLRGTRSKEGPVRALPALKEKVKNVMFYC

SEQ ID NO: 117455 - protein, 117 aa, Glycine max
  Coding DNA Sequence Number=SeqID_25770
MKLASTFPTKCDPSLPESASPSPLSAASSLCPEPLYPPPSWYGGEEGEGERAVVAAAAAKAKGAELVIGGVREGYGGSVVVVIRGFVHGHRSHRHGGNMYAFLFCFVRCVVRKMRAS

SEQ ID NO: 117456 - protein, 86 aa, Glycine max
  Coding DNA Sequence Number=SeqID_25771
MAQVHGGIDEKVEVTWDLPRCVIKTSLLMSLRPLIAMMKGLLGFREKGAKLKWNLWKLLRYGEGFDAYWKHSIFVETVNIAKETLV

SEQ ID NO: 117457 - protein, 219 aa, Glycine max
  Coding DNA Sequence Number=SeqID_25772
  Homolog annotation: Hit_ID=Q2HTK5; Match level="QueryCoverage=64%, HitCoverage=56%, E-value=2e-09, Identity=32%"; Hit description=H+ -transporting two-sector ATPase, alpha/beta subunit, central region
MGQTHAQIQCRSPVACDNGGDATMGPCREGPKDCSDGIAIQDGVAKFVGCGQGGHVEDFAYQFEVERGLEWETCDWYNRLIKDRLSTRTNLRTRQVELNDSRCPLCNSPDEDATHLFFYYTKTLPLWWESQSWINSSGVFPHTSKDHFLQHDNRSAVGVRARRWKCWLITLTWTIWKHRNRIVFDNQSFDGSKVMDDALFLLWSWLKVMEKGFTMHFSY

SEQ ID NO: 117458 - protein, 551 aa, Glycine max
  Coding DNA Sequence Number=SeqID_25773
MGGSDFGGSFQQPLMDRKVISIGVSSSEDTCCGASENESTYSKRLKALRCTGGGTSHFRRRARPSATSPIRDPVSVMVTGKIGWVSLNNVSKKLFEFDSNVFHRFKDHFLKVMATDVVADGTVDPCGKGRQSYFGTVVGLIGHVGHPFSFLDEQSFRIMGDFPLRPLVKQVGLVVIVDEVSPSALSSILANRKQDDGVGPSGRKKSRAPMSLCILRQVVGLKPGAGHPLSLQDAPTAPTVIETPASATIVATIPAPLPPPAIVVQEVTPTTRVGVPTTSASSVLVSSSTAATPLLSVGVATTSAPIMSPPPSLAPPDSTFCCVGGCAAFLVFFPDVSLDHMYTSSNVNSLWGGNYKPEQKTSTGIVSTFDKNLIWSVGVQNATNFAKVFLQRSLTILEENEQRHREALCKVSSLEIEVAKWRANAHMVWRQKRPKLANATIAFAEVEEKKDLAGKVEGIAAKTDKLSKMVANLEAWLKKSESRLEEAELRIAKEREASKELEEELIMHKKEAKYFAKDLDLDPFGLFKDMKNGVLLDEEEIVAEEEVADEE

SEQ ID NO: 117459 - protein, 99 aa, Glycine max
  Coding DNA Sequence Number=SeqID_25774
MQAKNEKEAWETLKNEFKGADKIRKITTVNFLEKEEEHLLIVVKGAKSNGVIMLQAPIANYARKIIMIQMIVGTNAKSAKGTYTTKKIVFTDKKKKQIF

SEQ ID NO: 117460 - protein, 51 aa, Glycine max
  Coding DNA Sequence Number=SeqID_25775
MTLRQYGLSLGSSSLMDSFASWKMNDSGMEKEEREETPLQGEDESRRSSPP

SEQ ID NO: 117461 - protein, 81 aa, Glycine max
  Coding DNA Sequence Number=SeqID_25776
  Homolog annotation: Hit_ID=Q2HV71; Match level="QueryCoverage=70%, HitCoverage=7%, E-value=4e-08, Identity=47%"; Hit description =Protease-associated PA; Proteinase inhibitor I9, subtilisin propeptide
MWLLSKEMAPSFSNSSNGLWHALNFGEDVIVGVIDIGVWLESEGFKDHRMTNKILNKWKGSYEEVQDFNTHVGCSCCSHDE

SEQ ID NO: 117462 - protein, 489 aa, Glycine max
  Coding DNA Sequence Number=SeqID_25777
  Gene Ontology: Mol. function=DNA binding; Biological process =regulation of transcription
  Homolog annotation: Hit_ID=A7PEX1; Match level="QueryCoverage=88%, HitCoverage=86%, E-value=1e-106, Identity=54%"; Hit description =Chromosome chr11 scaffold_13, whole genome shotgun sequence
  Pfam annotation: Domain name=Myb_DNA-binding; Domain location=256 -329; Score=20.4; E_value=0.0066; Accession=PF00249.22; Description =Myb-like DNA-binding domain
MPSQAELSMMDYKPYSYSTLLKSFLDQTETDQTYKLEEFLSRLEEERVKIDAFKRELPLCMQLLTNAVEASRQQLQAFRSNQGTRPVLEEFMPILKHPNSQESAEKTSNISDKANWMTSAQLWSQASEGTKPQSTITSLPKEGADIGFSVSPKLALDNKHRNGGAFLPFSKERNSCQGLRGLPELALASPEKEIEENKCELEAEKCSKRENPGKGGSCEGVNVDQGKSASVASEAQTANTTTTTTNTSGQTHRKARRCWSPDLHRRFVNALQMLGGSQGTKNRFEKITSFVLKTKLLQRNVATPKQIRELMKVDGLTNDEVKSHLQKYRLHTRRPSPSLHTGGPTPQLVVLGGIWVPPEYATTTAAMTNSGDPTLYGPHPTSQVAPPHYCAATQMPQEFYNSALPLSLLPPPHDYTLHHHHFHMYKTAAQTQNSPESDIRSSGDRSESIVDGKSESGKWNGESGEKKGLAALRDQEGEESTGSEITLKF

SEQ ID NO: 117463 - protein, 96 aa, Glycine max
  Coding DNA Sequence Number=SeqID_25778
MASYGDEAPKKEKSLALSSQKVKQALLSKEQVSISLSKSLEAETPLMKILSKSLMKMNSPSSHEIFSRCGRTKGDPNRRTSQKCCSRKRKTKTKAP

SEQ ID NO: 117464 - protein, 91 aa, Glycine max
  Coding DNA Sequence Number=SeqID_25779
LKFQITPSNGGTIKVAKGLFELKPTAFRDSRNANSFLHFLFLIVLCHTLILSGDHTLLGCDPHLITSRYLEPIVRQFVKFRDMSEAKRKAL

SEQ ID NO: 117465 - protein, 139 aa, Glycine max
  Coding DNA Sequence Number=SeqID_25780
  Pfam annotation: Domain name=zf-CCHC; Domain location=82-99; Score =28.1; E_value=3.3e-05; Accession=PF00098.14; Description=Zinc knuckle
EELRDYYEGRHRSHLRPHSHMRENERKPQEANINLPYFHGKDNKDQGLGILGAAPSKPKDDKGKTIEKQSPKASTQEKTSSIKCFKCLRRGHISSQCPTIKTMIMRGQETEKAKGEESSEEIYPQEEGQPLVVKEKCKE

SEQ ID NO: 117466 - protein, 79 aa, Glycine max
  Coding DNA Sequence Number=SeqID_25781
MTGGNLGDLQPFDPEIDRTFHRLVTDSVHPGHSVHFEHFEHSIEGDSEYSDFEHSTTNFHIGNMAQPPPRDRTLGRWLP

SEQ ID NO: 117467 - protein, 39 aa, Glycine max
  Coding DNA Sequence Number=SeqID_25782
MALGVRLLEPTQVAFFACPEPGRDDDLSVVTLAFICIRP

SEQ ID NO: 117468 - protein, 52 aa, Glycine max
  Coding DNA Sequence Number=SeqID_25783
MLEAATATTLASIIFFMLIMASIIAAICSCTSSTSPITLAQLRKKCNEQCNQ

SEQ ID NO: 117469 - protein, 151 aa, Glycine max
  Coding DNA Sequence Number=SeqID_25784
VVPAAVIAGRPAEPVAGVGSGTAAVVTAAFHLCPRGAVLHPAVRADGQACADRHGAGGDDHRGRVGLDAAPVRTSRRHGDQGRGFPAVADGAALVRLVAVPAPSRVPRGGSAPGNAAVADPGLPAGCRGVAGAAGLGPAAHAHGRTAGLRA

SEQ ID NO: 117470 - protein, 120 aa, Glycine max
  Coding DNA Sequence Number=SeqID_25785
MEDEGPTAQVPQHVEDKSSEATILEPFVIGEEAEETQVRQVVVATPERSLEATSEPSAQGENIPSPQPTAGPSTLLLEMPEDPTTPVLAMDSSPLATPVLHLTNEEDVQTQDTQDQSQEF

SEQ ID NO: 117471 - protein, 159 aa, Glycine max
  Coding DNA Sequence Number=SeqID_25786
MGLGKNNGGRTSLVSTKGNRGKFELGYKPTQAGIRKNISEKKNKGQSLRLGQRAKEPPPCHISRSFISEGLRREGQVAAICDDESPRRSDLVRPCPTSLQLGNWHVEECPDVYVTSIISDDESHKGTNTGDPVVDFEQEASRAENEEDEDVGLPLEWRG

SEQ ID NO: 117472 - protein, 238 aa, Glycine max
  Coding DNA Sequence Number=SeqID_25787
MAVLEREGSDGLGSTEAQLTTSKDWKAVSNDSSAASTYGAEEGQLTNISSSPDTITKSPPTANFNFGEALNGTLPEHESTVFPRGSYSCRNVDIQTGHGIKFPPWGSFPRSITGSLPSSFFRFKPRWSHKVYQFGFFLGGITFKLDPLSISTFERQRGPYSGTDTWSPLPLPRLSSCYISIEIAIVKPSLRYRLLTGLSRASSPLGNRGGMVAQNLVGLEGTPLLLLPPPPRTPFQHW

SEQ ID NO: 117473 - protein, 71 aa, Glycine max
  Coding DNA Sequence Number=SeqID_25788
MGVKYLEAIKRRFHANKQWFPDEIRGKLPGNHITSETSKRVGLRPQKETTPENLAFNGFKQKTQMKHEAET

SEQ ID NO: 117474 - protein, 186 aa, Glycine max
  Coding DNA Sequence Number=SeqID_25789
MEDLLQQMIDQGRLEVDDEGREEQHICMQSADERSFGRPKPLEVYFTKDATPQKPQYPSVVKPVPFPYRNSHAVPWRYAPPSERKEEATNISSLSAKVTNITGLSGVTRSGRVFAPPDLPTQPANVKGKAKMVEEQNDKTTPTLNEDIPVKGLLEKRDGCGKKEVSLEEASEFLRIIQQSEFKVIE

SEQ ID NO: 117475 - protein, 182 aa, Glycine max
  Coding DNA Sequence Number=SeqID_25790
  Homolog annotation: Hit_ID=Q2HTA0; Match level="QueryCoverage=97%, HitCoverage=30%, E-value=2e-19, Identity=33%"; Hit description=IMP dehydrogenase/GMP reductase, related
  Pfam annotation: Domain name=DUF1723; Domain location=43-92; Score =49.7; E_value=1e-11; Accession=PF08330.1; Description=Protein of unknown function (DUF1723)
ERPELKLSSHGRKVHSLGRPVPAIEGLVVGTGLSPLIACSVDTGDRGLLSSFVERWHWETSSFHFPVGELTITLDDISSLLHSPMVGDLHAFQPLHVDDAVQMLVDLLMVSAESARAETAQCHGSYVCLQWVRDIYEHRCQAGHWTAATHTYLLHILGCTLFANKNAINVHVVYLEALRDLS

SEQ ID NO: 117476 - protein, 84 aa, Glycine max
  Coding DNA Sequence Number=SeqID_25791
  Gene Ontology: Mol. function=transmembrane receptor activity; Cellular component=intrinsic to membrane; Biological process=innate immune response
  Homolog annotation: Hit_ID=Q2HS00; Match level="QueryCoverage=95%, HitCoverage=6%, E-value=8e-13, Identity=47%"; Hit description=TIR
MPYSNVEKHWQGVQNLPNLERIELRGSKHLVECPRLSHAPNLKYVSMRDCESFPYVDPSVFSLPKLEILNVSGCTSLESLSNNT

SEQ ID NO: 117477 - protein, 121 aa, Glycine max
  Coding DNA Sequence Number=SeqID_25792
MASGNRLPRVGNRLKGLKMETGGKDGLWLENEVRKLREPLRDGSLVIDYQMNLHGRFSALWSGYYHAYTISSSGARPSDREGDEDPLLEVNSPEEVMSASEADSTEDGGPGEMAISGGSSS

SEQ ID NO: 117478 - protein, 251 aa, Glycine max
  Coding DNA Sequence Number=SeqID_25793
  Gene Ontology: Cellular component=mitochondrion
  Homolog annotation: Hit_ID=A5AFX7; Match level="QueryCoverage=35%, HitCoverage=50%, E-value=5e-13, Identity=44%"; Hit description =Putative uncharacterized protein
MAHLELSIPWRGSTEQPHRPTYLNYPEGNFGGNQLLDGSISLSPLYPSQTNDLHVSIAAGLHQSFLWLRPAQHSSPSFGSRQVCSHSNPSQKIRVVGVQPTGDPTISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGDRFSWWAFPGSLAVTKGIL

SEQ ID NO: 117479 - protein, 54 aa, Glycine max
  Coding DNA Sequence Number=SeqID_25794
MGLNIGENSTPPKQYGNRRDNQRTVARGFVVGSDKRDILKGIVHNSRKSKMVGA

SEQ ID NO: 117480 - protein, 61 aa, Glycine max
  Coding DNA Sequence Number=SeqID_25795
GANSNQAHLGLVATYPSVGGRRETRGMRVPRKEYARSRHQRLFEENVGKTGKDAIYELLSE

SEQ ID NO: 117481 - protein, 89 aa, Glycine max
  Coding DNA Sequence Number=SeqID_25796
  Subcellular localization annotation: CTP_CleavageSite=51; ConfidenceScore=5.29e-01
MRTRSPLKVRACSPLKVRACSPLLARMCSPLKVRGVQPLCWARTCSPLKVKGTNTQGSTLMRKQEIDSSRGPVIPNPHDWILDVGNLCS

SEQ ID NO: 117482 - protein, 383 aa, Glycine max
  Coding DNA Sequence Number=SeqID_25797
  Homolog annotation: Hit_ID=Q84VH5; Match level="QueryCoverage=100%, HitCoverage=57%, E-value=1e-132, Identity=66%"; Hit description =Envelope-like protein
  Subcellular localization annotation: CTP_CleavageSite=3; ConfidenceScore=5.01e-01
MATATKETSALGSPSVPSSPSSTKAPSNQEQPEFHIQPIQMIPGQAPVPEKLVPKRQQGVKISENPSLATSPREVDPEMDKKIRSILMKMSQHLPPQMFLCLMLIKDVPTSSAPNAEALPSPSEEESTEEEDQATEKTPAPRAPEPAPGDLIDLEEVESDEEPIANKLALALQKDYKAEKEKPPLRGLDESNLWHRREHSNHSTTSRRSKVAIPSKKRKEISSSDSDDDVELDVPDIKRAKTSGKKVPGNVPDAPLDNISFHSIGNAERWKFVYQRRLALERELGRAALDCKEIMDLITAARLLKTVTKLGDCYESLVREFIVNIPSDITNRKSDEYQKVFVRGKCVRFSPAVINKYLGRPTDGVVDIAVSEHQIAKEITAKQ

SEQ ID NO: 117483 - protein, 284 aa, Glycine max
  Coding DNA Sequence Number=SeqID_25798
  Subcellular localization annotation: CTP_CleavageSite=65; ConfidenceScore=5.07e-01
MEASQNLAPTSHTSDLNMDRARLVYGLVTNMDMNIGALISGQISSISQSNSSRLRSLALITALSRARGVTSDNLTYESLSPAINLAYIKKNCWNMDDLTVNFKGAKKEKVRPAEVPFSSTLPAPSTSATLTPAPSDSSTQDSQCFESMLQSLHKGQILLMQSLQVVAPPGSILTVEQFLEKVSRPGTLPSLEREGGGPSAQVRQEVATTERSPQISPDPPSPVVDQSSLQQPADPPTLVHEIPADPSTLLLDLPEDHSTPVLGLTTTPPATPMLCLTNEEDNSG

SEQ ID NO: 117484 - protein, 115 aa, Glycine max
  Coding DNA Sequence Number=SeqID_25799
  Homolog annotation: Hit_ID=UPI00006A2939; Match level="QueryCoverage =92%, HitCoverage=75%, E-value=3e-08, Identity=32%"; Hit description =UPI00006A2939 related cluster
LHALTFKGLHILTFRGLHALAIRGLHVLPFRGLDVLTIRGLHVLAFIGLHNLTIIGLHNLTFIGLHALTFRGLHVIAFRGLHAIAFRGLHVLTFIKLHTLTFRALHLEGRKRERS

SEQ ID NO: 117485 - protein, 76 aa, Glycine max
  Coding DNA Sequence Number=SeqID_25800
MAENAYSFGSSGFYSLFFDNDNILRLLYDGLEVSAITGHIHGWHLGKLIRTQCMPDGVVKDVSSQKYSFIMFLRIH

SEQ ID NO: 117486 - protein, 42 aa, Glycine max
  Coding DNA Sequence Number=SeqID_25801
MGAKYLEVVKQMLHAIKQWSPDEIRVKILISILRSSILSVPP

SEQ ID NO: 117487 - protein, 58 aa, Glycine max
  Coding DNA Sequence Number=SeqID_25802
MGVQIAPRPTWALQNIPPEGCCFWRKQPGSPGRAELAWASWAATTSQNLSRGASETFS

SEQ ID NO: 117488 - protein, 82 aa, Glycine max
  Coding DNA Sequence Number=SeqID_25803
  Gene Ontology: Mol. function=aspartic-type endopeptidase activity; Biological process=DNA integration
  Homolog annotation: Hit_ID=A5BI38; Match level="QueryCoverage=53%, HitCoverage=4%, E-value=1e-11, Identity=70%"; Hit description =Putative uncharacterized protein
MSSLHLALKRTSWINVYTKSCWKPYFMLIFAPDLTLRMLLEFWERYQGNPGIDHWKAAKKVMRYLQGTKDYMLMYRQLIVWK

SEQ ID NO: 117489 - protein, 214 aa, Glycine max
  Coding DNA Sequence Number=SeqID_25804
  Pfam annotation: Domain name=zf-CCHC; Domain location=97-114; Score =18.2; E_value=0.0027; Accession=PF00098.14; Description=Zinc knuckle
MKEGIGHILDLTPIEEKRNESLKRLTLTSHTSMGRAMVEQQLKKKSTSKSYGSHFYPKKDQCQGILGVTPSKPNGDKGKTIENQAPKASMQEKTSSIKCFKCLGRGHNTSQCPTTKTMIMRSQDIYSNQDEATMSPSSSESEEAKGEESSEEIYHHEEGQPLMVKEECKETTSTSSPFKKTLVSTATPLGLEVIRQVKELLDEGLVLLGTKSLK

SEQ ID NO: 117490 - protein, 137 aa, Glycine max
  Coding DNA Sequence Number=SeqID_25805
  Homolog annotation: Hit_ID=UPI0000ECAFAB; Match level="QueryCoverage =56%, HitCoverage=93%, E-value=5e-25, Identity=75%"; Hit description =UPI0000ECAFAB related cluster
MRFGRRPGRPQGVRVGRFINAAGTTGFPTGKRAVSATQLIGIPGYRARIRPIVSRITIHWPSFYNVVTGKTLALPNLIALQHIPLSPAGVIAKRPAPIALPNSCAAEWRMAPDAVFSPYASVRDFTPHMVHSQYNLL

SEQ ID NO: 117491 - protein, 59 aa, Glycine max
  Coding DNA Sequence Number=SeqID_25806
MENWRTALGNQFAGLQTRSARQSIREWSILIVGGWMKSAWEGIHWAPNNSGEWRIGEQL

SEQ ID NO: 117492 - protein, 86 aa, Glycine max
  Coding DNA Sequence Number=SeqID_25807
MGVQIAPRPTWALQKIPPEGGSEVEKDPSPLGTSLSFEFAWKNRFREENLSRGASNVSVTFSVKNLARFNRSSTFSFVFIVLRSQR

SEQ ID NO: 117493 - protein, 145 aa, Glycine max
  Coding DNA Sequence Number=SeqID_25808
TLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 117494 - protein, 96 aa, Glycine max
  Coding DNA Sequence Number=SeqID_25809
  Subcellular localization annotation: CTP_CleavageSite=45; ConfidenceScore=5.07e-01
MTVKTSDTCSSRETVTACLCVRRKYRIRRHSPFRLRNCWEGRSVRASSLLRQLAKGGCAARRLSWVTPGFSQSRRCKTTASAKLACLQVDSRGSPR

SEQ ID NO: 117495 - protein, 160 aa, Glycine max
  Coding DNA Sequence Number=SeqID_25810
  Homolog annotation: Hit_ID=A6BLN7; Match level="QueryCoverage=78%, HitCoverage=24%, E-value=5e-07, Identity=29%"; Hit description =Putative transposase
MDNYSWCYLACGQCYKKTGMQTVSFTCLCGKENDQPELRYRVEVIVNHKGEQTKFLIWDCECAQLIGQSTDEVNRFKIEDGDVDLNASPQALDRLLGCFLAFRVKVQPTFRNSVVLKYSNESDLINVVLDMIPDSEQSLSITADHDGPMVGSSEPIEFES

SEQ ID NO: 117496 - protein, 153 aa, Glycine max
  Coding DNA Sequence Number=SeqID_25811
MKSLKIVMAAQLIHDRVEMECLEGAWETLEGNARCRFRGTIRFTATSLVHPDEPARTLQRTVEWILPMPTPYRLVEPIQVIEVTSSEEDPEEDLEELPPEPVVDALDFLEGDEDPLPEVDSPEDVMSASEADSTEDSRLFYGLVLYTFEGGCI

SEQ ID NO: 117497 - protein, 152 aa, Glycine max
  Coding DNA Sequence Number=SeqID_25812
  Gene Ontology: Mol. function=chlorophyll binding; Cellular component =integral to membrane; Biological process=photosynthetic electron transport
  Homolog annotation: Hit_ID=Q2MI75; Match level="QueryCoverage=73%, HitCoverage=32%, E-value=5e-39, Identity=53%"; Hit description =Photosystem II P680 chlorophyll A apoprotein
  Pfam annotation: Domain name=PSII; Domain location=1-152; Score= -171.0; E_value=0.0015; Accession=PF00421.10; Description=Photosystem II protein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGLLSLLELCGMVQQQPLLNYSVLLVINGIRDTFSKKYIEELVLD

SEQ ID NO: 117498 - protein, 225 aa, Glycine max
  Coding DNA Sequence Number=SeqID_25813
MGDQEETQEQMKADMSALKEQMASMLEAMLGMKQLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDLQDYARRDVEFYPPIPEGPAPGTAVEGFGDYPFADMTDLCLLPDVVIPPKSKCWTSTSIRDDLSKNHLKIFPYPYLEGSDYRFLRQYQYNSDMAPD

SEQ ID NO: 117499 - protein, 105 aa, Glycine max
  Coding DNA Sequence Number=SeqID_25814
MLAVISKYQEELSLATAHEHKVADEYAQVYAEKEARGRVIDSLHQEATMWIDRFALTLNESQELPRLLAKAKAMADTYSAPEEIHGLLGYCQHMINLMAHIIRNR

SEQ ID NO: 117500 - protein, 194 aa, Glycine max
  Coding DNA Sequence Number=SeqID_25815
MIIDQSLLYALTKLPSQGAPFEGTIVDDWKFDYSSHDARRMIDWAYLVRYRMHKALRANAPLPYPQLVTLFLHHFQIPLDDEPFVQVKRSFAIGAGAVTSFGYRKDRKGHWLMIDALPPQDERTPSPPPQRDDSALMTEVLSELRGLRTYVGERFDSWIIALPEWISVSHSLKKMWVIFIRALIFHHHLHLLRV

SEQ ID NO: 117501 - protein, 31 aa, Glycine max
  Coding DNA Sequence Number=SeqID_25816
MESYEDSENEEINLCLMAKSYESDEEGLEPP

SEQ ID NO: 117502 - protein, 94 aa, Glycine max
  Coding DNA Sequence Number=SeqID_25817
MGVQIATRPTWALQKIPPEGCCFWRKQPCSPGRAELAWASWALLSLSNLLGKIVSVKKIQAEALPKRFRNVSVRNFVKVSIVLRRSSSFFDLQR

SEQ ID NO: 117503 - protein, 233 aa, Glycine max
  Coding DNA Sequence Number=SeqID_25818
  Gene Ontology: Mol. function=motor activity; Cellular component=cell projection
  Homolog annotation: Hit_ID=P15305; Match level="QueryCoverage=95%, HitCoverage=81%, E-value=1e-17, Identity=26%"; Hit description =Dynein heavy chain
RDACPHFRGLHVHPFKGLHVLTFGRLHILPFRGLHVLTFRGLHVLALRGLHVLAIRGLHVITFKELHVLAFRGLHALSFRGLHVLAIRRLHVLPFTGLHVLAFRGGLHVLAFRGLHALAFRGLHVLSFRGLHALTLRGLHVLSFRGLHVLAIIGLHIFAFRGLHVLAFSGLHILPVRELHVLAFIGLHALTFKGIHDLAFRGIHVRALRGLNVLTLGELHVVDFRGLHAFAFR

SEQ ID NO: 117504 - protein, 57 aa, Glycine max
  Coding DNA Sequence Number=SeqID_25819
MEVWEVNVSLLRLSFLFSPMRVRKGSVTRAMSKRLQEDWARAAEEGPRILMNLRVDL

SEQ ID NO: 117505 - protein, 91 aa, Glycine max
  Coding DNA Sequence Number=SeqID_25820
MTGPLDESISCFLTKVDPWLLVPITFRGLYVLAIRGCTLKRPGLEGLPNSSLLQGHDEGQRLYLKALHWGNERHHVKTSSEPRGRLEDLTE

SEQ ID NO: 117506 - protein, 105 aa, Glycine max
  Coding DNA Sequence Number=SeqID_25821
MVEASGNRLPACVIDYTEEWVTGNRLPGRSVVLRERGGLVGVREPQLEVGNTGMVAFMRDLRIVKYPEEESRGSRRPLGSRCVDATCPNFQRRLRIPTPEVDPEA

SEQ ID NO: 117507 - protein, 58 aa, Glycine max
  Coding DNA Sequence Number=SeqID_25822
DMPYLQDGRPVDMVFNPLGVPFTNECGGHLQVFFPSGRAATTGEAKLEALGKNLEGYL

SEQ ID NO: 117508 - protein, 23 aa, Glycine max
  Coding DNA Sequence Number=SeqID_25823
NLAKVSTVLRRSSFVLHRSSIFN

SEQ ID NO: 117509 - protein, 151 aa, Glycine max
  Coding DNA Sequence Number=SeqID_25824
  Subcellular localization annotation: CTP_CleavageSite=28; ConfidenceScore=5.02e-01
STLEDPRPKEVQQGPGVSSSGYGPSSVLQGARSPSKESHTQRHPVDPEKSNRALGFPALGSRPQDTQWTRRGLTGSWSCQALITGLCQFYGVPVAPNMVIRPPTNRAFIKKYCIPRQALGETPQQPGDGRQRATDAPPSPLEFTSSHPQKG

SEQ ID NO: 117510 - protein, 269 aa, Glycine max
  Coding DNA Sequence Number=SeqID_25825
  Homolog annotation: Hit_ID=Q9AVH2; Match level="QueryCoverage=31%, HitCoverage=41%, E-value=4e-39, Identity=70%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 117511 - protein, 322 aa, Glycine max
  Coding DNA Sequence Number=SeqID_25826
MAKFDPKIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLGVRHPDTDEHPCGSVGSLMPYIFLQGLGFPALITGLCQSFGVPVAPTKVIRPPITRAFIEKYCTQRQGQGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPEAPDDGEEAHEDEEMADLLDFLGGSGDT

SEQ ID NO: 117512 - protein, 151 aa, Glycine max
  Coding DNA Sequence Number=SeqID_25827
  Gene Ontology: Mol. function=protein serine/threonine kinase activity; Cellular component=cytoplasm; Biological process=protein amino acid phosphorylation
  Homolog annotation: Hit_ID=A7QNJ6; Match level="QueryCoverage=65%, HitCoverage=26%, E-value=1e-48, Identity=93%"; Hit description =Chromosome chr2 scaffold_132, whole genome shotgun sequence
  Pfam annotation: Domain name=Pkinase; Domain location=1-128; Score= -62.3; E_value=6.9e-05; Accession=PF00069.16; Description=Protein kinase domain
NVLHRDLKPSNLLLNANCDLKIADFGLARTTSETDFMTEYVVTRWYRAPELLLNCSEYTAAIDIWSVGCILGEIITRQPLFLGKDYVHQLRLITEVLASMQAWHWPSFYNVVTGKTLALPNLIALQHIPLSPAGVIAKRPAPIALPNSCAA

SEQ ID NO: 117513 - protein, 132 aa, Glycine max
  Coding DNA Sequence Number=SeqID_25828
MEQRGHGMYYTSPTFSQYHSQMYQYPFEGHDTDMSASSHSYGGVAETHPHFSWPTMTPSRQHDAPMATPNAPLAPQWNVLICVTSFLLRLSNKGGDNGQEEILIVKPEGGIDHVAQAHAITDTIMTDFYVSI

SEQ ID NO: 117514 - protein, 104 aa, Glycine max
  Coding DNA Sequence Number=SeqID_25829
MITFYVKKNHLIKKNYVGLISSIALKSPTWAHPEDCSRGRSEVKKVQPLRHFVSLSEFLRKIVFREDKRPAVGDFRNAYSIVRNSRKFTVFDVLHRRSTLPAEG

SEQ ID NO: 117515 - protein, 181 aa, Glycine max
  Coding DNA Sequence Number=SeqID_25830
  Homolog annotation: Hit_ID=Q2HSV3; Match level="QueryCoverage=76%, HitCoverage=21%, E-value=2e-12, Identity=34%"; Hit description=IMP dehydrogenase/GMP reductase, putative
MKAHMKGITGAPYRARCDALTVTDVCWLPYSDHRGVRGFEPISSFQGQIRWGPTVVTVRPERVLCQFGYIQSIPPPPVSASLSYDDIDDRWMHFSDHVVVVGDLCVVPGQVFADYMEWFFQISHPFMIPTQAGDQPRHAPAPDHEDYMQPDIPQVLVAFDPPRHVVDCLRIARGCQRRWKC

SEQ ID NO: 117516 - protein, 370 aa, Glycine max
  Coding DNA Sequence Number=SeqID_25831
  Gene Ontology: Mol. function=helicase activity; Biological process =viral genome replication
  Homolog annotation: Hit_ID=Q8RV60; Match level="QueryCoverage=99%, HitCoverage=35%, E-value=4e-82, Identity=34%"; Hit description =Putative uncharacterized protein At2g05640
MVESEKLNYIRNNQKKLRVDKYCSLQNSLDDGTIQGLNKGKRVIWPSTFVGSPRYMDQLYFDGMAICNHDFPNLFITLTCNLNWPEIHRLLAPLNLKVADRPDIMSRVFKLKYEEMLSDLTKNHLLGKAVAYEIDQIISAEIPSNEDDPELYTLVQNHMVHGPCGIICFESPCMKEGKCNRFYPKMFQPRTLLDANGYPVYPRRNDGCTISKNGVIIDNRHIVPYNPKLPKKYQAHVNIEWCNQRTSIKYLFKYINKGYDRVTTIMVYDGNDKIQNATNQKDEIKEYIDCRSWHLRKKGYTIGRLIWVPPTIGELFYLRMMLTAYKGATSFKDIRTVTNIQYPIYRETCFVMGFLQDDREFVEAIKEAKD

SEQ ID NO: 117517 - protein, 90 aa, Glycine max
  Coding DNA Sequence Number=SeqID_25832
MGAKHLTRTKEKSHVIKQRSPDEIRQAKEAPPYHISRSFISVGLRCEGQIAAICDDDSPRRLDLVQPCPPGFRLGNWWVEERPDVYVTSI

SEQ ID NO: 117518 - protein, 192 aa, Glycine max
  Coding DNA Sequence Number=SeqID_25833
AQLIADAIYIFAGMAAYQALWIQISPNRALGFPALNTGLLPSRSEVPVAPTKVIRPPITRAFIEKYCTQRQAQGDAPQVVDAPPPHQAGQAGSFDTERYLRHLVRQQAANHRAHVQTHDCLYQLSLSMQSQGFTSFSCPTPDQFRAEVAWPGDWPEAQAGEAPPEAPGDGEEAHEDEEMANLLDFLGRSGAT

SEQ ID NO: 117519 - protein, 162 aa, Glycine max
  Coding DNA Sequence Number=SeqID_25834
MGNQEETQEQMKADMSALKEQMASMMEAMLGMRQLMEKNAATAAAVSSAAEADPTLLATAHHPPSNIVGRGRDTLGHDGSPHLGYNRAAYPYGLPPNYSPPVLQDDAGHIAYPVLEREPPQQPEEVHKDPQDYARRDVEFYPPIPKGRHPARCLNPTSRHNQ

SEQ ID NO: 117520 - protein, 186 aa, Glycine max
  Coding DNA Sequence Number=SeqID_25835
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MVSEVSSPSKKHIAAVGTTSNNMLSKRKTLDEGSLLSSKSETQHDHRFTSTPYVPMDPGIGPLYNSPPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 117521 - protein, 20 aa, Glycine max
  Coding DNA Sequence Number=SeqID_25836
MVTLGLQTREIRAGVLAQAS

SEQ ID NO: 117522 - protein, 113 aa, Glycine max
  Coding DNA Sequence Number=SeqID_25837
METKEIRIKDLPIMWLRMPPGSWVTTYVVLDNCETKNSLGVFFTKMRTCFSKETKLPTDQSNRCFLDEKQCVYRGRRCSDVEIASTVDPLVGNQRGEGQLGRGCLYMTLFLFT

SEQ ID NO: 117523 - protein, 92 aa, Glycine max
  Coding DNA Sequence Number=SeqID_25838
MALSASFPAKPSVATYPSAGGRRETRGMHVPQKEYARSRHQRLFEENVGKTGKDAIYELLSERFGSCIYARGRVFPFAPTYSSICDKEIRPT

SEQ ID NO: 117524 - protein, 139 aa, Glycine max
  Coding DNA Sequence Number=SeqID_25839
  Gene Ontology: Mol. function=RNA-directed DNA polymerase activity; Biological process=RNA-dependent DNA replication
  Homolog annotation: Hit_ID=A5B6M9; Match level="QueryCoverage=57%, HitCoverage=23%, E-value=5e-10, Identity=43%"; Hit description =Putative uncharacterized protein
  Pfam annotation: Domain name=zf-CCHC; Domain location=58-75; Score =29.3; E_value=1.4e-05; Accession=PF00098.14; Description=Zinc knuckle
MARFLNGLNRDIQDVVELQSYNNMDELIYRAVKHLERKSLRGNPTSPTQALPNKSSFIKCYKCLGKGHIASQCPKKRTMIVLEKPARLGELQLPQSDPLPIKIYGFYKDLHSGFPIVITLAIEHKRPINRISLKKWKVG

SEQ ID NO: 117525 - protein, 29 aa, Glycine max
  Coding DNA Sequence Number=SeqID_25840
MVFIKSSLRILEKMIEKGGKQWHKIVNPI

SEQ ID NO: 117526 - protein, 191 aa, Glycine max
  Coding DNA Sequence Number=SeqID_25841
  Homolog annotation: Hit_ID=Q6WAY4; Match level="QueryCoverage=84%, HitCoverage=29%, E-value=6e-17, Identity=33%"; Hit description =Putative uncharacterized protein
MGTNQIGKIFYQVKIKGLDVSSLKELGQLMGQLQRQAFRKAYGKIWDLAMVEVSTEAIASLAQYYDQLLRCFTFGDFQLSPMVEEFEEILGFPLGGRRPYLFSGFHPSLARISKIVQISAHELDYGKQVRNGVVGIPRKCLEEKARTLVGRGEWAPFIGILALLVFRGVLFPNVDGLVDLAVEAKLHGESK

SEQ ID NO: 117527 - protein, 109 aa, Glycine max
  Coding DNA Sequence Number=SeqID_25842
MPISPADAHKTPGGPKEVQQGPGVSSSGYGPLSVLQGARSPSEESHQQRHPVDPEKSNRALGFPALVTGLCSPTGCPFPPARSRHHRDRTCKTPSGPEDVQQGLGVVKL

SEQ ID NO: 117528 - protein, 90 aa, Glycine max
  Coding DNA Sequence Number=SeqID_25843
MPLRTLFLLPHQGSDTRDQRNKIKRTDRKYQGHTETAYKPRFLKTKKPKRRQSRTGSVEGEERRMKNRNLLNLERSAYKNLVSEHLSSET

SEQ ID NO: 117529 - protein, 134 aa, Glycine max
  Coding DNA Sequence Number=SeqID_25844
  Homolog annotation: Hit_ID=A6FJQ2; Match level="QueryCoverage=28%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFGISSLKGGNTVIHRIRDNAGRTCEQKASKRPGTVKGRVAGVFP

SEQ ID NO: 117530 - protein, 115 aa, Glycine max
  Coding DNA Sequence Number=SeqID_25845
DLCPRMSLIRKRGVLRHLVPPPTFPFPLTSAGWTADNELTSVASSSFSLGGVYLHGTAWLLWYGKGTVYHQGFGLRNTAPIRGLHAVATYPSTGGRRVTRGMRVPQKEYARSRHQ

SEQ ID NO: 117531 - protein, 67 aa, Glycine max
  Coding DNA Sequence Number=SeqID_25846
MMMTKDDDKGDDKKLKDQSKNNSKEFKTQEESLETRIKIQGSRSQESRSRFKTQDSRMKRRLNQDKY

SEQ ID NO: 117532 - protein, 124 aa, Glycine max
  Coding DNA Sequence Number=SeqID_25847
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARVVRAAASGISSLKG

SEQ ID NO: 117533 - protein, 44 aa, Glycine max
  Coding DNA Sequence Number=SeqID_25848
GQDHLELPSGVGTKHEQQKPVKVLRNGCKWGWSHDRLVIAPSPC

SEQ ID NO: 117534 - protein, 75 aa, Glycine max
  Coding DNA Sequence Number=SeqID_25849
  Homolog annotation: Hit_ID=B0HC01; Match level="QueryCoverage=46%, HitCoverage=74%, E-value=3e-12, Identity=100%"; Hit description =Putative uncharacterized protein
MRKRHASRREKGGQGGGAYGKTPATRPFYGSWPFAGLLLTCSFLRYPLILWITVLPPLSELIPLAAAERPSAASQ

SEQ ID NO: 117535 - protein, 34 aa, Glycine max
  Coding DNA Sequence Number=SeqID_25850
MPIVFLQIPKILTSFIDHKYESIVALEVQKGGSG

SEQ ID NO: 117536 - protein, 38 aa, Glycine max
  Coding DNA Sequence Number=SeqID_25851
GEYGELSEKSTRKKNVYVFLDFRVVIIKNGEIVEAKLH

SEQ ID NO: 117537 - protein, 51 aa, Glycine max
  Coding DNA Sequence Number=SeqID_25852
MTFFIMAEQAKQANGYTTQLSSSSSFDWCSITVAIYLEAHKKRHTAKIIGD

SEQ ID NO: 117538 - protein, 50 aa, Glycine max
  Coding DNA Sequence Number=SeqID_25853
MPMMKTMYGRLGSNSSSENYEHDIHDEFATINDLESWKRKATFQCKKQFS

SEQ ID NO: 117539 - protein, 99 aa, Glycine max
  Coding DNA Sequence Number=SeqID_25854
  Homolog annotation: Hit_ID=A4XQU5; Match level="QueryCoverage=69%, HitCoverage=20%, E-value=1e-11, Identity=43%"; Hit description =Putative uncharacterized protein precursor
  Subcellular localization annotation: CTP_CleavageSite=18; ConfidenceScore=5.14e-01
MTQRLATPTFSSSRKVVKLASVLSILFSPLANPAFADTVWLKNGDKITGTLGVKISNKLTVKTSYADEVKINWNDIHSIDAEKPILMQLSDGSIVNGRL

SEQ ID NO: 117540 - protein, 67 aa, Glycine max
  Coding DNA Sequence Number=SeqID_25855
MVFHLRLVVSFKTRKGKQGSKGLSKELIQGRITRPPITSQLLHSWAKDTKNKIGYKRRAQTKETISI

SEQ ID NO: 117541 - protein, 131 aa, Glycine max
  Coding DNA Sequence Number=SeqID_25856
MTGLASEGEKNDFVCETERAGGKRFWVLIYITTFGSIVGMIRLFFNPSMFHELLCAVMVSVFTLLHGFKGSYIKSVLTELINLVSQKSQLLKPYISDMVLDVLPIAESGQLECFVDFGSYMSIGLVSPNIS

SEQ ID NO: 117542 - protein, 281 aa, Glycine max
  Coding DNA Sequence Number=SeqID_25857
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=23%, HitCoverage=65%, E-value=9e-33, Identity=100%"; Hit description=LacZ protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTRSITRSNPKSIIPMKDRRRRNAVVSWSALFWCTLLLVFSTIIFTTLIFSPFITTFSHPFKWIKTTTTNSRATITIRGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 117543 - protein, 171 aa, Glycine max
  Coding DNA Sequence Number=SeqID_25858
MDIRVKVSSFELIRAPFQLGASRYITGLNQTSELKVIAVFICYEHPFSISSVSIYYGTQSEIRVKGYCGLLLIRASVFNLERLDILQDSVGHPSKNLLTQSDIQVKSYCGLHLIRASVFKFERPDILRDTIGHPNKKLLSFEFAQYFCFQFGASRYITGLNRTSMLKFNVV

SEQ ID NO: 117544 - protein, 148 aa, Glycine max
  Coding DNA Sequence Number=SeqID_25859
MHKALWANAPLPYPHLVTLFLHHFNIPLDDKPFVKVKRSFSIGAGAVISFGYRKDIDGQWVRKHDLPPPIPDERTPSPPPQRDDSTSLLTKVLTELCGLRAFVGEHFNAMDTRLDAMDTRFDGMDMRITRLEDDMSFIRRCFDPPADS

SEQ ID NO: 117545 - protein, 74 aa, Glycine max
  Coding DNA Sequence Number=SeqID_25860
MEKSDKRNFKEKKEKKAYNTWEDNVEAKLHGESKVIQRCFDDNKGDDKKLKDQSRTFQEFKIRIKKNSRLKKKV

SEQ ID NO: 117546 - protein, 226 aa, Glycine max
  Coding DNA Sequence Number=SeqID_25861
IGEIQRLTEKNSHPWILRANPTEYVHRWAETTNQAITRCLCWGKNKAENPEEATELIENMSASDHAILRDRTHQPTKKSLLELTSHDALLAQNKSQVVPFVVKLMRQVNAFPLTLKKFISWGISRGKGTLKEGFQASSKVLIISKDNGGHTLTTSSIKTKVTMSNHKSTEPALENLEVQMGQLAKQMADKSSNSFGANTENNPKEECKAVMTRSKRFVEDEDEENV

SEQ ID NO: 117547 - protein, 211 aa, Glycine max
  Coding DNA Sequence Number=SeqID_25862
METCLAVEDLLQQMIDEGRLEVGDERREEQHICMQSTDEKSFGRPKPLVVFFTRDAAPQTPRYPSVVKPVPFPYQNNHAVPWRFAPPSERKEEATDISSLLAKVTNITGLSGVTRSGCVFAPPDLPTQPANLKGKAKMVEEQNDKTTLTLNEDILVKGLLEKRDGCGKKEVSLEEASFGGLVNNIIANNYLAFAEEEIPVEGRRYNRALHV

SEQ ID NO: 117548 - protein, 130 aa, Glycine max
  Coding DNA Sequence Number=SeqID_25863
YTMNSVITVLYFNGRVYEDNDGVIFEGSKKAIQIKRGISFNALKKKIGDKTYQCHGPRKDTDTSAKDTEQMLVACNTFHDHAAPYVGKNLPLEQSPFVCQNLEFQHLTEACETLVGEIDALMLDHVPQAQ

SEQ ID NO: 117549 - protein, 150 aa, Glycine max
  Coding DNA Sequence Number=SeqID_25864
ATLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMGIL

SEQ ID NO: 117550 - protein, 205 aa, Glycine max
  Coding DNA Sequence Number=SeqID_25865
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNAGIFIVLSGFATSDLSVDFCDARQGGGAYGKTPATRPFYGSWPFAGLLLTCSFLRYPLILWITVLPPLSELIPLAAAERPSAASQFPDWKAGSERNAINVRNSYDHDYEFELGTLDYLLLRGMQAWHWPSFYNVVTGKTLALPNLIALQHIPLSPAGVIAKRPAPIALPNSCAA

SEQ ID NO: 117551 - protein, 63 aa, Glycine max
  Coding DNA Sequence Number=SeqID_25866
  Subcellular localization annotation: CTP_CleavageSite=25; ConfidenceScore=5.49e-01
MAFFQSSLGYKGQNAKVKKAFGNGRVTHTPEGVTPPPPPLSLSFFSSIETSSLSFLSKALSWW

SEQ ID NO: 117552 - protein, 149 aa, Glycine max
  Coding DNA Sequence Number=SeqID_25867
  Subcellular localization annotation: CTP_CleavageSite=30; ConfidenceScore=5.15e-01
TLGKLPSKLPIGQPTHSSVCRLHVVPFVVRLMKQANVFLVKNTLKKFTIWEINRGKDILKEDFQASSRVLITNKDNGDHTLAISSSKTRRTTKLEETLTQFMQNPKEECKAVMTRSKRFVEAEDEDRVIMPKKKAAEKKGTDDKKDDVR

SEQ ID NO: 117553 - protein, 96 aa, Glycine max
  Coding DNA Sequence Number=SeqID_25868
  Subcellular localization annotation: CTP_CleavageSite=56; ConfidenceScore=5.43e-01
MHTRSFTIPHFPKIGLTHKNSRQLSQPTLWRASEARFAGASSKGGKCAESPPTLICGKRRKNRTKLVMKNIPDSGVVFTFEEGISTSNVCPKGQQP

SEQ ID NO: 117554 - protein, 98 aa, Glycine max
  Coding DNA Sequence Number=SeqID_25869
  Homolog annotation: Hit_ID=A5C7C5; Match level="QueryCoverage=72%, HitCoverage=10%, E-value=3e-08, Identity=35%"; Hit description =Putative uncharacterized protein
  Pfam annotation: Domain name=zf-CCHC; Domain location=23-40; Score =30.4; E_value=6.8e-06; Accession=PF00098.14; Description=Zinc knuckle
MRGSQRRQNFKPKRRTEESSQIPKCFECNQPGHMRADCPIFKRKIEKSEKKTIGDKKAYITWDDNDLGSSDDSEKEMVNLCLMGKNYESDKEQICRRN

SEQ ID NO: 117555 - protein, 97 aa, Glycine max
  Coding DNA Sequence Number=SeqID_25870
MKADMEAIKEKMATMMEAMMSVKKIMEANAVAIAATSVVAKVNLMSPSGINQNESSNLIYEVCPSHVIPMREILASELAIKEALKIIGLCNQKMLVP

SEQ ID NO: 117556 - protein, 142 aa, Glycine max
  Coding DNA Sequence Number=SeqID_25871
MEEGFSKGLVPIILGRPFMKTARTKIDVYAGTLSMEFADITVHFSILDAMKHPLMQSHPPRALDRRLQEDWAKDAREGPRVLMSLRGTETSFCIRGSVATCPSRATEGEAYGCAFQRRKDARSRHQCLFVENVGKTEGNRSK

SEQ ID NO: 117557 - protein, 122 aa, Glycine max
  Coding DNA Sequence Number=SeqID_25872
TESLREAVNGIIGGYHKWLRVRTQGLDWLPNLKTVRDDEVKASEESDEVQALKAELERAQVVEENFKSIAIKSSSSRRGLKGNPGMPTGQKEAISFLWVLSLHELRVAKVVKKSQHKQLARP

SEQ ID NO: 117558 - protein, 100 aa, Glycine max
  Coding DNA Sequence Number=SeqID_25873
MSLATLFGKLQQHEMELMRLHHHEENDIKRKGITLRTSSSFIQEESDKEDLTETEEDDDDFRLFVKRFNKFLRNKRNKRKSNMNTKKKEEDSSLAPSCYE

SEQ ID NO: 117559 - protein, 220 aa, Glycine max
  Coding DNA Sequence Number=SeqID_25874
  Subcellular localization annotation: CTP_CleavageSite=54; ConfidenceScore=5.47e-01
MNRVCMKGSVKRFGFSVGSRSPAPPHSPLVGRVVNLEGARLLFRRVFDNLAVVRSPLLEAGVLGRWGFLFLNQFGCVSPEIGWSNIYELAGQRWMEVPCCSPLPEAKDGVEPSFQDLQSDTFPLCYPAKPATSCAKVKRLFFLPRSLFFYICGRSTLYDRRRVTREEGTTSFSLALLHFPFLIESRKPLHYWYRGQKVASSICSGKEHLEASFCLVSNHA

SEQ ID NO: 117560 - protein, 166 aa, Glycine max
  Coding DNA Sequence Number=SeqID_25875
MDRGMTLTDAPRSSMALSNLLFPIMQGGNGRRDRRLYHLPHLICQTLNGGYYLLLKLHIMHGHFASLTLLREVEEEPKLLVVFVVTAAIAVAVLEEEHMACLDQQHFEKEGQTVVVVEDLSISDLDDSSNLDCIYCLKGHNYSAVVGFATEEVYYKCLQHKLQVAH

SEQ ID NO: 117561 - protein, 19 aa, Glycine max
  Coding DNA Sequence Number=SeqID_25876
MAVEVLFSVLYMLSLLFIF

SEQ ID NO: 117562 - protein, 273 aa, Glycine max
  Coding DNA Sequence Number=SeqID_25877
  Homolog annotation: Hit_ID=Q9AVH2; Match level="QueryCoverage=30%, HitCoverage=41%, E-value=4e-39, Identity=70%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRGGTNQSDRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 117563 - protein, 113 aa, Glycine max
  Coding DNA Sequence Number=SeqID_25878
MNCIFMGSRGSYWMSNSESSMEQATIFLTSSGFLKNLLDGVVRLDYHLMTREVRLESLGQGNEWAELITSSITERYKSKGALGLDRLKDGSVVMVFLKARKACSQVSFPLKKA

SEQ ID NO: 117564 - protein, 116 aa, Glycine max
  Coding DNA Sequence Number=SeqID_25879
  Gene Ontology: Mol. function=4 iron, 4 sulfur cluster binding; Cellular component=nitrate reductase complex; Biological process =nitrate metabolic process
  Homolog annotation: Hit_ID=A0JRP5; Match level="QueryCoverage=80%, HitCoverage=7%, E-value=8e-37, Identity=70%"; Hit description =Respiratory nitrate reductase alpha subunit apoprotein
MTPTTHDIHPATDGPLADTLLGMGKFLRRGEVSADLRSLFLDGGRSGDVFYRDRWAHDKVVRSTHGVNCTGSCSWKVYVKDGIITWEAQQTDYPSVGPDSPRVRTARLSARCRLQL

SEQ ID NO: 117565 - protein, 90 aa, Glycine max
  Coding DNA Sequence Number=SeqID_25880
  Homolog annotation: Hit_ID=Q84VH5; Match level="QueryCoverage=58%, HitCoverage=7%, E-value=4e-20, Identity=96%"; Hit description =Envelope-like protein
KAAASGAVSKDALIAELKDTCKVLEATIKATTEKKMELERLIERLTDSGIDDGEAAEEEEAAEEEEEVSVEEEDAAEDTESDDDDSEATP

SEQ ID NO: 117566 - protein, 101 aa, Glycine max
  Coding DNA Sequence Number=SeqID_25881
MSDKRAETNYGHSAPFVIQEQQVDESRGGQRQIMVIPHTFSPSRGDRVRWHAETNYGHSTPCHLGSIIPEGTQRQIMVILRLVSTKRNELGSIRMMLVVRC

SEQ ID NO: 117567 - protein, 138 aa, Glycine max
  Coding DNA Sequence Number=SeqID_25882
MDDYKSLQIEFEKLKKAHNKERTKLKIEFSYLKDLFRKINKVKSDLSHLLNVKRHSTEKTSLGYNKQTTFSKKTKFASSKKVNPNKVFKKKNIVQSKPKAKACHYCMKRGQTSYKCYVRRFDVPRGVPKSKRLTIVLG

SEQ ID NO: 117568 - protein, 90 aa, Glycine max
  Coding DNA Sequence Number=SeqID_25883
MKHNSKLENGGHIVATYPSAGGRRVTRGMRVPRKEYARSRHQRLFEENVRKTGKDAIYELLSERFGSCIYARGSNNIHVAPKMGENGGLP

SEQ ID NO: 117569 - protein, 146 aa, Glycine max
  Coding DNA Sequence Number=SeqID_25884
  Homolog annotation: Hit_ID=A5AWV0; Match level="QueryCoverage=65%, HitCoverage=6%, E-value=4e-08, Identity=32%"; Hit description =Putative uncharacterized protein
HPIETSMRAGNSYVYGFLESQSIQRSRQSQFDSESYIKSWMQSSKRDVYLGAYLNGEHWQMVVILPKENLVVWFCSLHNRPDNYLKGIINSTLKELDDTPQPKSKAAARWIVVKCNRQKGSTKYGYYIMHWMSTIILGSLRNNWEA

SEQ ID NO: 117570 - protein, 165 aa, Glycine max
  Coding DNA Sequence Number=SeqID_25885
KLKGNGRISMGRNVLALIGKFVPHIPKKCKDPGTFYIPCIIGNNKFENAMLDLGASANGSVAYPTGFIEDVLVRIIDQIVDDYMFDFDSLHGRKHPFLSDLHTCHSLCIESESEFEFDPISDFYAESKFEFESGSDFLGVVPLDAEKPSSSSPTLVPPTVQPPPT

SEQ ID NO: 117571 - protein, 235 aa, Glycine max
  Coding DNA Sequence Number=SeqID_25886
  Subcellular localization annotation: CTP_CleavageSite=45; ConfidenceScore=5.25e-01
MNTLPRTVHASSTNESAGLRIDCLALLPKSPLSTFIRRPMNSLPSAVHVSSTFESGAPRIDYLALFANSPFSTFIRSPMNSLPSAVHASSTNESGGSRIDCLALFASSPFSTFILSPMNSLPSAVHASSTIEFGGLRIDCLALFPSSPFSTFIRSPMNSLPSAVHVSSTFESGAPQIDCLALFANSPFSTFIRSPMNSLPSAVHASSTNESGGSRIDCLALFAHSPFSTFYFGAP

SEQ ID NO: 117572 - protein, 283 aa, Glycine max
  Coding DNA Sequence Number=SeqID_25887
  Gene Ontology: Mol. function=long-chain-fatty-acid-CoA ligase activity; Cellular component=membrane; Biological process=fatty acid metabolic process
  Homolog annotation: Hit_ID=A8GFH1; Match level="QueryCoverage=99%, HitCoverage=49%, E-value=1e-103, Identity=67%"; Hit description=AMP -dependent synthetase and ligase
  Pfam annotation: Domain name=AMP-binding; Domain location=1-243; Score=101.2; E_value=3.2e-27; Accession=PF00501.19; Description=AMP -binding enzyme
GKLLRAGQEQVVTALPLYHIFALTVNCLLFLDLGGTNLLITNPRDIPGFVKELSKFPFTAITGVNTLFNALLNDANFNQLDFSTLRLSAGGGMAVQKAVAERWEKLTGHYLLEGYGLTECSPLVSVNPYDITCHTGSIGLPVPSTDVRIVDDEDRDVPPGEPGELCIRGPQVMIGYWQRPDASEEVLKNGWLHTGDIVTVDAEGFIRIVDRKKDMILVSGFNVYPNEIEDVLMQHAKVREAAAIGVPSDLSGEAVKVCIVKKDPSLTKEKCWIIVARQLTGYK

SEQ ID NO: 117573 - protein, 235 aa, Glycine max
  Coding DNA Sequence Number=SeqID_25888
  Homolog annotation: Hit_ID=Q6L477; Match level="QueryCoverage=48%, HitCoverage=20%, E-value=6e-08, Identity=27%"; Hit description =Putative uncharacterized protein OSJNBa0009L15.8
  Subcellular localization annotation: CTP_CleavageSite=27; ConfidenceScore=5.34e-01
MGSPPASTTPPPSPPSPPPPPPTSDASASMSARPVVHVDPATGKADGPHKKKLKHIWGIVARDKVDITYENWKEAEFDIPEASDSRTKRKLLQTVGERWRQFKSDLTRKWALAADQDGVEDTVCDKYGISKEKWAQFCQTRRDPSWEDVRMKAQAIQKHNTAPHVLSRGGYDYLEQKLLAEKTKKKMQEATQSGSVDGVIDPPSPVRRHVKWKMACTKKTGEMTTEAAKEIAEKI

SEQ ID NO: 117574 - protein, 84 aa, Glycine max
  Coding DNA Sequence Number=SeqID_25889
  Subcellular localization annotation: CTP_CleavageSite=54; ConfidenceScore=5.49e-01
MSSPSKGYMPPPSEDYMSLPSEDYTSSPSKDYTSSTSRVAGNRRTATTSRVHLSSSTKSRTHLVAHDPRNLNKTSTSSEGSKIP

SEQ ID NO: 117575 - protein, 106 aa, Glycine max
  Coding DNA Sequence Number=SeqID_25890
KDQGQGILGVTPSKPKDDNGKTIEKQPLKASMQEKTSSINSQDEATTSPSSSESDEAKEKESSEEIYPQGEGQPLMVKEECEETLVSIATPLGLEVIPEVKELLDE

SEQ ID NO: 117576 - protein, 168 aa, Glycine max
  Coding DNA Sequence Number=SeqID_25891
  Homolog annotation: Hit_ID=Q6WAY6; Match level="QueryCoverage=96%, HitCoverage=27%, E-value=3e-08, Identity=27%"; Hit description =Putative uncharacterized protein
MGTRGCIIYNPVLAIRQLGYPMRGAPLEEELTPIIARGFNNTNVEALQKVRKAWEMVQKKDKELIGSNNGPIGGYRRWLKAHMQGLDWLPSLRTTKGVEVEAPEEDEEVQAHRVELEKAQTVKEKFKSAALKIRKENAKLRDVNIATTKALEQETKRVRREEHGWNKF

SEQ ID NO: 117577 - protein, 165 aa, Glycine max
  Coding DNA Sequence Number=SeqID_25892
MKAKSEDFEFYEWIIDGEALFKSAFDHGPFKCFMIDCLFLKDVITHETSSYLFANLFRDSLKVYGPLFDGCHTLISSGDHCLMACNLCLTASRYLTPIIRQSVKFCNKPEVERKHCCAIRKVLQHPGSQKGIIAQSVSFEAGLLIEEATQLAWASWVATSSPLFL

SEQ ID NO: 117578 - protein, 201 aa, Glycine max
  Coding DNA Sequence Number=SeqID_25893
MCAVKKVIWTFRLPVTKDKTNIQRVCDDMMLMRKKHNMGMYPVWQYLQVVISLLMVSRGIIPFDKHIAAVGTTSNNMLSKRKTLDEGSVLSSKSKTRHEHRFTSTPYVPLDPASKSYIQDRKRNKRKSTKEEVMILHEIRRPNSLKTVPSGVANCRNLPFGGRATRGLTGASSMGGKCAESPPTFIRGKCQKNRKGVVYEL

SEQ ID NO: 117579 - protein, 96 aa, Glycine max
  Coding DNA Sequence Number=SeqID_25894
MWKRIRRVELVLWMRWWLRSDELLKPKRRWMNPYISIGEIKRKMKKKKIASYGSRFDEEMSKIGRFGGLGMEERRKGEEAAQGFLKNVIFIDQDAL

SEQ ID NO: 117580 - protein, 175 aa, Glycine max
  Coding DNA Sequence Number=SeqID_25895
  Homolog annotation: Hit_ID=Q6WAY4; Match level="QueryCoverage=88%, HitCoverage=28%, E-value=4e-18, Identity=35%"; Hit description =Putative uncharacterized protein
MGTNQNGKRFYQVKVKGLDVTSLKELGRLMGPLQRQAFRKVYGKILDLTAAEVFTEAVVSLAQYYNQPLRCFTFGDFQMVPTVEEFEEILGCPLGGRKPYLFSRFLPSLSKVAVVVGDSAKELDRMKQTRNDVVGLPRKYLEGKARDMVSQEKWGPFADTLALLIFGVVLFPNVD

SEQ ID NO: 117581 - protein, 138 aa, Glycine max
  Coding DNA Sequence Number=SeqID_25896
MAPTRHPLDPDKSNRALGFPSLITGLYQSFGVPVAPTKVIWPPITRAFIENIYGIWFASRRPTTGAHVQTHDCLYPYEPSACRARASLLFHALLQTISRAEVAWARGFGPRPKQERHPRKFPVKERSPRRTRRWADFA

SEQ ID NO: 117582 - protein, 94 aa, Glycine max
  Coding DNA Sequence Number=SeqID_25897
MVTLKWSNFHPSGWGGYALKQKLKFIKACIRQWSSSNGVINAKKIQVLKKELNALEAGISDRILNQFEVELKKSLQEQLWHAANAYESTFPWSK

SEQ ID NO: 117583 - protein, 214 aa, Glycine max
  Coding DNA Sequence Number=SeqID_25898
  Gene Ontology: Mol. function=DNA-directed RNA polymerase activity; Cellular component=alpha DNA polymerase:primase complex; Biological process=DNA replication, synthesis of RNA primer
  Homolog annotation: Hit_ID=A4THS9; Match level="QueryCoverage=100%, HitCoverage=36%, E-value=3e-99, Identity=78%"; Hit description=DNA primase
  Pfam annotation: Domain name=Toprim_N; Domain location=126-214; Score= 111.7; E_value=2.2e-30; Accession=PF08275.2; Description=DNA primase catalytic core, N-termina
  Pfam annotation: Domain name=zf-CHC2; Domain location=5-102; Score =222.9; E_value=7.2e-64; Accession=PF01807.11; Description=CHC2 zinc finger
  Pfam module annotation: Pfam domain module=Toprim_N::zf-CHC2; Domain location=126-214::5-102
MAGRIPRVFINDLLARTDIVDLIDARVKLKKQGKNYHACCPFHNEKTPSFTVSGEKQFYYCFGCGAKGNAIDFLMNHDRLDFVESVEELATQHGLEVPYEAGNGPSPMERHQRQSLYQLLEGLDSFYQQSLRNPQAKSAQQYLATRGLSQQVIDHFAIGYAPAGWDNVLKRFGQQKEDRESLMEAGMLVSNDSGRTYDRFRDRVMFPIRDKRGR

SEQ ID NO: 117584 - protein, 167 aa, Glycine max
  Coding DNA Sequence Number=SeqID_25899
  Homolog annotation: Hit_ID=A5C5V8; Match level="QueryCoverage=99%, HitCoverage=24%, E-value=1e-09, Identity=26%"; Hit description =Putative uncharacterized protein
LQETPPNVVKELKEYMATKKSGTTYSTSGSGNMENIRDFEFGEPIGFDGSEEDEFADSCNVTASAKTKCGTKKGPMDKFCKNSENAINRRKMEMLRQMNIRESMDKNEVLKVHQHIARFWYQAAIGQYGPYLPIPSYHDIRVPLLKKEVEYTENLMKGHREQWVKYG

SEQ ID NO: 117585 - protein, 30 aa, Glycine max
  Coding DNA Sequence Number=SeqID_25900
MGKSLKVGENEGRERERGEQNFEGEKMENE

SEQ ID NO: 117586 - protein, 230 aa, Glycine max
  Coding DNA Sequence Number=SeqID_25901
  Homolog annotation: Hit_ID=A7MGR0; Match level="QueryCoverage=61%, HitCoverage=48%, E-value=3e-39, Identity=59%"; Hit description =Putative uncharacterized protein
MLHQLPGAFALTTGHAQLKLPDVAHQGGNPFRNGERAAAFVQHVIGGQRERIVIGEPALLGNTLCRFQQRIPEHRGKEERRVHAHVVANAGIGIFQHLRNHPLHWAVTVFGKVAGNGREQRLEQVVFAQKFVGFKTVAGLQQLQRLFKQASRRHVVNQRRQTRDWLCRFRADAHIQLGGETHGAQHTHGIFTVARFRRADQADQTFFQVLHAADVIAHGEIRHAVIKAVD

SEQ ID NO: 117587 - protein, 89 aa, Glycine max
  Coding DNA Sequence Number=SeqID_25902
MKFQLGQRIKGQMTILLGSPLPHSLSDSSPQDILLAYSPTIDIQSIPYEWILVTKELVLGHLKRQNNKQKQAKGSKPGFRKDSLHYEYS

SEQ ID NO: 117588 - protein, 20 aa, Glycine max
  Coding DNA Sequence Number=SeqID_25903
MAQSVFALCPYLGTYRIVSR

SEQ ID NO: 117589 - protein, 79 aa, Glycine max
  Coding DNA Sequence Number=SeqID_25904
  Homolog annotation: Hit_ID=A5BIE2; Match level="QueryCoverage=83%, HitCoverage=19%, E-value=5e-10, Identity=42%"; Hit description =Putative uncharacterized protein
MDSSSDSENEIINLSLIDKDYESEEEDSLKQNWYIDSGCSKHMMGDASKFTHISPKNSGHVTYGNKKKKIKPQIMLNAF

SEQ ID NO: 117590 - protein, 172 aa, Glycine max
  Coding DNA Sequence Number=SeqID_25905
  Subcellular localization annotation: CTP_CleavageSite=34; ConfidenceScore=5.25e-01
MASFSHMQPQLQSQMQSQGLAVSPEPLVGPSGPRVSTKGSCVDPSGNDPETGDSDKCGLYIEADPARLDVRIKAHAIQKQNTAPHVLSRGGYDYLEQKLLAEKTKKKMQEVAQSGSVDGVIDPPSPVRRHVKWKMAHTKKTGEMTTEAAKEIAEKIDSFESRSHRDRSSPHG

SEQ ID NO: 117591 - protein, 294 aa, Glycine max
  Coding DNA Sequence Number=SeqID_25906
  Gene Ontology: Mol. function=two-component sensor activity; Cellular component=integral to membrane; Biological process=two-component signal transduction system (phosphorelay)
  Homolog annotation: Hit_ID=Q1VYF9; Match level="QueryCoverage=49%, HitCoverage=44%, E-value=7e-34, Identity=45%"; Hit description =Putative two-component system sensor histidine kinase
  Pfam annotation: Domain name=His_kinase; Domain location=10-91; Score= 109.4; E_value=1.1e-29; Accession=PF06580.4; Description=Histidine kinase
  Pfam annotation: Domain name=Response_reg; Domain location=156-265; Score=69.5; E_value=1.1e-17; Accession=PF00072.15; Description =Response regulator receiver domain
  Pfam module annotation: Pfam domain module=His_kinase::Response_reg; Domain location=10-91::156-265
MLKSEKLDQELTMLKAQINPHFLFNTLNNIYGMALKKADETPDVILQLSKIMRYNIYEAAERHISIAKDIENIKDFIEIQKIRHRRLFVNFKEDIDNPSQEISPLILIQFIENAFKHGVSESLGNSFIHIDIRLKNGILHYSVENSKEQIAASKKYNCIIVEDEPIAAEILENFVIRNEELNLVGKCADAVHASSLLNIHDVDLMFLDLNLPVIKGFDFLKKLKNPPFVIVTTAYHQYAVEGYELDVVDYLMKPIPYDRFLTAISKFRHIMESEEALLEIADRDYIFINSGKKQ

SEQ ID NO: 117592 - protein, 47 aa, Glycine max
  Coding DNA Sequence Number=SeqID_25907
MDSSSFFQILPRAQPRRVALSRWLAKPTDWLSEKVYATKVTDCMRRE

SEQ ID NO: 117593 - protein, 70 aa, Glycine max
  Coding DNA Sequence Number=SeqID_25908
SNELKIRRADRDESRMESMALEDKLKACQRLKRSLVEQLSKIEENMLIIIDQYKEKVNLAASHGQMLEDE

SEQ ID NO: 117594 - protein, 56 aa, Glycine max
  Coding DNA Sequence Number=SeqID_25909
MGHLSDQGVPADPKRIKVIPKWPTPPSIREIWGFHDTNFYKRVLREEALSFKNLWI

SEQ ID NO: 117595 - protein, 142 aa, Glycine max
  Coding DNA Sequence Number=SeqID_25910
MAAQLIPDRVEMEFLEGAWETLEGNTRCRFRGTIRFTATSLVHPDEPARTLQRTVEWILPTPTPYRLVEPVQVIEVTSSEEDPEEDLEELPPEPTVDALDFLEGDEDPLPEVDLPRKSCRHLKDSTEDSGPREMATSGGSSS

SEQ ID NO: 117596 - protein, 80 aa, Glycine max
  Coding DNA Sequence Number=SeqID_25911
  Subcellular localization annotation: CTP_CleavageSite=14; ConfidenceScore=5.41e-01
MPSIPKRSIKGCISSSNNPRTKLGYDNVFSGFPTFPQINVGGDSARILSWNTHPASLASPSRRRVGCDSWRLRWGLFLES

SEQ ID NO: 117597 - protein, 47 aa, Glycine max
  Coding DNA Sequence Number=SeqID_25912
MCNSKSLTAPFWLVRLHDDGGRATEEAVAAAATRAFLAIVDPVVIAI

SEQ ID NO: 117598 - protein, 109 aa, Glycine max
  Coding DNA Sequence Number=SeqID_25913
MGRPWCPGFLCGGDIGYIISINLGISSTNISFISLCIWSGASGASPSPPTREVWTPGQATRSKKALRVMTGYYWDRVEEKENDDGLVGGGAIGGASVGALALALRVPEK

SEQ ID NO: 117599 - protein, 36 aa, Glycine max
  Coding DNA Sequence Number=SeqID_25914
MEGSSYLRVNDNEKNLIEMVVIRGNGVVTVEVLQIQ

SEQ ID NO: 117600 - protein, 238 aa, Glycine max
  Coding DNA Sequence Number=SeqID_25915
RGKIKLKTPEEATELIKNMSANDHAILRDRVDQSIKKSLLELSSHDALLAQNNLLSKQLEILTETLGCRLQVVPSMVRLMKQANVFPVKNTLKKFTIWEINRDKDILKEDFQASSRVLITNKDSGDHTLAINSTKTRRTTKLEETLTQFMEVTMSNHKSTQSALKNLEVQVGQLAKQIADKSSNSFVVNTEKDPKEECKVVMRRSNKFVEVEDKDSVVVPKKKAVEKKGTDDKKDDVR

SEQ ID NO: 117601 - protein, 132 aa, Glycine max
  Coding DNA Sequence Number=SeqID_25916
MEYPEGVWETLEGNERCRFCGTIRLTATSLVHPKEPARILQQPVEWILPTPTPYRLVEPVQVIEVSSSEEDLEEDLEELPPEPVVDSLDFLEDDEDPLFDVDSPKDVVPASEADSTEESGPGGTANSDDSSS

SEQ ID NO: 117602 - protein, 151 aa, Glycine max
  Coding DNA Sequence Number=SeqID_25917
  Gene Ontology: Mol. function=adenyl-nucleotide exchange factor activity; Cellular component=cytoplasm; Biological process=response to stress
  Homolog annotation: Hit_ID=A2U2E2; Match level="QueryCoverage=99%, HitCoverage=77%, E-value=6e-37, Identity=49%"; Hit description=GrpE protein
  Pfam annotation: Domain name=GrpE; Domain location=12-148; Score =65.3; E_value=2e-16; Accession=PF01025.10; Description=GrpE
MENQDINEENINKQQEDNIQNENASEQNVTNTPTAEELLAEEKDRYIRLYAEFENYKKRTSKEKMEFFQYANQDMMVSMLGVLDDFERALKEIAKNGNPADLQGVELIYQKFKNKLTEKGLKSMEVKAGDSFNVDLHEAITQIPAPSDDLK

SEQ ID NO: 117603 - protein, 64 aa, Glycine max
  Coding DNA Sequence Number=SeqID_25918
MILKFHDDPTVNGFEIVIFMRLLQPYGINIGLKEHSNWVTPKAYTTKSPSGPLPPDSGPTQKTF

SEQ ID NO: 117604 - protein, 745 aa, Glycine max
  Coding DNA Sequence Number=SeqID_25919
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=Q1ZVV1; Match level="QueryCoverage=62%, HitCoverage=97%, E-value=1e-168, Identity=64%"; Hit description=PTS system, sucrose-specific IIBC component
  Pfam annotation: Domain name=PTS_EIIB; Domain location=271-299; Score= 36.6; E_value=9.2e-08; Accession=PF00367.11; Description =phosphotransferase system, EIIB
  Pfam annotation: Domain name=PTS_EIIC; Domain location=377-662; Score= 152.0; E_value=1.6e-42; Accession=PF02378.9; Description =Phosphotransferase system, EIIC
  Pfam annotation: Domain name=SIS; Domain location=83-213; Score=7.0; E_value=0.012; Accession=PF01380.13; Description=SIS domain
  Pfam module annotation: Pfam domain module=PTS_EIIB::PTS_EIIC::SIS; Domain location=271-299::377-662::83-213
MNIDLSQMITEGRNPASQNIDELNTEAMLRVINDEDKKVALTVEAIVPQIAEVVDAITAAFSQGGRLIYCGAGTSGRLGILDASECPPTFGTPRSQVVGLIAGGHTAILQAVENAEDNREQGAQDLKDIDFSARDVLVGIAASGRTPYVLGALAWAKQQGAFTAALTCNPNSAMSQAADVALTPVVGPEVVTGSSRMKAGTAQKLVLNMLTTGAMIRSGKVYGNLMVDVEATNQKLVQRQINIVKQATECDDARAQQALAACGGHCKTAIAVGGAGNVVHCGNCMTRLRLTLADAARVDSARLKTLPGVLGVIDSDAQLQIVLGPGKAQTAAEKMQAMLNSATPEAPGDLHSIASAQKQQMKAKQTSALHRFLSCFATIFTPLIPGFIGAGLLLGFATLIEQVCHLNQPGEHARWLLDTVAYMKVFGKGLFTFLSILIGYNAQKAFGGTGVNGAIIASLFVLGYVPNATVGYYSGMQDFFGLTIDPRGNIIGVLLAAIFGAWLEKQLRKIIPDNLDMILTSLLTLVITGAVTFLVIMPIGGELFKGMSWLFIHLNNNPFGCAILAGLFLIAVMFGIHQGFIPVYFALMETQGFNSLFPILAMAGAGQVGASLALWFKADKHSLLRSQIKGAIVPGLLGVGEPLIYGVTLPRLKPFITACFGGALGGFFIGLVAWLGLPVGMNTVFGPSGLVTLPLMTSSQGIFAGMAVYLVGLIVAWIGGFVFTWWGGTENVDLSSKSLRQQTVK

SEQ ID NO: 117605 - protein, 151 aa, Glycine max
  Coding DNA Sequence Number=SeqID_25920
MYNTTMTYISLHGNAHWQMVVILLKENLVVWFCSLHNRLDNYLKGIINMPVLFSNTFALTLVSNINILMFLVFNSALKGLDDTSQPKFKAGARWIVVKCNRQKGSTKCGYYVIHWMSTIILGSFRNNWETAIGSREIEGASHPVDTVLSQS

SEQ ID NO: 117606 - protein, 213 aa, Glycine max
  Coding DNA Sequence Number=SeqID_25921
  Gene Ontology: Mol. function=hydrolase activity, hydrolyzing O -glycosyl compounds; Cellular component=cytoplasm; Biological process= carbohydrate metabolic process
  Homolog annotation: Hit_ID=Q46829; Match level="QueryCoverage=100%, HitCoverage=44%, E-value=1e-108, Identity=85%"; Hit description=6 -phospho-beta-glucosidase bglA
  Pfam annotation: Domain name=Glyco_hydro_1; Domain location=1-213; Score=-232.8; E_value=5.3e-07; Accession=PF00232.9; Description =Glycosyl hydrolase family 1
MPLHLVQEYGSWTNRKVVDFFVRFAEVVFERYKNKVKYWMTFNEINNQRNWRAPLFGYCCSGVVYTDHDNPEETMYQVLHHQFVASALAVKAARRINPEMKVGCMLAMVALYPFSCKPEDVMFAQESMRERYVFTDVQLRGYYPSYVLNEWERRGFSIRMEPGDEQILREGTCDYLGFSYYMTNAVKAEGGTGDAISGFEGSVPNPHVKASDW

SEQ ID NO: 117607 - protein, 57 aa, Glycine max
  Coding DNA Sequence Number=SeqID_25922
MAWRLAEARAGEAPTEAPDEADEAHEDKEMTDLLDFLGGMFVEIPGPCRVFHLGTSF

SEQ ID NO: 117608 - protein, 74 aa, Glycine max
  Coding DNA Sequence Number=SeqID_25923
MKNERMICPSRCHEEMHNVIKEQAKMRLHCHQASRRPSMTTDRPPLLMAHIVPGIGPNISTCVRGVGAYVCIEK

SEQ ID NO: 117609 - protein, 187 aa, Glycine max
  Coding DNA Sequence Number=SeqID_25924
  Homolog annotation: Hit_ID=UPI00016621D1; Match level="QueryCoverage =64%, HitCoverage=22%, E-value=6e-07, Identity=34%"; Hit description =UPI00016621D1 related cluster
GGPLGTSTLTFGGLHVLTFRGLHVLIFRGLHVLGARGLYVLTFRGLRILTFRGLHVLTFRGLHVLTFRGLHILAVRGLHVLTFRGLDVLAVRGLGVLAVRGLHVLAFRGLHALVFRGLHVLTFKTTIGTSKPSWGNTGALHEPSSEPTCLAFRELILTFNRLHPATLRVMTIDNDWYLTSEALHLWA

SEQ ID NO: 117610 - protein, 85 aa, Glycine max
  Coding DNA Sequence Number=SeqID_25925
MVILHPLSFRSSESSGGWRQIMVIPHTFSPSRGDRVRWHAETNYGHSAPCHPGSIVFDGTQRQIMVILRLVSTKRNELGSIRMML

SEQ ID NO: 117611 - protein, 47 aa, Glycine max
  Coding DNA Sequence Number=SeqID_25926
MADEQPRRVTLEDYSIRIAGVPEDVVRINLFSFSLSGEAKRWLHSFK

SEQ ID NO: 117612 - protein, 80 aa, Glycine max
  Coding DNA Sequence Number=SeqID_25927
  Homolog annotation: Hit_ID=Q7XET4; Match level="QueryCoverage=71%, HitCoverage=14%, E-value=7e-09, Identity=47%"; Hit description =Retrotransposon protein, putative, LINE subclass
  Subcellular localization annotation: CTP_CleavageSite=42; ConfidenceScore=5.01e-01
MGAYQSSDFVDLWKLKIPAKSLVFAWRLIRDRLPTKMNLSRRQVMVNDLMCPFCGGVMEEAAHLLFSCSKILPLLWESLS

SEQ ID NO: 117613 - protein, 259 aa, Glycine max
  Coding DNA Sequence Number=SeqID_25928
  Gene Ontology: Mol. function=transcription factor activity; Cellular component=nucleus; Biological process=regulation of transcription, DNA-dependent
  Homolog annotation: Hit_ID=A5B053; Match level="QueryCoverage=97%, HitCoverage=94%, E-value=4e-64, Identity=50%"; Hit description =Putative uncharacterized protein
  Pfam annotation: Domain name=AP2; Domain location=17-68; Score=72.6; E_value=1.3e-18; Accession=PF00847.11; Description=AP2 domain
MEERANKGEGGPQNASCEYRGVRQRTWGKWVAEIREPKKRTRLCLGSFATAEEAAMAYDEAARRLYGPDAYLNLPHLQPMSTSTIMSGKFKWFPSKNFISMFPSCGLLNRLQELKRNSVMSQSSSSSSNDPKAEIQNVDSKNHGEDENPPKDVQTSLEEVLGDLQEKPQIDLHEFLQQMGILKEERQSKRTDSSGSSTVCEAVLTDDCDNLGVFSDKSVNWEALIEMDGLAGIQESEVTQLEAYEPNDDLTFSTSIWNF

SEQ ID NO: 117614 - protein, 129 aa, Glycine max
  Coding DNA Sequence Number=SeqID_25929
MIHDDNKDDDKVMTKAQKIKEHSSESKNISSESRTGQEFKNQGEFKTQEESLESRIKNQESRLKISRIKIKIQDSRCEEGMNEKTQSFLSRICTVDMHFNEMESRITKVKKMFYIRSSFDLPPLPPPSS

SEQ ID NO: 117615 - protein, 19 aa, Glycine max
  Coding DNA Sequence Number=SeqID_25930
ASVFNFERLDILRDTIGHP

SEQ ID NO: 117616 - protein, 104 aa, Glycine max
  Coding DNA Sequence Number=SeqID_25931
MASMMEAMLGMRQLMEKNVATAAAVSSAAEADPTLLATAHHPPPNAVGRERNTLGHNNNPHLGFNQVAYPYGLPPNYTPPVIHDDAGHVPSPILEGEPPRLPDE

SEQ ID NO: 117617 - protein, 266 aa, Glycine max
  Coding DNA Sequence Number=SeqID_25932
LPTDYREIEAALCIPGRGFILNAEGHPRKILRKDLTTLAQVWSILSYSNLASTSHTSDMIVDRARLIFDLVSHMDMNVVALISSQITSIAQSNSSRLGFPALITALCRARGVVSDSLVFERLSSIINLAYIRKNCWNPDDLTVTIRGARRARPAELPSTYVVPTPASSSAATSVPAHTDSQRFEAMLQSIHQGQIILLQSLQVVAPPGSIPSVEQFREMVAWPGTQPSLHREDEGPTAQVPQHVEDESSEATIPEPFIIGEEAGET

SEQ ID NO: 117618 - protein, 108 aa, Glycine max
  Coding DNA Sequence Number=SeqID_25933
MGSTTVKDRRKRRTNDECRRMVENLRIITHGNVTESPQLGFSSRKQFSSANLREYEVPRRLNPFLFTPPPIYSKIGEELATQLAQASKVASSRSNRLLEEESGRPKWA

SEQ ID NO: 117619 - protein, 63 aa, Glycine max
  Coding DNA Sequence Number=SeqID_25934
MGEYNQLSLRISSLDQKQAKGGIPQRESVPTKKEVFVIAGEYPTELPLMIWIQILKTTMLLIA

SEQ ID NO: 117620 - protein, 97 aa, Glycine max
  Coding DNA Sequence Number=SeqID_25935
  Homolog annotation: Hit_ID=A6FJQ2; Match level="QueryCoverage=39%, HitCoverage=84%, E-value=3e-11, Identity=92%"; Hit description=50S ribosomal protein L5
MQLPETGHQLVCKRMPGADKPVRARQRMRKEKIPHQAPFAIQAAQLLGRAIGAGLFAITPAGERGMCCKAIKLGNARDPPSKEREEAMEKNIVLKLE

SEQ ID NO: 117621 - protein, 70 aa, Glycine max
  Coding DNA Sequence Number=SeqID_25936
MGILRNQDANSKTKGENMQNLVAIIKKGEIMEAMPSKVILMMPKNQESSKFQRFKNQVFKNQVSIIKIQE

SEQ ID NO: 117622 - protein, 32 aa, Glycine max
  Coding DNA Sequence Number=SeqID_25937
MSSVRADPSGQNLFMVVVRFLETFVGSMSAGG

SEQ ID NO: 117623 - protein, 159 aa, Glycine max
  Coding DNA Sequence Number=SeqID_25938
  Gene Ontology: Biological process=transposition, DNA-mediated
  Homolog annotation: Hit_ID=Q1J7G7; Match level="QueryCoverage=20%, HitCoverage=47%, E-value=2e-11, Identity=96%"; Hit description =Transposase
MKTFQFAHGKRCNKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 117624 - protein, 183 aa, Glycine max
  Coding DNA Sequence Number=SeqID_25939
MGDQEETQEQMKADMSALKEQMASMMEAMLSMKQLIEKNAATAAAASSAGEAYPTLLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAVPPIVLSTEGPPPATEEWKEARSP

SEQ ID NO: 117625 - protein, 168 aa, Glycine max
  Coding DNA Sequence Number=SeqID_25940
  Pfam annotation: Domain name=G-patch; Domain location=1-42; Score =11.7; E_value=0.0073; Accession=PF01585.14; Description=G-patch domain
MVARVMLGNGYEPEMGLGKNNGGRTSLISTRGNRGKFGKSRSQGSQLGRKVEGGPPCHISRSFISAGLGHEGQVVVICEDDSPSGSDFVRPCPPGFRLGNQRVEERPDIYATSIISNHESLQGTNTWDPTIDFKEEMDQTESEEDEDVGLPPELEKIVAHEDQEMGPH

SEQ ID NO: 117626 - protein, 54 aa, Glycine max
  Coding DNA Sequence Number=SeqID_25941
MKVEQLFACHHISEERKVPLATLSFQGVLLGRGTFPPTMKGSLWTSYRGLDKGV

SEQ ID NO: 117627 - protein, 123 aa, Glycine max
  Coding DNA Sequence Number=SeqID_25942
MASSNIKAKVFASTRSSRGYIYLGVQREQGRVHPLWIFACKGFYKVEKKSQGPWTDATKDVLYLTMFLCSMLSPGLLNPDVSHMFSLILIKRRPQMSLVGLNLTRTAVRHNIPKTKLSYPDVS

SEQ ID NO: 117628 - protein, 252 aa, Glycine max
  Coding DNA Sequence Number=SeqID_25943
  Homolog annotation: Hit_ID=A5C169; Match level="QueryCoverage=60%, HitCoverage=13%, E-value=6e-08, Identity=27%"; Hit description =Putative uncharacterized protein
MVIDQSVFHYLTQLSSDGVPFEGTLNDDGKFDFSAYDARQLVCTNHADMTGRLLAGSLAFESRILHYLIVRILLPRSSNLAQVSEEDLVIMWAFHTGRQLDWAHLVKYRMHKALRLNAPLPYPHLVTLFLRHFQIPLHSEPYVPIKRSFLIGAAVIASFGYRKEHDGSWVKKGAQPADDEGNLPVEDNSSLLRRLLDKFDGLQTFVGDKFDAMELQVDMRFDAMDSRITKVEEDVSFIRTCFDPPPPPPSSS

SEQ ID NO: 117629 - protein, 67 aa, Glycine max
  Coding DNA Sequence Number=SeqID_25944
MLPFDFRTSQGPKNGRMSSSKGSRTKLGYDNGAPKKSGEWRIGEQRYAITSRGSRLVGGGRSNSARQ

SEQ ID NO: 117630 - protein, 270 aa, Glycine max
  Coding DNA Sequence Number=SeqID_25945
MDKSEDVATNERVNVEASHNDKLNLLLRGNDFSLFHLRCCRNDACMKPNWVFLAKEKPQPSGERPSTRNTFEVVLPMVGFILYYFRNRPTNKAWSLSLIHHQERPLIRSFTTSYKNFKVGFSKVEIIPGLGDNFFMTLWVSITSANIIVVTPDIRSPPPHPSPQVVVLPGNKNKKKKARRELLGEKFFHSSYHPQSLMSTSVVSDYNKDILQGADATSNWAMYLELQSKSTIITKHMILLNSLVDQEVLKLKKALEAIEKEKDHAIEANI

SEQ ID NO: 117631 - protein, 134 aa, Glycine max
  Coding DNA Sequence Number=SeqID_25946
  Subcellular localization annotation: CTP_CleavageSite=56; ConfidenceScore=5.03e-01
MYPLLFSVTTTQVDVPSTCTIKDVPSNLLRQSSQAVTPLKVCEGETKDISSGRHKRIQAVSPLFFWKRDKRDTKRIQTISPCRILFGKREKRMKKMNSTLLFSVKEQGLETKKLRKLLAKEEEEEVQEDVQKLV

SEQ ID NO: 117632 - protein, 64 aa, Glycine max
  Coding DNA Sequence Number=SeqID_25947
MSNHKSTESALKNLEIQVGQLDKQLAEKSSNSFKANTEKNLKEECNAVMTRNKKRLVVEDKDRV

SEQ ID NO: 117633 - protein, 72 aa, Glycine max
  Coding DNA Sequence Number=SeqID_25948
MNCIFVQVSSVFTFEFGAMLSDCLVQFSILNPFSEPHELVFVHISSTFEFGAMRSDCLVQFFILNPFSEPHE

SEQ ID NO: 117634 - protein, 91 aa, Glycine max
  Coding DNA Sequence Number=SeqID_25949
FLWGPSAFPVAGSTCTTGLSTPGGLVDNDRRREALRVRFTADVEADASEVGGGGGGEGEEGGGGGGGGEGGVEAEKKEGNEQQFEGCTFRN

SEQ ID NO: 117635 - protein, 78 aa, Glycine max
  Coding DNA Sequence Number=SeqID_25950
  Homolog annotation: Hit_ID=Q9KHC4; Match level="QueryCoverage=53%, HitCoverage=8%, E-value=2e-07, Identity=69%"; Hit description=SocE
MEVSLKGIIFFVRRYRARIRNHGHSCFLRETCRASCINESANARGEAVCVLGALPLPRSLTRCARSFGCGERYQLTQR

SEQ ID NO: 117636 - protein, 270 aa, Glycine max
  Coding DNA Sequence Number=SeqID_25951
MAKFDPEIVIEFYANAWPTEEGVRDMRSRVRGHWVPFDADADDFDEEAIAQLLCIPGQDFARTAAGRQVWIMRTNMTTLTQIWMTLLHSNVLPSDHNSDLPLPKCQLVHAILTQMSVHMAQVIADAIYLFAGMAPTRHPLDLEKSNRALGLPALITGLCQSYGVPITPSKVIRPLITRAFIEKYCTPRQAQGNAHQDAGAPPPPRQADSVGPLHVERYIYHLVHQQAAKHHGQVQIHECLYRFSLSQQGQVSTPFVCRTPEQFGAEVAWP

SEQ ID NO: 117637 - protein, 100 aa, Glycine max
  Coding DNA Sequence Number=SeqID_25952
SEQESARGSFQGETPGIFIVLSGFATSDLSVDFCDARQGGGAYGKTPATRPFYADTARRSRTTERSESVSEEAEERPIRKPPLPALVELRPLAMLVVGIL

SEQ ID NO: 117638 - protein, 188 aa, Glycine max
  Coding DNA Sequence Number=SeqID_25953
MVKRKVIHTRRPNQLALLCLLGSFYYLTNTEHAYTNPLKNLRIARHGKFGENSARSSVLAWVYRPTKPRPNDFGRKPIELVQPSRPNSIQARLIPLVQPNSVNSTEFGSVISAEGSSANTAEFSASRTFLDGSANMIQASEALQVQPNFTQHVPYSHSWPNQVHPPLPINCLLESLFGRFGRARTPVH

SEQ ID NO: 117639 - protein, 150 aa, Glycine max
  Coding DNA Sequence Number=SeqID_25954
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLNLLSFVVDLPDGSGEPASKRLGIL

SEQ ID NO: 117640 - protein, 70 aa, Glycine max
  Coding DNA Sequence Number=SeqID_25955
  Homolog annotation: Hit_ID=A5AYU6; Match level="QueryCoverage=61%, HitCoverage=7%, E-value=3e-08, Identity=53%"; Hit description =Putative uncharacterized protein
MTKSHENNEEESVRKKWYINSGCSKHMTGDVSKFTTISPKKSGHVTYSDNNKGKIIGVGKIGAGVLAQAS

SEQ ID NO: 117641 - protein, 37 aa, Glycine max
  Coding DNA Sequence Number=SeqID_25956
MVQSYPLRTLDRRLQEDWARDAREGPRILMNLRGSIM

SEQ ID NO: 117642 - protein, 101 aa, Glycine max
  Coding DNA Sequence Number=SeqID_25957
  Homolog annotation: Hit_ID=A6FJQ2; Match level="QueryCoverage=37%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTCKRRQCQLHAA

SEQ ID NO: 117643 - protein, 29 aa, Glycine max
  Coding DNA Sequence Number=SeqID_25958
AVDGTSLSYPNFVRGPLLDDMRPFFGPCE

SEQ ID NO: 117644 - protein, 224 aa, Glycine max
  Coding DNA Sequence Number=SeqID_25959
TPLPIILPALIGAVVGAGITLFFNLWKFHRDERAARCDELCKAIQEAATLALGYWTTAFSEPEEQIVAETKLRAAQDFVELLFEDFIIFISVSNEEALAEMLSDFTSKITGGQYTELGRPTDLERAKMTGPLANRLSAIREGDFKRLATYPDHRQAAYPDKPLRFTSRKSSISRCNKARLWVTLSSERRAPFSMRWMDVFTAFTRLPKVYGLEIATKSVESISA

SEQ ID NO: 117645 - protein, 311 aa, Glycine max
  Coding DNA Sequence Number=SeqID_25960
GVAKDWLYYLAPRSITSWDDLKRVFLEKVFPASRTTTIRKDISGLSNMERSMKDAASGGALGDMTPAEARNLIEKMASKSQQFSARNDAIVIRGVHEVATNPSASSETKKLEGKLDALVNLVTQLALNQKSVPVARTSSTSAANQPQQSNYDLSSTDTPWMEDHPNLRWSSPQQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKNVSAILLRSGKQCQGPQPVAPSSSANEPAKLHSIPEK

SEQ ID NO: 117646 - protein, 122 aa, Glycine max
  Coding DNA Sequence Number=SeqID_25961
  Homolog annotation: Hit_ID=Q1I5S8; Match level="QueryCoverage=42%, HitCoverage=9%, E-value=6e-08, Identity=57%"; Hit description =Putative sulfate transporter
  Subcellular localization annotation: CTP_CleavageSite=33; ConfidenceScore=5.08e-01
MSGLSQGFAISGADSRTAVNDSVGGKSQLVSIVAALLIGIVVVFFTQPLQFIPGIGLAVLLGLLQFLRTVFRPSEHLLGTDEDGMIHSLGNTTDIKMQYSLNGWSLMPLHASPIQISAFWQP

SEQ ID NO: 117647 - protein, 100 aa, Glycine max
  Coding DNA Sequence Number=SeqID_25962
LFEVALARSPPICASSSSISVVFKSKGERKDIELVEEEQARIGADPSSGASNKSEIYKEEAWKKTQKHKPKRVESGNADAEAFGDDSKILIALCIVKLKQ

SEQ ID NO: 117648 - protein, 89 aa, Glycine max
  Coding DNA Sequence Number=SeqID_25963
MSPKVVMTLARVEVKNLATIIEGAIVHVLNIIPKEEKRIEGLKRLKNSLLAIILANREKFHWLPLAFKDMPSIGGLPLFGNEGFIGILQ

SEQ ID NO: 117649 - protein, 93 aa, Glycine max
  Coding DNA Sequence Number=SeqID_25964
MTAPSTDPPRDAYATQPCHIPHEAAPASTHADPDADECRHAVEACHAIAEALEQHLNASGTSTHEEVIQKCLRIARGVTEDVRSRHRRRTDQQ

SEQ ID NO: 117650 - protein, 24 aa, Glycine max
  Coding DNA Sequence Number=SeqID_25965
MRESGVLAMVGEEVNAGVIDVLMR

SEQ ID NO: 117651 - protein, 63 aa, Glycine max
  Coding DNA Sequence Number=SeqID_25966
MEEIEPTSVHDNNNRRKSIKAKPPLYENVDSNVNNLIQEDHALLKFNSRQESKKFKIYDQDNL

SEQ ID NO: 117652 - protein, 75 aa, Glycine max
  Coding DNA Sequence Number=SeqID_25967
MFPHGEDAQEMGVEERTPEFQEPLDLRSNPFQGGEHDAILPPRALDRRVQEDWARDAKEGPRILMSLRVDFRSMG

SEQ ID NO: 117653 - protein, 158 aa, Glycine max
  Coding DNA Sequence Number=SeqID_25968
  Homolog annotation: Hit_ID=A2Q2H3; Match level="QueryCoverage=58%, HitCoverage=77%, E-value=3e-09, Identity=39%"; Hit description=IMP dehydrogenase/GMP reductase, related
  Pfam annotation: Domain name=DUF1723; Domain location=81-130; Score =38.7; E_value=2.1e-08; Accession=PF08330.1; Description=Protein of unknown function (DUF1723)
MVKTRGLGRVLRKVGAKGLGRGGDGDDTDGAPQRQRPIASARRRRVPVILDDDVPVVTCGLACDMVARTGLSPLIACSIDAGDRGLISSFVDRWHREISSFHLHVEEVSITLDDVMSLLHLPIVGAFDDFQPLRTDKAVVLLVELLMVSAEVAMAETG

SEQ ID NO: 117654 - protein, 70 aa, Glycine max
  Coding DNA Sequence Number=SeqID_25969
MVKETTDASITITIKNNAEGRRKRERRCHFKEKMSLKETHHHRRPLIRAWRKKEMNEGRGREEHEILCSK

SEQ ID NO: 117655 - protein, 76 aa, Glycine max
  Coding DNA Sequence Number=SeqID_25970
YILCGTSRAYIYLGCNTENKRWYISCGSVQVEGTSTWLFKENKGGYIPCGSLLVKDLTKSQEPVVAWGLDVGTGCG

SEQ ID NO: 117656 - protein, 412 aa, Glycine max
  Coding DNA Sequence Number=SeqID_25971
  Gene Ontology: Mol. function=transcription regulator activity
  Homolog annotation: Hit_ID=A7Q5W0; Match level="QueryCoverage=35%, HitCoverage=39%, E-value=1e-42, Identity=62%"; Hit description =Chromosome chr14 scaffold_54, whole genome shotgun sequence
  Pfam annotation: Domain name=DUF573; Domain location=260-347; Score =129.7; E_value=8.5e-36; Accession=PF04504.5; Description=Protein of unknown function, DUF573
METYGLPYVHIMAALMRLNIDELPSCLVLERWTIAVKDRFVGMIIDDASFWNSHVIARYVWMLNACREFCTLACQSANDFVEGRNKSRKEIQNLKYKNGIEVGTGWVERCVGGLQDPTYVRTKGSGCKKSRVSKLRIKRIVKCSACKLPGHNKLACTTVNKPDAIDDNVLASCSFDGEDNASPMAGDFNVDVIGSPTTSLRRTKSKKKTTTKKTCPFPPALSLSPLSSPIPPSPTAAATLQFQSPPPPSSSPTHPIRSGDEIELLQGFLYYTSQQGSSHHSDTALFYDQIKSKLQLDFNKNQLVEKIRRLKKKYRNVLNNIFSGKEFSFKSAHDQATFEISRKIWSNVTPVGDNSLDDDEINPNRSPNPNLNFSPVILKNEMIFRNSTEKKTPKRSRPRSAMKIEPNELSAK

SEQ ID NO: 117657 - protein, 225 aa, Glycine max
  Coding DNA Sequence Number=SeqID_25972
  Gene Ontology: Mol. function=acid phosphatase activity
  Homolog annotation: Hit_ID=A7Q3N5; Match level="QueryCoverage=80%, HitCoverage=36%, E-value=2e-66, Identity=67%"; Hit description =Chromosome chr13 scaffold_48, whole genome shotgun sequence
MKGYKLRWCDFSPTTLVVQAAKYHDALVRAASIRWTDGGSTIKYGAAKDIADNNFVPSKIPKGCVPIHLNLVARHGTRSPTKKRIKELDNLSERLEVLVRDAKERNLPLERVPSWLNEWKSPWQGRRKGGELVIKGEEELYDIGIRIRERFPNLFDEEYHPDIYPIKATQVPRASASAVAFGMGLFSGNGSLGLGHHRAFAVTSESRASDIVLRFHDCCHNYKLL

SEQ ID NO: 117658 - protein, 72 aa, Glycine max
  Coding DNA Sequence Number=SeqID_25973
MDKSLKVGEDEWREKEKMSYKHFIIIILDTILPRRGPITRAMARRLQGDWARDAAEGPRVLMSFRIDFGPMS

SEQ ID NO: 117659 - protein, 185 aa, Glycine max
  Coding DNA Sequence Number=SeqID_25974
MEATPFDFPQVLFNYFATQVMKDKSIEKDIYHKVVLTKVLGARGVIRKFLYKTPEESFGCRRDWRELSLKRKLFCRALDEIQSDCEVSRGGGDIPTTCNLVPLPPEIEATLRRNKAERRRKLLKDRIVASILEEEAQSSDSTSFDSLSSRESAIYLPEASIMADEDHHRITLEDYSSSSVLQFFT

SEQ ID NO: 117660 - protein, 107 aa, Glycine max
  Coding DNA Sequence Number=SeqID_25975
MRVRLIKEEKSITGRETRETGTRETARKSRQDFSVSKPKERSSEAFSLPLSRSFLSSSSTIEAPHKASTFGAHFRSKSQKEGISGVVKCVATSGTLKLQVWVDFFLL

SEQ ID NO: 117661 - protein, 78 aa, Glycine max
  Coding DNA Sequence Number=SeqID_25976
MASSQECKGWKISVNVLRGDCFRGVISRALAQAMRNQNRGKVAGVVEYQGLDCFQRNNPSAFNEGYNPNGAHNWITGD

SEQ ID NO: 117662 - protein, 151 aa, Glycine max
  Coding DNA Sequence Number=SeqID_25977
MPKDTEERGKKVILWIFLDPSSPRLASGSPGPSNNFMGSEVKRIKRREKEEEERKRNEVEALPNHNRGDERAFLYMLSLSRREAKRQPGVGKCAKWTGEYGLVLVLRCNVNLHSPIVNAKCPVVGHSSRNQLIVLVFHNSDVRLLRNHLDG

SEQ ID NO: 117663 - protein, 29 aa, Glycine max
  Coding DNA Sequence Number=SeqID_25978
MEATEPKNEKTSPSPFLTTFVQGLLAQAS

SEQ ID NO: 117664 - protein, 59 aa, Glycine max
  Coding DNA Sequence Number=SeqID_25979
MTSLPGIQFIMCQPRFASVHLKKNTHDAILPRKGLLTRAMSKKLQEDWAGAAEEALGFS

SEQ ID NO: 117665 - protein, 136 aa, Glycine max
  Coding DNA Sequence Number=SeqID_25980
MASRKRKSNGTRPTSQYDTRRFSSLDAWTRYTDNVLGRNILPERKVELYHTELDDFKAELERGHLVKIDANSLKTFLETHVVLSEGETLPAYSKYCRLPTDYREIETALCIPGRGFILNSEDHPGKILRKDLTTQA

SEQ ID NO: 117666 - protein, 183 aa, Glycine max
  Coding DNA Sequence Number=SeqID_25981
MHTGRSISLQDHAIRLSEELGRFVYVDEVFQQTHLRKDTEEFEARLSQARSDAASSIGESQLTPLDPAEEQRLRSRCWVAAARPKCKGRLYGIGDLAHTYKCGSDRFMQHTQGSFGHAEDAAEINRLREELRQSKEEMHVFQSVVLQFLPPEVWNIINQQQQTHQQHQDHHQDQADDQQTDDQ

SEQ ID NO: 117667 - protein, 45 aa, Glycine max
  Coding DNA Sequence Number=SeqID_25982
MALLIIYMRIFLLGFSKKDMTTGGVDPPRPPSHDSNGKGTTVMKK

SEQ ID NO: 117668 - protein, 40 aa, Glycine max
  Coding DNA Sequence Number=SeqID_25983
MEGRKEKNSIAVVVASIAVEMNSFAAVATSTTMLASMATA

SEQ ID NO: 117669 - protein, 93 aa, Glycine max
  Coding DNA Sequence Number=SeqID_25984
MSSGSTHRELPEERHPECFRKKLLPEEFHCLPEEASSGSCVLLRFLCFFFRLLCLFLPFAVVSVVVPSAVCWWSREVKYLKIWWSRVPYLKFY

SEQ ID NO: 117670 - protein, 127 aa, Glycine max
  Coding DNA Sequence Number=SeqID_25985
  Homolog annotation: Hit_ID=A5AIH8; Match level="QueryCoverage=80%, HitCoverage=17%, E-value=1e-12, Identity=33%"; Hit description =Putative uncharacterized protein
GRSISTEKFLSKEESRIQAPTKPYKERHKIQTPTKKTNANGTVEEPEKCSKLRTSIGKKSTEVSNSGLPGNLEVMKHRDAAQIAAIEAMQEPAATESLLQCLSRKEEEAKKKKKQRTEREESVRLGF

SEQ ID NO: 117671 - protein, 101 aa, Glycine max
  Coding DNA Sequence Number=SeqID_25986
MFLQIQTVEFYRDNSGFLRERKRLQCEGYFSHLRHDIKIPNGKNARNWVSNLMLKFHDDPTVNKSEIVIFMRQVWWSARKREGFEMRKEKNENEVKKKHLT

SEQ ID NO: 117672 - protein, 656 aa, Glycine max
  Coding DNA Sequence Number=SeqID_25987
  Gene Ontology: Mol. function=nucleoside-triphosphatase activity; Cellular component=protein complex; Biological process=ATP metabolic process
  Homolog annotation: Hit_ID=Q9LSC3; Match level="QueryCoverage=99%, HitCoverage=91%, E-value=0.0, Identity=62%"; Hit description=Genomic DNA, chromosome 3, P1 clone: MOJ10
  Pfam annotation: Domain name=AAA; Domain location=417-600; Score =214.8; E_value=2e-61; Accession=PF00004.20; Description=ATPase family associated with various cellular activities (AAA)
  Pfam annotation: Domain name=AAA_5; Domain location=417-548; Score =16.9; E_value=0.00015; Accession=PF07728.5; Description=ATPase family associated with various
  Pfam annotation: Domain name=Vps4_C; Domain location=604-652; Score =0.1; E_value=0.00095; Accession=PF09336.1; Description=Vps4 C terminal oligomerisation domain
  Pfam module annotation: Pfam domain module=AAA::AAA_5::Vps4_C; Domain location=417-600::417-548::604-652
MEEAKEKCWRMEVEEKLKRLQSLLFGAERALENNDFSSAYILALRLLGFLDVNSHSNVDEAFVQPIRRDALAKLHFARQSLTPQSDRQAFEQAKKSPGRIFGTTGDIDIEKIRNSKYFQALVKQSKEKDENQLVDHLGKQDKAGSKASKQMVQTKLPSMYGKRSLRTSNGSKSIFNMKNNSSEDCMSLDRPQSHASHTKGPGFSSILQVEGEERAFGNTFSTKRVHMENNSPRVGFVKSPSSKEDVNPDACGNGFVTARAKLEMEAKQKRGVGGSPSASVSPQCDNNSANRLYGGRSYGVPRRGVRGNFVPPIKSNGNNAGNTSTRIAGKCDDSLDDSTKKCLEILCGPDGELPEKLRNLDPRLIEHVSNEIMDRDPNVRWDDIAGLEHAKKCVNEMVVYPLQRPDIFMGCRSPGRGLLLFGPPGTGKTMIGKAIAGEAKATFFYISASSLTSKWIGEGEKLVRALFGVASCRQPAVIFVDEIDSLLSQRKSDGEHESSRRLKTQFLIEMEGFDSGSEQILLIGATNRPQELDEAARRRLTKRLYIPLPCSEARAWIIRNLLEKDGLFKLSCDEMDIICKFTEGSDMKNLVKDASMGPLREALSQGIEITKLKKEDMRPVTLQDFKNSLQEVRPSVSTNELGTYEQWNKQFGSLSL

SEQ ID NO: 117673 - protein, 198 aa, Glycine max
  Coding DNA Sequence Number=SeqID_25988
MTEDIVVFEMYVGHCRLLKACNDGRHGRLRNVDEGHCCLLKACNDGRHGVLQNANDNMTFFVSTCYLTRLSWDSRENFSGLSRQTLSLRQRKQPTVVQMTILVSACQWARLPLVDKGETKVASVDRHRVFNKRVQMTIFVVALCGACRPWIFFINGVLCFLKFDGNGMEKKKDDWRRHFKKKMSLEEAHHHRKPWIRA

SEQ ID NO: 117674 - protein, 274 aa, Glycine max
  Coding DNA Sequence Number=SeqID_25989
  Homolog annotation: Hit_ID=Q2N2B2; Match level="QueryCoverage=32%, HitCoverage=44%, E-value=4e-16, Identity=47%"; Hit description=RPGR ORF15 isoform
MEDFESYEGEDFESSKGEDLKSSKGEDLESFEGEDFEPSEGKDLEPSKGKDLEPSKGEDLESSKGEDLESSKGEDFESAEGEDFESSKGKDFESYEGEDLESSEGEDFIFESSETSQSMGTILEVETQEHMSLEQTNHQLTLTFQWNPYHLDFAPYASRSYNAQWNVPELLHDMHMLRLSRILRKMEVEEPWLGLWLPLHYQVDMGARWCLALDVWQEGLVADLGVTFVVDWVVDNEKGRYWLSNDIVGLVENLAMMIKFASLQTYFDTFVGED

SEQ ID NO: 117675 - protein, 266 aa, Glycine max
  Coding DNA Sequence Number=SeqID_25990
MGVKYLEAVKRRLHATKQWSPDEIRAINSWDSGLNDGGCTNNARQSIRGAPDLMAINSWGSGLNDGGCMNSARQSIRGALDLMMEDAINSWGFGLDDGGCTNSARQSIRGAPDLMAINSSGSGLDCLWIVKKRCGTKWFPRMSSGPPPLDDKGANDHNLSLRVNGLACLWLTKEVVCAEDDVNLRVSTGLLAAIDKGVQKTTLVSACYHALSLRDSKRKFAGYRQVSPHATGLLGHGNKGGVVDKSRAFAPTYPQFVMRNSDLRSS

SEQ ID NO: 117676 - protein, 76 aa, Glycine max
  Coding DNA Sequence Number=SeqID_25991
MLGFTSDSPQILASPHQLDFAPYASGPYNAQWNAPELLHDKHMLCSSRILGKMEVGFVVDLGMAFVDNWVVGNEKG

SEQ ID NO: 117677 - protein, 113 aa, Glycine max
  Coding DNA Sequence Number=SeqID_25992
  Gene Ontology: Mol. function=helicase activity; Biological process =protein amino acid phosphorylation
  Homolog annotation: Hit_ID=Q2A9E0; Match level="QueryCoverage=99%, HitCoverage=7%, E-value=2e-29, Identity=56%"; Hit description =Putative uncharacterized protein
  Pfam annotation: Domain name=DUF889; Domain location=34-111; Score= -95.0; E_value=5e-05; Accession=PF05970.5; Description=Eukaryotic protein of unknown function (DUF889)
MAHKFCFEALDRSLRDAIKVKSSSDKIFGGKVMLFGGDFRQILPVIPRGSRSDIVNSNINSTCLWNHCHVLALSKNMRLEANTDAIDKEETAAFAKWILNIGDGIAGQQNDGY

SEQ ID NO: 117678 - protein, 128 aa, Glycine max
  Coding DNA Sequence Number=SeqID_25993
  Gene Ontology: Mol. function=aspartic-type endopeptidase activity; Biological process=DNA integration
  Homolog annotation: Hit_ID=A5BVM8; Match level="QueryCoverage=76%, HitCoverage=6%, E-value=5e-21, Identity=49%"; Hit description =Putative uncharacterized protein
MVLQNDETELLRIWPHERKLDSRTINCYFVGYVECSRGYKFYDSTLRSIFETGNARFLEEFEFGKEKNIRKVVFEEEPVIDSAQVLIPIVVQETTPIIENNVQEPVIDSAQVLIPIVVREQDNDGVLP

SEQ ID NO: 117679 - protein, 165 aa, Glycine max
  Coding DNA Sequence Number=SeqID_25994
  Gene Ontology: Cellular component=ribosome
  Homolog annotation: Hit_ID=A2Q6B4; Match level="QueryCoverage=96%, HitCoverage=64%, E-value=1e-15, Identity=30%"; Hit description =Ribosomal protein L33; Nucleic acid-binding, OB-fold
MARIADKIKTIDGSKETLKLAVRITELWFVGTPGRSEQAEMIIVDSNGDQIHVVCKQDQLKAWKMDLKEGCTYVMHNFRVTKNDEQYRVCDHPYKLTFIGVMVVRQCDLDGLPLKKYRFIDFSDIIVGQLQFDLLVDIIGVVDEVVFRHISPKSKKVVFKLMNLR

SEQ ID NO: 117680 - protein, 59 aa, Glycine max
  Coding DNA Sequence Number=SeqID_25995
MVVKRSQKDGCEGCEAITERLKRVLNLRMVTEGINLHQIMEDCLRITRGDTSDGNVRAR

SEQ ID NO: 117681 - protein, 140 aa, Glycine max
  Coding DNA Sequence Number=SeqID_25996
  Gene Ontology: Mol. function=transferase activity, transferring hexosyl groups; Cellular component=endoplasmic reticulum; Biological process=carbohydrate metabolic process
  Homolog annotation: Hit_ID=A5AJP8; Match level="QueryCoverage=60%, HitCoverage=50%, E-value=4e-35, Identity=84%"; Hit description =Putative uncharacterized protein
  Pfam annotation: Domain name=Glyco_tran_28_C; Domain location=13-134; Score=-7.3; E_value=1e-04; Accession=PF04101.7; Description =Glycosyltransferase family 28 C-terminal domain
MVGLPARKVAGKVMMASGGWKVIGEGERVVGRRATSKRAHRNAETGHWKKDNKRKGSGSIFETLRLGKPLVVVVNQDLMDNHQSELAEELADRKHLYCASPQTLHQTIADMDLSSLLPYSPGDATPVAKHINRFLGFPDD

SEQ ID NO: 117682 - protein, 196 aa, Glycine max
  Coding DNA Sequence Number=SeqID_25997
MSIHVAQLIADAIYLFAGIALTRHPLDPDKSNRALGFPVLITGLCQSFGVPVAPSKVIRPPITWAFIEKYCTQRPAQDDAPQAADTPPPHQAGPAGSFDSEQYLRHLVRQQAANHRAHVQTHDCLYQLSLSLQSQGFTSFPCSTSDRFRAEVAWPGDWPEAQAGKAPAEAPGEADEAREDEEMTDLLDFLGGSRAT

SEQ ID NO: 117683 - protein, 82 aa, Glycine max
  Coding DNA Sequence Number=SeqID_25998
  Subcellular localization annotation: CTP_CleavageSite=15; ConfidenceScore=5.15e-01
MSGAVRAALKSTTSVCALVQRSHGLLPMRCFSTEAEQPPLNSTPRPPPFFETDHSEIICILYGTILHESGETMGGKAHSSNI

SEQ ID NO: 117684 - protein, 200 aa, Glycine max
  Coding DNA Sequence Number=SeqID_25999
  Homolog annotation: Hit_ID=A2Q4S5; Match level="QueryCoverage=82%, HitCoverage=26%, E-value=5e-20, Identity=36%"; Hit description=IMP dehydrogenase/GMP reductase, putative
  Pfam annotation: Domain name=DUF1723; Domain location=87-136; Score =50.2; E_value=7.4e-12; Accession=PF08330.1; Description=Protein of unknown function (DUF1723)
MTADVHGAEGSHADDAEGFPGGPRDPSVLTSFADHVAHAIWSGQERPELKLVSHGRKVTLIGRPVSEIEGLVGATRLSPLIGCSVVTGNPGLISAFVERWHSEINSFHLPVVELTITLDDVSPLLHLSISGAFYSFHALSVDEAIFLLTELLKVSVEEARAETARSRGAYVRLGWVRDIYEMRCEARWWIVAARAYLLHL

SEQ ID NO: 117685 - protein, 104 aa, Glycine max
  Coding DNA Sequence Number=SeqID_26000
NNESKLPRNVSNLDDDDDYLVSNSYVEKSLDEHDSVDGISDTDDKITHMIEPGVEGIQNPFWNDVLHYNNINWSHPDEEDICATIPPSDDSWTLILDPSIIRAK

SEQ ID NO: 117686 - protein, 213 aa, Glycine max
  Coding DNA Sequence Number=SeqID_26001
MDLKENCTYVMHNFEVLKNNDQYRVYDHQFKLVFIGVIVVRQCVLDDLPFRKYSKFEPGLLVDVNGVVEEVVFHHVSGKGRRVVFKPKDLSQQLLSCTLWDDYCLQFLKDIPNYKVLLTHGRIKEAQGSYPPSVSNSFKASKLVINQPVMEIQEFIERLAELGIEARSVFKSHGEGSTQLSGSIQLSSKESFFGKAEAKTIAEINTISEVIIL

SEQ ID NO: 117687 - protein, 67 aa, Glycine max
  Coding DNA Sequence Number=SeqID_26002
MAISTTIDAPKDHLQCSTLHQMHHHKFVPHPHSPPPHVWWITMVDVDHGMRRWCWVEVKCDGHENEV

SEQ ID NO: 117688 - protein, 146 aa, Glycine max
  Coding DNA Sequence Number=SeqID_26003
  Gene Ontology: Mol. function=RNA-directed DNA polymerase activity; Biological process=RNA-dependent DNA replication
MKNKKVVMAGVSLSEACPLSENHPLSEALSLLSKLGESGGEYAKHLDVQRIISSLIKGNRGRKELVLNEGDWRINNNAYRLDLLEEYGVRNTFNIIDLVPFVGVANSDDEWSADLRTNPLQKGGDDAILPRRGPVTEVMARRLQED

SEQ ID NO: 117689 - protein, 151 aa, Glycine max
  Coding DNA Sequence Number=SeqID_26004
  Homolog annotation: Hit_ID=A5B2I6; Match level="QueryCoverage=53%, HitCoverage=3%, E-value=2e-07, Identity=40%"; Hit description =Putative uncharacterized protein
MLSSRRGQKKDFVIIVMGNLALVIHALINNSKSLFWEKDKMKKTKWKWGQYMRNNCKRLLGEDKFKWTSKLMGFDFDIVYKPRCENKEPDALSRRMTYSAISMIRFFDEEERDSEVLADLKLKKIMQDLLVNGSAHPDTPYRIKNYGIKAS

SEQ ID NO: 117690 - protein, 102 aa, Glycine max
  Coding DNA Sequence Number=SeqID_26005
MARIYGHFPTIGQREDICNRVVEHLQDEVVEEFRVVGEDEDGLARSKLQGILKKSKVELIIPIRHSEWSIRHSESSSLGHGAPAKFATVNVYIIKAKKRSKT

SEQ ID NO: 117691 - protein, 177 aa, Glycine max
  Coding DNA Sequence Number=SeqID_26006
  Gene Ontology: Mol. function=aspartic-type endopeptidase activity; Cellular component=small subunit processome; Biological process=DNA integration
  Homolog annotation: Hit_ID=A5CB76; Match level="QueryCoverage=100%, HitCoverage=63%, E-value=6e-33, Identity=40%"; Hit description =Putative uncharacterized protein
MASSGPVLSFSGTPTITTAKLNWKNYLSWSASVELWFLGQGHHDHLENDAEAVPDDRRPEWENLDYHLCVVLWQSVEVDVLEILRSFKTCCSFWKKAREIFTNDIQSLFDATMKVTALKQTSHDMIAHIGKARTVVEELKRFLVAESLEEVNRKLYKFYMVLILRSLHSDFDHVHDQ

SEQ ID NO: 117692 - protein, 248 aa, Glycine max
  Coding DNA Sequence Number=SeqID_26007
  Homolog annotation: Hit_ID=A5APQ3; Match level="QueryCoverage=52%, HitCoverage=8%, E-value=1e-14, Identity=40%"; Hit description =Putative uncharacterized protein
  Pfam annotation: Domain name=DUF1723; Domain location=17-66; Score =40.1; E_value=7.7e-09; Accession=PF08330.1; Description=Protein of unknown function (DUF1723)
MVARTRLSHLIACSVDTSDRGLISLFVERWHREISSFHLPVGEVLITLDDIASLLHLLIIGDLHVFQPLHIDVAVLMLVELLMVSPEVAMAETGHYALRDLTQTRRYAWRAASLVHMYDHLNDASNSTSRHVTGYITLLQCWIYEHFSSVAECNADPDYDEVSPRQLRWGAVAIRYRSERVMRQFGYVQGIPAHPDDSWVSFDDVDDRWTHYSDHLAPTGDICVVPGQCAPDYIDWFFVISHPFMTAP

SEQ ID NO: 117693 - protein, 334 aa, Glycine max
  Coding DNA Sequence Number=SeqID_26008
  Gene Ontology: Mol. function=acyltransferase activity; Cellular component=integral to membrane; Biological process=metabolic process
  Homolog annotation: Hit_ID=A7PFR4; Match level="QueryCoverage=32%, HitCoverage=32%, E-value=1e-50, Identity=90%"; Hit description =Chromosome chr11 scaffold_14, whole genome shotgun sequence
  Pfam annotation: Domain name=Acyltransferase; Domain location=144 -267; Score=76.5; E_value=8.6e-20; Accession=PF01553.12; Description =Acyltransferase
MGSFYQNNWRWDLKWRRHLFEHEEGVVVAFMEEISAYPIECHLKDNLLWKADPTGMYSTRSAYRLLSNLNSFAPDGRNFQLIWKLKIPPKAAIFTWRLIKDRLLTRANLHRRNAGSIATVVKMHLSTSGTIALINNTIYFLPSKKKFEGLENLPPPDTPAVYVSNHQSFLDIYTLLTLGRSFKFISKTGIFLFPIIGWAMFLLGIIPLKRMDSRSQLDYLKRCMDLIKKGASVFFFPEGTRSKDGRLGTFKGCKHFKKRFLAIWKEERFSKQNPCRPTLDGIQFSSLGQGQKESLVARFSEVEIKSAVWACGGDKSPGLDGLKINYAKSQFGCL

SEQ ID NO: 117694 - protein, 272 aa, Glycine max
  Coding DNA Sequence Number=SeqID_26009
MLKMGNSTKVVIKQDMKGKRHKYGFNNNKCEKAQKKRVVDDETGDKHQLDEVIERGSEQRTSTSSLAIKWTEGGPVVAHEFEGGPGDAVEEGAATGVSGGLGRLVLLEADGVDFEDVGGSDDEVGEGANVVAGAGGPLDVDVVELERDEVRAGVGEEPDGAIVDVDGALHHLRSSVSATKEKREYESVRVRGSAEWRPAGRKVQELGFAKGSCLEVNKDPLIDYLEHLIDYIVLELFPDVGKNTLIDYLDNLIDYFVESINYLVDLIDYKRL

SEQ ID NO: 117695 - protein, 74 aa, Glycine max
  Coding DNA Sequence Number=SeqID_26010
MYLKDVIRQWSKDYGFINDKGIQKIQQKLNEVEDLASNTSLSEEDIKAKRDLQQQLWEVSNAYESLLRQKSRAK

SEQ ID NO: 117696 - protein, 28 aa, Glycine max
  Coding DNA Sequence Number=SeqID_26011
MELPLERVRLRIRKEREMERFGEDERMW

SEQ ID NO: 117697 - protein, 113 aa, Glycine max
  Coding DNA Sequence Number=SeqID_26012
MGVQIATKPTWAFLNTVASGGSNLARLGELGDKLLPYFPINRGRSEGKKCLALLIFNRSSTFFVHSSSFFGLQPDKNNLTKHFVHKEIRRFDFLIAIKEYVGARETPSSTAKR

SEQ ID NO: 117698 - protein, 104 aa, Glycine max
  Coding DNA Sequence Number=SeqID_26013
MEGGVDVGDGGVVSAIVIDIILSAGPNNNNNNNNNNNKNIQTFQKMYQQKNHHNFKACCCNLPYNENEGEKPKEHLLERKTRGSHHQHLFEENVRKTKKEVYEF

SEQ ID NO: 117699 - protein, 95 aa, Glycine max
  Coding DNA Sequence Number=SeqID_26014
  Gene Ontology: Mol. function=betaine-aldehyde dehydrogenase activity; Cellular component=chloroplast; Biological process=metabolic process
  Homolog annotation: Hit_ID=Q9S795; Match level="QueryCoverage=83%, HitCoverage=21%, E-value=6e-15, Identity=48%"; Hit description =Betaine aldehyde dehydrogenase 1, chloroplast precursor
MSYSYAPPHSSHTTIALPTKEDVDLVVATAKAALSRNKGVDWASASGSVWARYLRAIAAKDDVAGCFQFYADLAEKSNAQKKAHVSDVPSFSSIF

SEQ ID NO: 117700 - protein, 246 aa, Glycine max
  Coding DNA Sequence Number=SeqID_26015
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q93XQ3; Match level="QueryCoverage=51%, HitCoverage=6%, E-value=4e-56, Identity=81%"; Hit description =Putative beta-1,3-glucan synthase
VLTPYYSEETAYSKNDLELENEDGASIIYYLQKIYPDEWTNFMERLDCKKDSEIWKKDEHILQLRHWASLRGVTLSRIVRGMMYYRRAIKLQAFLDMANEQEILDGYKAVIVPSEEDKKSHRSLYVKSRNKLCHNWSKSSCKITEDFVFVIFAAVETLLVLGCALGFQDGGVSVSSTTSKLANPNIRLPGTTSANSRASSAALGQKKLYAESQTGKSTFQKLLEPMLPQLPGISPYRIVLGNVKDK

SEQ ID NO: 117701 - protein, 78 aa, Glycine max
  Coding DNA Sequence Number=SeqID_26016
MCTFREASKKLAVENATKETNQLKEETKGIFGATCVCFMIAKKEEIDLSDNFAAKIATKSKQKLRKGIEALEAYNAHK

SEQ ID NO: 117702 - protein, 70 aa, Glycine max
  Coding DNA Sequence Number=SeqID_26017
MGNTLLETFEGAQGTPVPKDNLPGLETVPMPIQDCSRAHPPDMQNPAEKVIPVGVTSTKSSNGSLYLFVL

SEQ ID NO: 117703 - protein, 143 aa, Glycine max
  Coding DNA Sequence Number=SeqID_26018
GRQLLPWSLAEDVFHETPQKKQSSAIVMSTAEDSFFRGISWKTSFVSTHGRSCLPMCSGKKLLPWNFAEDVFREIPRKKISSAVDITTAEDCFFRGISRKIGVGVATVLVVVVLVEWWCGGDDNGRGGIVATTMVAVVVEWSW

SEQ ID NO: 117704 - protein, 58 aa, Glycine max
  Coding DNA Sequence Number=SeqID_26019
MQSYPQGYLIEDSKRIELELLKKALARVLMNLKLSSNFSSKFLKEDSQENFSKKLPRL

SEQ ID NO: 117705 - protein, 125 aa, Glycine max
  Coding DNA Sequence Number=SeqID_26020
MAQYCRELATRVALAFLKIVGYKDQETHSSPTCCNNNGIRERMLRNGTIVAHVNRGEKPEEKLRFVDEYFGMQVKLEFEEEVGALELMMEDIAESTNPCELNEGDWSMEAVAEVVQAIAVADIGR

SEQ ID NO: 117706 - protein, 80 aa, Glycine max
  Coding DNA Sequence Number=SeqID_26021
  Subcellular localization annotation: CTP_CleavageSite=72; ConfidenceScore=5.41e-01
MLQPYGISIGLKEHSNPVTPKAYTLKSPSGPLPPDSASDSSISSGSLRFLQFLSSNCSDRVPKRQRDREGIEASTCTVIM

SEQ ID NO: 117707 - protein, 119 aa, Glycine max
  Coding DNA Sequence Number=SeqID_26022
  Subcellular localization annotation: CTP_CleavageSite=44; ConfidenceScore=5.58e-01
MCSERQLQCKSRNHSMFQSGMQKIPKKRAKRVFSLSFLDPSSPRLASGSPGPPNYFRVKETTRLGEPVTSRVTINSLGRAAIAPSAHFPINRRAREVEERFQGLVLEGVERIKREEEER

SEQ ID NO: 117708 - protein, 88 aa, Glycine max
  Coding DNA Sequence Number=SeqID_26023
MERDMITMIVDTLPVFYYDKMVGYMPSSFADLVFADERIKVGLRREKFDYPALMNRKPGANGENKKEGETHVVAAVPTWPNFPLAQQY

SEQ ID NO: 117709 - protein, 86 aa, Glycine max
  Coding DNA Sequence Number=SeqID_26024
  Subcellular localization annotation: CTP_CleavageSite=48; ConfidenceScore=5.29e-01
MSGYWEKPFKLYAPVSGSVTAAKAGTLTFMPRGNPICHNSSLCRGNSKAWTVGSDKEFIAVFYSLLCCLPKTWMCSFTRGNGEGNT

SEQ ID NO: 117710 - protein, 72 aa, Glycine max
  Coding DNA Sequence Number=SeqID_26025
  Subcellular localization annotation: CTP_CleavageSite=59; ConfidenceScore=5.49e-01
MSETLPNRRPSNKSPRSTTKESPTKLLCRTNSSRRQLQPSLVEFTENRGRFGLGYEPMRADLSKCYENSRIA

SEQ ID NO: 117711 - protein, 73 aa, Glycine max
  Coding DNA Sequence Number=SeqID_26026
MARMQEITWLSKLKISSEEEVEIPEESKEVQALKAELERARLVKEKFKTTTIRVRKGCDGLRDVNVATTAALE

SEQ ID NO: 117712 - protein, 71 aa, Glycine max
  Coding DNA Sequence Number=SeqID_26027
MEVRDKIELLPYTDLDEVVQHCIRVEQQLKRKPSSKNSTSYSYRKEDRTLSLLGVPPSKPKDDKGKRWRIF

SEQ ID NO: 117713 - protein, 170 aa, Glycine max
  Coding DNA Sequence Number=SeqID_26028
MTGRLLAGSLALESRILHYLIVHILLPRSLNLAQVSEEDLIVMWAFHTGRQIDWAHLVRYRMHKALRLNAPSPYPHLVTLFLQHFNIPLDSEPYVPIKRSFLIGAAVIASFGYRKERDGSWIKKGAQPNDDEGHLPGCHNQKGGDYRSKLHDDDSSMNQVVLMMTKSPKE

SEQ ID NO: 117714 - protein, 100 aa, Glycine max
  Coding DNA Sequence Number=SeqID_26029
MTAPSTDPPRDAYATQPCHIPHEAAPASTHADPDADECRHAVEACHAIAEALEQHLNASGTSTHEEVIQKCLRIARGVTEDVSDARCTNNNAGAPSNTLV

SEQ ID NO: 117715 - protein, 421 aa, Glycine max
  Coding DNA Sequence Number=SeqID_26030
  Homolog annotation: Hit_ID=Q6WAY4; Match level="QueryCoverage=44%, HitCoverage=33%, E-value=6e-22, Identity=34%"; Hit description =Putative uncharacterized protein
MGSNQTPLIKKRFYQVKIKSLKVASLRELGQLMGQLQRQAFCKTYGKIWDLAMVEVSMEAIASLTQYYDQPLRCFTFGDFQLVPTVEEFKEILGCPLGGRKPYLFSGFYPSMVRVAKVVKISVQELDHVKQNRNRVVGIPRKHLEEKVKALADQGEWASFIDILALLIFGVILFPNMEGLVVLAAIDAFLAYHHSKESPVIAILVDVYDTPTYPLQGHRLCAKKGKKNWEQLWASVERRRRKASRLSSPRVLVTLMQEYFKESARHELKATREEKAETPKESEEVQTLKAELERAQVVKEKFKSTAIKVWKEYDELRDINMATVEALERETKRARKEEHDRNNELELRRAERDQSWVKDMILKDELKACQRSKRSLSEQLSKTKENMWAIIDQYKEKLSLAVAHEQRLEEEYAKVSVLQAE

SEQ ID NO: 117716 - protein, 93 aa, Glycine max
  Coding DNA Sequence Number=SeqID_26031
  Subcellular localization annotation: CTP_CleavageSite=42; ConfidenceScore=5.52e-01
MGTLRPSLASMAQSSWSLLMQSSRKGPVTRAISKRLQEDCARAAEEGPRVLMNLRSTKFRALLFLSLHSSPPSSKVLSMASYGGELLLDSSSP

SEQ ID NO: 117717 - protein, 134 aa, Glycine max
  Coding DNA Sequence Number=SeqID_26032
MPHQGEDESRTSSPPLEAMDKSLKVGEDEWREMERRSTKFCASNELWFNPLIQDQVQDSPLSVLRCHAASHKPEIYPIAHENPRAFSCISGPIFLESSIQCPWGVGLHHSLPLEKDLTSNPEVIETLGFFPQHL

SEQ ID NO: 117718 - protein, 73 aa, Glycine max
  Coding DNA Sequence Number=SeqID_26033
  Subcellular localization annotation: CTP_CleavageSite=41; ConfidenceScore=5.35e-01
MVESLKKRKGSSSTTTATGHRRHGTSGDPLAPIPPSFSSPRSTNLAQASKEDLMLLWALQIGRQIDWAHLVQY

SEQ ID NO: 117719 - protein, 136 aa, Glycine max
  Coding DNA Sequence Number=SeqID_26034
  Homolog annotation: Hit_ID=Q2HTZ2; Match level="QueryCoverage=49%, HitCoverage=50%, E-value=8e-07, Identity=43%"; Hit description=HAT dimerisation
MSCSFYMPRDILVIHVSIVSSKFIFNIGAQELDPFQSSLCPTTVEALICAQNWLKFDKQNVNDLQVELDETKNSESAQRSIKNNSRVQDKNQEEFKTQEESLETRIKIQGSRSQESRSRFKAQDSRMKRRLNQDKY

SEQ ID NO: 117720 - protein, 100 aa, Glycine max
  Coding DNA Sequence Number=SeqID_26035
MRHRIPMIGGMMNVLSGATLFCKITHAPNIFMIWVHRDSLGRNNQHENKGKGGQRSINYEDKRDEEEKLEKQKKKKDSKALSSKAKGKGKGEKRFLQEDC

SEQ ID NO: 117721 - protein, 187 aa, Glycine max
  Coding DNA Sequence Number=SeqID_26036
  Homolog annotation: Hit_ID=UPI000065F7CF; Match level="QueryCoverage =79%, HitCoverage=24%, E-value=3e-09, Identity=33%"; Hit description =Homolog of Homo sapiens "Leucine-rich repeats and IQ motif containing 1
MSKSCGFGMTGPLDESISCFLMRVDPWVLVTLTFRGLHVLTFVGLHALTFRGLHVLANRGLHALTLRGLHVLTLRGLHVLTIRGLHVLTSRGLHVLALGTSYPHIQRTTRPHLQRATRPRHQRTACPHLRRATRPRLERTTRPHHQRAARPHLERSTRPRLERTTRPHHQRAARPHLQRTTRPRLGY

SEQ ID NO: 117722 - protein, 145 aa, Glycine max
  Coding DNA Sequence Number=SeqID_26037
  Homolog annotation: Hit_ID=A6FJQ2; Match level="QueryCoverage=26%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPVKKELEKTTENVSSNHAGNSSSCNNNNKLSNQKLIDVLEMDVKILGVPSSNS

SEQ ID NO: 117723 - protein, 166 aa, Glycine max
  Coding DNA Sequence Number=SeqID_26038
METCLGVEELLQRMIDQGRLEVGGEGREEQHICMQSTDGSGVARPKPLVIYFTKGTASQKPGHPLAARPVPFPYQNSHAVPWRYTPSREKEEEATDVSSLSAKVTNITGLSGVTRSGRVFAPPDLQVQPANVKGKGKVGEEQDGEAPHATNKDIPTRGLPEKKDGK

SEQ ID NO: 117724 - protein, 89 aa, Glycine max
  Coding DNA Sequence Number=SeqID_26039
MHRSPTATLRRNRAKRRRKLLQDRTVASILEEEAQSSDSTSSDSSSSRESATDLPEAFVMAEEHQHRVTLEDYSSSSVPQFFISIARPK

SEQ ID NO: 117725 - protein, 58 aa, Glycine max
  Coding DNA Sequence Number=SeqID_26040
MRKRTLPKGERRTGGRSLWKNASNAAFLRFLAFCWPFAHMFFPALSPDSVDNRITAFE

SEQ ID NO: 117726 - protein, 302 aa, Glycine max
  Coding DNA Sequence Number=SeqID_26041
  Homolog annotation: Hit_ID=UPI00006A2D9E; Match level="QueryCoverage =37%, HitCoverage=62%, E-value=4e-08, Identity=18%"; Hit description =UPI00006A2D9E related cluster
TFRGLHVLTFRGLHALAIRGLHALTFRGPHVLTFRGLHALAIRGLHVLTFVGLHALTFRGLHVLANRGLHALTFRGLHVLANRGLHALTLRGLHALTSRGLYILALRGLHALTFRGLCVLIFRTSSFLLTVPGPPPDIGGGPTVRAQPEREAITQLLCIPGQDFTRAAAKRRRPQCQSPPAKVSVGIAPTKTPSGPEEVQQGPGVSSSGYGLYRPYRAPVSPSKFMSSWHRDCARKTPSGPEEGQQGLGVTSSKYGSLSVLGSACRPQQGHQAPPTNRAFIKKYCAPRQAQGETPHQHWDGR

SEQ ID NO: 117727 - protein, 270 aa, Glycine max
  Coding DNA Sequence Number=SeqID_26042
MAPKKISTKRSRRDAAAEGFSATPEFDSHHFRSAEHQQRFEAIKGWSFHRESHVQLREDEYTYVQEEIAHRHWTSLVTPTAKFDPEIVLEFYANAWPTEEKASNVSSARGGTGPMGLTRRPLPSCYAHWGRISPGPLQGGGHPLDPDKSHRAMGFPSLITGLCQSFGVPVTPSKVIRPPITRAFIEKYCTPRQAQGEAHQAADTPPPPRQVDPVGSLGIEQQFGAEVAWPGDWPEAQAGEDPAGSPGEADESHMDEEMTDLLGFLGGSGA

SEQ ID NO: 117728 - protein, 333 aa, Glycine max
  Coding DNA Sequence Number=SeqID_26043
  Homolog annotation: Hit_ID=Q949K7; Match level="QueryCoverage=14%, HitCoverage=54%, E-value=8e-08, Identity=54%"; Hit description =Putative gag polyprotein
GHALRRPYRTRARARVMGEVEEIQEKMKADMEAIKEKMATMMEAMMSVKKIMEANAVAIAATSVVAKVNPTSPSGLKQMNHPTSNMVGKDLGSTDDPMMCKFKTSTPSRHMVCLPNYTPPNVVYIPNEDVNNSTPILIKSQQPQSDHAHVSRPMEETHEIPHHDLARLRALARICCTEGQAVGGIPFENTLQGPQFRPQPQPLHFAVGRAPLAMAEKGKLDHLKERLRAIEGVLDFDKYKGTTCLKNHLKMYCQKMGEYAKDEELLIHSIQESLTGVAVTCINTILIWFWIGYNYRTFAKKGDGSSKDHAQKVEGSGGPGGTPNDGKGDDDRD

SEQ ID NO: 117729 - protein, 174 aa, Glycine max
  Coding DNA Sequence Number=SeqID_26044
MGSSQMLHLKEFYQIKVKSLGTTSLKELGQLMDQLQRQAFRKAYGKIWDLAMVEVSTGAIASLAQYYDQPMRKPYLFSGFYPSLARISKIVQISAQELDHGKQVENGVVGIPRKYLFLEAKARHLDTRKVKGDSPDLDAFLAIITTREALVVAMLADLYDTFEKSEIPQTIQED

SEQ ID NO: 117730 - protein, 68 aa, Glycine max
  Coding DNA Sequence Number=SeqID_26045
MAQEEGTSTDQIPEPSSAPVPEETQPSTPVTELEHPIQDSSAAPGLECHLAKKLTMCLNELSLVPRLS

SEQ ID NO: 117731 - protein, 132 aa, Glycine max
  Coding DNA Sequence Number=SeqID_26046
MPGADKPVRRVSGCWRVSGLANYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPIEPDIRTCQLFLS

SEQ ID NO: 117732 - protein, 354 aa, Glycine max
  Coding DNA Sequence Number=SeqID_26047
MGKICKKSPNPYLAEKKLLEEKRKTREQQAEFTENSSLSLDPPSLVSRHVKWKMARTRRYRQMTSTATQEISDKIGLVSQLASTLDRHLVAQIVLVEEENKNLQEAWRRTVEEEQLRKEVEEENKNLQETWRMTVEEENKRSLELIKQQLKQAIKLELSQIASQHSPPLEPPDIQVVVAGVSTKGSCAEAYTIPLAKKPSDLHIDIMGLYVVHDQCTKLVALGKVYDSAFTIHNIPYADDVVRVSVVKVYHGDAYGSPLQLLFVHLYLKEISMGVYRKAHQIVKYLKLKRMNPSIEHRELMLAKIKFRIEALLIEHPKLLNPRSLVRLNIQASSTDPSCKTTPDLDSPLRFRLT

SEQ ID NO: 117733 - protein, 466 aa, Glycine max
  Coding DNA Sequence Number=SeqID_26048
  Gene Ontology: Mol. function=transferase activity, transferring glycosyl groups; Cellular component=cytoplasm; Biological process =carbohydrate metabolic process
  Homolog annotation: Hit_ID=A7PWD5; Match level="QueryCoverage=37%, HitCoverage=31%, E-value=1e-62, Identity=54%"; Hit description =Chromosome chr8 scaffold_34, whole genome shotgun sequence
  Pfam annotation: Domain name=Raffinose_syn; Domain location=2-449; Score=-223.8; E_value=1.2e-12; Accession=PF05691.3; Description =Raffinose synthase or seed imbibition protein Sip1
MGQGITTTSVPRSLSESDNIVVWLCSLRKKPNVNIKGAINSAMKTLTSSLEGKGDQAGPQWIEPKVDGSFIILFLKENTKFQKKLQNNEQMSGLKHLIDRAKQHHNVKYCLTSLKTILENNEQMSGLKHLVDGAKQHHNVKYAGYWGGVKPATISMEHYDIALAEPVQSPGVLGNQPDIVMDSLAIHGLGLLHPKKVFNFYYELHAYLASCGTCAKRTAIVRAFDDFYPRDPTSHTIHISSVAYNSLFLGEFMQPDWDILHPAEDYDVVARAIGGCPIYVSDKPGNDNFDLLVSNVEIRLKWFADGNWRFQNSSADQLVLYFRLGDGHSDFDAYAPKDLLIVTTGSQAEPRAALNLAYSRSSHSFKLTKEDIVLYSGKVIPGNESRVMELLNRISEIGSTIVMGKNECLHTSGHRYRGELENPAAVLANEINTKLSRKLNVDGMLTLRKVVDGHEKENQRTKMQIR

SEQ ID NO: 117734 - protein, 129 aa, Glycine max
  Coding DNA Sequence Number=SeqID_26049
  Subcellular localization annotation: CTP_CleavageSite=45; ConfidenceScore=5.42e-01
MNLLPSVVHVSSTIESGAPRIHCLAMFANSPFSTFIRRPMNSLPSAVHVSSTIESEAPRIDCLALFANSPFSNLVRRPMNSLPSAVHVSSVIKRGASEKKRRSRDESRHHEKGRTDEISVLSLLSSYLR

SEQ ID NO: 117735 - protein, 127 aa, Glycine max
  Coding DNA Sequence Number=SeqID_26050
TFYKKVEYVLEDCIEVLVKINKFFINKEGLVCVETLCMPVTKPERFEFDAFELDEPEDAGRMPPYFTYCTLCTEAERSPITYCALCCLEIVETPRMLDVPESQDFDIPIFIEIKSFWNLPKQMKCLI

SEQ ID NO: 117736 - protein, 129 aa, Glycine max
  Coding DNA Sequence Number=SeqID_26051
MSLPSEDYTSSPSEGRTPSPSEDYTSSTSEDYTSSSSKGHDYTSSPSEDYMSPIFKGRHALTFRGLHVLAIIELHSLAFKRRHVLNFRGLHALAFRRLRVLIFSVLHIHTLENIRSVALRCLTETCAPG

SEQ ID NO: 117737 - protein, 249 aa, Glycine max
  Coding DNA Sequence Number=SeqID_26052
MSHHSSSVNGEGTSHKDPLSRILDELSSLKLWKEKQERKEKGKKRVEEVSQDERKKVREEERRKIMKEMKEKNMPPIVVITLQSLSEELHDYYEGRHRSHLRPHSHRREKERNPQEANINLPYFHGKDNAEANFDWEIRVEQQLKKKSTSKSYGSHSYPKKDQGQGILGVTPSKPKDDKGKRIEKTHYFSMPHHKNHDSEGQEIYSSQDEATTSPSSSESEEAKGEKSSEEIYAQEKGQPSVVKQKCKE

SEQ ID NO: 117738 - protein, 78 aa, Glycine max
  Coding DNA Sequence Number=SeqID_26053
MTLEIEQRKLSRNSNGHNISLGSPIPAHNISRRSKLNSGSSQEIQMVITLHSDFRVRGMTYRDAQNSTTEVLAKFKWS

SEQ ID NO: 117739 - protein, 55 aa, Glycine max
  Coding DNA Sequence Number=SeqID_26054
  Subcellular localization annotation: CTP_CleavageSite=26; ConfidenceScore=5.16e-01
MVFGASIKFSKTLENPSRGASVTLPRCFRKQIREGFPSFFTVLHPFFICSSFFNG

SEQ ID NO: 117740 - protein, 141 aa, Glycine max
  Coding DNA Sequence Number=SeqID_26055
  Homolog annotation: Hit_ID=UPI00006A2D9E; Match level="QueryCoverage =64%, HitCoverage=61%, E-value=1e-07, Identity=18%"; Hit description =UPI00006A2D9E related cluster
GGPLGTSTLAFRGLHVLAFRGIHALAFRGLHALAFRGLHVLPFRGLHVLTFRGLHALTFRGLHVLVFRGLHAIAFRGPHALAFRGLHVLAFRGLHSGVLTNHKRIKVIPEWPTPPTPLIELVRNHVQGRGNDAILSPKGIG

SEQ ID NO: 117741 - protein, 188 aa, Glycine max
  Coding DNA Sequence Number=SeqID_26056
  Gene Ontology: Mol. function=phosphoprotein phosphatase activity; Biological process=intracellular signaling cascade
  Homolog annotation: Hit_ID=A5C0F5; Match level="QueryCoverage=64%, HitCoverage=18%, E-value=4e-25, Identity=41%"; Hit description =Putative uncharacterized protein
MTTTKNKYEERYAMPPIIKLNQSEVCASYYKCGHGNDVQPWLQRGLSQVENTPLGHRWQRRGNQHIGNDDFVWEPYPSTVISLLPPVCLVGSLAWYAVVPLICFQVIEWHQPDRVLRQFGMQQPIPESPSQPLNIHGITLKGKHDENWGQLFAPMIDQWNNRHAFRVDAYPRQEGLLSFNSDYMAWYR

SEQ ID NO: 117742 - protein, 102 aa, Glycine max
  Coding DNA Sequence Number=SeqID_26057
  Homolog annotation: Hit_ID=A5B612; Match level="QueryCoverage=91%, HitCoverage=32%, E-value=7e-12, Identity=34%"; Hit description =Putative uncharacterized protein
MIFIEAIDLNIWEAIEIGPYIHTVVDVSTSTTTQKPRDKWTKEDRRKIQYDLKAKNIITSALGIDEYFRVSNCTNAKEMWDTLQLTHEGTTNVKDLESHPYT

SEQ ID NO: 117743 - protein, 210 aa, Glycine max
  Coding DNA Sequence Number=SeqID_26058
  Homolog annotation: Hit_ID=Q949K7; Match level="QueryCoverage=18%, HitCoverage=43%, E-value=8e-07, Identity=60%"; Hit description =Putative gag polyprotein
MATMMEAMMSVKKIMEANAVAIAATSVVAKVNLMSPSGINQMNHPTSDMVGKDLGSTGSPHNVQIQNEHAFPPYGLPLNYTPPKVAYTPNKNVNNSTPIPIESQQPQTDHAHKGKQLVVYPYKTLWKALSITHNYTLHSTTSKNPHAMAEMGKLDHLEERLRAIEGEPNIITPPKFKVLDLDKYKGTTCPKNHLKMYCRKIRAYAKMRNC

SEQ ID NO: 117744 - protein, 113 aa, Glycine max
  Coding DNA Sequence Number=SeqID_26059
MARTRHGGGHAAGSVVGRMHVRARAGPGFAQGRRHVGRPTGPDRLQPHRHPGGARQPGQPLQPAGQALPTQPARMAQDRRARPRDRGVAGQACDRGADPAGRPGRPARHPDPG

SEQ ID NO: 117745 - protein, 236 aa, Glycine max
  Coding DNA Sequence Number=SeqID_26060
  Gene Ontology: Mol. function=hydrolase activity, acting on ester bonds; Biological process=biosynthetic process
  Homolog annotation: Hit_ID=Q8XBV9; Match level="QueryCoverage=96%, HitCoverage=17%, E-value=1e-106, Identity=87%"; Hit description =Enterobactin synthetase component F
MAAWRTNAASPFTPFADVVEEYQQYRESEAWQRDAAFWAEQRRQLPPPASLSPAPLPGRSASADILRLKLEFTDGEFRQLATQLSGVQRTDLALALAALWLGRLCNRMDYAAGFIFMRRLGSAALTATGPVLNVLPLGIHIAAQETLPELATRLAAQLKKMRRHQRYDAEQIVRDSGRAAGDEPLFGPVLNIKVFDYQLDIPDVQAQTHTLATGPVNDLELALFPDVHGDLSIEIL

SEQ ID NO: 117746 - protein, 128 aa, Glycine max
  Coding DNA Sequence Number=SeqID_26061
  Subcellular localization annotation: CTP_CleavageSite=48; ConfidenceScore=5.67e-01
MWSSAPFPEMSASSGGDFFKSHKLSRTTSKSIAFVGRPTRSVILTMRSCDMRRQNLVILHPFAIQTQSCPMARRDKIWSFCTLVSSRGGGPDDTRRYLTVIRTLLSSRGGGPDDTQRQNLVILHPCVI

SEQ ID NO: 117747 - protein, 231 aa, Glycine max
  Coding DNA Sequence Number=SeqID_26062
  Subcellular localization annotation: CTP_CleavageSite=56; ConfidenceScore=5.72e-01
MATQSNSPPPPPPSTGVASHSSSPPLKRTRKASRLRLLATRPVGAERPLVHVDPVTGKADGPHSKKFRTYLGIVARDKVDVTYENWEACPYYSEGFDMGGYSASDLRTKKKILQTVGERWRQFKSDLTSKWALAADKDSVDDTNVRKKAQAVQKQNTAPHVMSRGGYEYLEKKLMDEKRNKKLEEATQSGSTDTVIDPPSPIKRHMKWKLACTKKTGDMTSEAAKEIADKI

SEQ ID NO: 117748 - protein, 114 aa, Glycine max
  Coding DNA Sequence Number=SeqID_26063
MNPGIGPRRAGLLPPEATAFWRNLLEGPSGPEPCGLHNHPLFDLRNVTEPHLFVQRCFHLISGVSRNLTDCASIFSFVFRHVPEFHKLPNDGCQAPHKDQRKVTCHQAKVPGRN

SEQ ID NO: 117749 - protein, 133 aa, Glycine max
  Coding DNA Sequence Number=SeqID_26064
MVSPQGRNTWTVEYLMPYVEKITILSEEQERITELVAHGPTSERRFPPQDFHMLLSSVETRGFDRRREAVEAQEFSQQIEKRGHGMYYTPPTFSQYPSQMYQYPFEGHHTDMSTSKHSSVVLRKHILIFHGRL

SEQ ID NO: 117750 - protein, 70 aa, Glycine max
  Coding DNA Sequence Number=SeqID_26065
MNSKERSSRGRDGIGKGLSKPAGLWDNSCFNSCKKVTVGINKTNNFLASARDSGIWDSVSATTFDCPERY

SEQ ID NO: 117751 - protein, 70 aa, Glycine max
  Coding DNA Sequence Number=SeqID_26066
EQGLDQESSVWVGYGIQVVPGLMALWWMMGMMVQRVNQELKFLLVSPAAFVKGHDLHQISVPFQGKSDPV

SEQ ID NO: 117752 - protein, 114 aa, Glycine max
  Coding DNA Sequence Number=SeqID_26067
MTGPLDESISCFLIKVDPWVLVPITFRGLYVLAIRGLHILACRGLHALAFRRLRVLVFSVLHIHTLREYKGSRPQDAQWTRRIPTGPRGFQLLWRASVSPTGCPFPQRGHAIVT

SEQ ID NO: 117753 - protein, 156 aa, Glycine max
  Coding DNA Sequence Number=SeqID_26068
  Homolog annotation: Hit_ID=UPI00006A2D9E; Match level="QueryCoverage =99%, HitCoverage=85%, E-value=1e-12, Identity=14%"; Hit description =UPI00006A2D9E related cluster
VLTFRGLHVHTLRGLHVLAFRGQHALAFRGLHILPFRGLHALVFRRLHALAFTGLHVLIFRGLHILAFRGLHTLALKGLHALAMRGLHVLAFRELHVLTFRGLNVLAFRGLHVLAFKGLHNLAFKRLHALAMRGLQVVAFRGLHVLTFRGLHLLAF

SEQ ID NO: 117754 - protein, 318 aa, Glycine max
  Coding DNA Sequence Number=SeqID_26069
  Homolog annotation: Hit_ID=Q6WAY6; Match level="QueryCoverage=37%, HitCoverage=20%, E-value=8e-13, Identity=34%"; Hit description =Putative uncharacterized protein
DWDQHLVEIGGSAINWFPRWKEGKEEVLFSCGDYPNVPLIGTRGCINYNPALAIRQLGYPMRGVPTEGSLSPFLVKDLGAQGLKVIQRIHKAWRSPLRKDKELRGIRNGVIGGYHGWLRIHTRGLDWLSKLKVIDEENFEAPEEDEEVRALKLELEKEKTRQGEENAATARALEQETKRARKEEYGREKFRGALWGSNNELKLRREERDRSRVHGMILKEELVACARSKRSLAQHLEATEQSMLAIIGQYKEELNQSVAHKQKLVEDFAQVYAEKEARGRVIDALHQEATMWMDRFALTLNGSQDLPRLLAKAKAMAK

SEQ ID NO: 117755 - protein, 175 aa, Glycine max
  Coding DNA Sequence Number=SeqID_26070
  Homolog annotation: Hit_ID=Q6WAY6; Match level="QueryCoverage=41%, HitCoverage=12%, E-value=7e-07, Identity=39%"; Hit description =Putative uncharacterized protein
MGSKSNRQEVLPKSRSKLSVPQHQGIRAVETPSKCKPSASTLTESLELTIEGCPLGGRKPYLSSGCLSSLSRIATVVKDSARGLDRIKQTRNGIAGLPRKYLEDKARGMANQGDWVPFMDVLALLIFGVVLFPNVDGLVDLAAIDAFLAYHHSKESPVVAVLADLFDTFDRGAKE

SEQ ID NO: 117756 - protein, 44 aa, Glycine max
  Coding DNA Sequence Number=SeqID_26071
MTGARQKGGTKREELATQLAQASKVASSRSNSLLQEESGRPKWV

SEQ ID NO: 117757 - protein, 90 aa, Glycine max
  Coding DNA Sequence Number=SeqID_26072
  Gene Ontology: Mol. function=protein dimerization activity
  Homolog annotation: Hit_ID=A5BXL1; Match level="QueryCoverage=83%, HitCoverage=10%, E-value=4e-19, Identity=62%"; Hit description =Putative uncharacterized protein
MFTSDEWTLNKLSKELKGKEAAKVVLMPFFWNSVVYTLKVMAPLVKVLHLVDGERKLAMGYIYEVTNDLFECIKKFDLEVSNLGQTRMLT

SEQ ID NO: 117758 - protein, 65 aa, Glycine max
  Coding DNA Sequence Number=SeqID_26073
MGRRKLELGLEDQKIDFDLFVEDKPASEQNVCLQVMEGGQEVMTPRVSSAQRLMFDSGKCTGSHK

SEQ ID NO: 117759 - protein, 88 aa, Glycine max
  Coding DNA Sequence Number=SeqID_26074
MLRNLTDYVIIPFLPSGTLQNFTDCALTLPFNFRHVTELHGLCYDAFLLASGMSRNFTNCLTMGAKYLEVVEPGSYPKNGWSPDEIRV

SEQ ID NO: 117760 - protein, 97 aa, Glycine max
  Coding DNA Sequence Number=SeqID_26075
MVVGGKLLALAYSATTTVTSTAATCFATLGSAAALLPLLLEDLELGLMLLVEVVVGKLVLDLLLLNRQNLLLGRLTQPCLSSLTAFINRIAGINRLY

SEQ ID NO: 117761 - protein, 133 aa, Glycine max
  Coding DNA Sequence Number=SeqID_26076
MKANMEAIKEKMATMMEAMMSVKKIMEANAVAIAATSVVAKVNPTSPSGLKQMNHPTSNMTHEIPHHNLADFEPWLGYTTEGQAVGGIPLQNPLEGPQYHPQLHLLHSTAVKNPHDYGRNGKVGSSRGKAQGH

SEQ ID NO: 117762 - protein, 216 aa, Glycine max
  Coding DNA Sequence Number=SeqID_26077
  Homolog annotation: Hit_ID=Q2HW90; Match level="QueryCoverage=70%, HitCoverage=35%, E-value=1e-16, Identity=29%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENAVLGIPRKYLEGVLFPNVDGLVDLAAIDVFLAYHNHKESPVVAMLADLYGTFDRRCEESNARIVCCTPALYVGLVSHLFLQEGRPVYPLQGYRSCVEKGKANWDQLLASMEGRPLICSLARRKEESGFYLHAKDVQMFP

SEQ ID NO: 117763 - protein, 175 aa, Glycine max
  Coding DNA Sequence Number=SeqID_26078
MAPTRHPLDPDKSNRALGFPALITGLCQSFGVLVAPSKVIRPPITRAFIEKYCTQRPAQGDAPQAADAPPPHQAGPAESFDSEQYLRHLVRQQAANHRVHVQTHDCLYQPSLSLQSQGFTSFPCPTPDQFRAEVAWPGDWPEAQAGEAPVEAPDEAREDEEMTDLLDFLGGSGAT

SEQ ID NO: 117764 - protein, 71 aa, Glycine max
  Coding DNA Sequence Number=SeqID_26079
MAGAGDNGERLEHQMNPNAGRPYGGNKSDASSIGACRPRIFFINGFLCFLEDKWQRNGEGRERGDATSRRR

SEQ ID NO: 117765 - protein, 150 aa, Glycine max
  Coding DNA Sequence Number=SeqID_26080
  Gene Ontology: Mol. function=transcription factor activity; Cellular component=nucleus; Biological process=regulation of transcription, DNA-dependent
  Homolog annotation: Hit_ID=A9NJI8; Match level="QueryCoverage=97%, HitCoverage=98%, E-value=4e-49, Identity=66%"; Hit description =Dehydration responsive element-binding protein 1
  Pfam annotation: Domain name=AP2; Domain location=22-73; Score=71.5; E_value=2.8e-18; Accession=PF00847.11; Description=AP2 domain
MEGEGGSATRKRGKDGETETTTRYKGIRMRKWGKWVAEIREPNKRSRIWLGSYSTPVAAARAYDTAVFYLRGPSARLNFPELLAAEGPAASDAVMSAASIRKKATEVGARVDALHRQDPHAPPAGEFADRVDLNKIPEPENSDCDYWGGD

SEQ ID NO: 117766 - protein, 62 aa, Glycine max
  Coding DNA Sequence Number=SeqID_26081
MKSHQEEMKIVNLGVSKERKKLRRMKHEMSLKIKEEVKKKFDAGFFGSGSIPRMDGQYCAGP

SEQ ID NO: 117767 - protein, 205 aa, Glycine max
  Coding DNA Sequence Number=SeqID_26082
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=4e-23, Identity=98%"; Hit description=LacZ protein
  Subcellular localization annotation: CTP_CleavageSite=18; ConfidenceScore=5.13e-01
MEKRLCRGPLTSLLSIFRASSRKFPPRWKAISARRSRTTESSESVSEEAEYILYHIFSDAPVQPFFSCHMKHFTDTLISANINSCSPGDPLVLERPPPRWSSNSPYSESYYNSLAVVLQRHDWENPGVTQLNRLAAHPPFASWRNSEEARTDRPSQQLRSLNGEWDAPCSGALSAAGVVVTRSVTATLASADVRRCFCRYAPPRQ

SEQ ID NO: 117768 - protein, 217 aa, Glycine max
  Coding DNA Sequence Number=SeqID_26083
EEDPNVKTNPLASHGGASVNAVKEDGPSRAKRLGDVATSRCFIYQSLQAACMVSHGGGERDECLFHLGESHDMETCPAVEELLQQLMDCGKLEVSIGGREESQICMQSEEKKVPLTPKALVICFTRKWTGSTPIYPRTVPEPMPFAYQSNKAVPWKYTPPASSEKSCNPKLTPLSAKVTNITGPQWRNPAVVGCSLPLTRRIFPLKGRRPWSKSPQT

SEQ ID NO: 117769 - protein, 138 aa, Glycine max
  Coding DNA Sequence Number=SeqID_26084
  Pfam annotation: Domain name=zf-CCHC; Domain location=65-82; Score =22.6; E_value=0.00058; Accession=PF00098.14; Description=Zinc knuckle
MMQSYPARALARRLQVDWARDPRKGPRVLMSLRVCVAKASMQDDKGKAIEKQAPKASMQEKTSSIKCFKCLGRGHITSQCPTTKTMIMRGQDIYSSQDEATTSPSSSESEEAKGEESSEEIYPQEDGQPLVVKEKCKE

SEQ ID NO: 117770 - protein, 167 aa, Glycine max
  Coding DNA Sequence Number=SeqID_26085
  Subcellular localization annotation: CTP_CleavageSite=54; ConfidenceScore=5.09e-01
MWKRQHYYIYTAKKMHTQSFTIPHFPKIGLTHKNSPQWSRQLSQPTLFQASEARLTGESSKGGKCAESPPTFICGKRRKNRRKPVMKNIPNSGVVFTFEEGISISHVDKSGALAPTYPPSKKKSDLRSSFLKSESSDSFYLEGGPFKVLDLKMTHFYLVRKTEVFES

SEQ ID NO: 117771 - protein, 221 aa, Glycine max
  Coding DNA Sequence Number=SeqID_26086
MSVLELYIEKDVAGGSMFQSTNSLTSCGNYLSNDETQPPTNMSNLHLDEDDDHNDDDYLVSNSYVEESLDEDDSVDDISDTDNEVPDMIPLVRIVHPTEGVQGIQNSFWNDALHYNNINSSHPDEKDICGFEMPSSFNVGQELYVGMEFDSKDAVKNAVKQYVMKVHQSFKVVESKWDKYVVCCLNKNADCPCPFYMRAILSKKTDSWKVTQWVEHTHVSI

SEQ ID NO: 117772 - protein, 167 aa, Glycine max
  Coding DNA Sequence Number=SeqID_26087
MAPTRHPLNPEKSNRALGFSALITGLCQSYGVPVTPSKIIRPPITRAFIEKYCTPRQAQGDAHQAAGAPPPPRQADPTGPLGAANHHGQVQIHECLYRFSLSQQGQVSAPFVCPTPEQFGAEVAWPGDWPDAQVGEERTGSLDEADESHMDEDMMDLLGFLGGSGAT

SEQ ID NO: 117773 - protein, 100 aa, Glycine max
  Coding DNA Sequence Number=SeqID_26088
MMNVLSGATLFCKITHTPYIFMMCLHRDPLGSDQGVPTDPKRIKVIPEWPTPPSIREIWGCHDLTNFYKRSPEYVEPRDLRSNPFQGGGDDAILPPKGIG

SEQ ID NO: 117774 - protein, 251 aa, Glycine max
  Coding DNA Sequence Number=SeqID_26089
  Homolog annotation: Hit_ID=Q2HW90; Match level="QueryCoverage=87%, HitCoverage=57%, E-value=2e-25, Identity=31%"; Hit description =Putative uncharacterized protein
MGQLQRQAFRKAYGKVWDLARVEVSMEPIASLSQYYDQPLRCFTFEDFQLVPTVKEFEEILGCPLGGRKPYLFSGFYPSTTRVAKALANQGDWASFIDILALLIFGVVLFPNMEGLVDLAAIDAFLAFHHGKESPVDAILAMYDTFDRGGEKSGARIVCCTLALYVWLVSHLFLQEGRENRDSIFIRRMSKGSLDGTRGCINYNPVLAIRQLGYLMRGVPSDESITPFIARGFSDHNARVLQGVRKAWDAA

SEQ ID NO: 117775 - protein, 94 aa, Glycine max
  Coding DNA Sequence Number=SeqID_26090
MKTFEYSETFGRFTFDGSTSYLSSRKQPIFPRNSKEREVPKKMGALAQRARCFLQKEQHLLLSGGKLFLLEGQGPVAILRCWTLKIIHLLDKEN

SEQ ID NO: 117776 - protein, 101 aa, Glycine max
  Coding DNA Sequence Number=SeqID_26091
MAREAHAKRARRKISVEDKQPSSFPSLPGPKASSCPVLGRVKGASILIPYPLAQANGALFRGESGAPRSTVERKILGPSSFSTGGMEKVDKTDSHFPVEKM

SEQ ID NO: 117777 - protein, 345 aa, Glycine max
  Coding DNA Sequence Number=SeqID_26092
  Homolog annotation: Hit_ID=Q6WAY6; Match level="QueryCoverage=89%, HitCoverage=51%, E-value=1e-38, Identity=33%"; Hit description =Putative uncharacterized protein
MRSSQTPLLKEVLSSQGQSLGITSLKELGQLMGQLQRQAFHKAYGKIWDLAMAEVSTEAIASLAQCYDQPLRCFTFGDFQLSPMVEEFEEILGCPLGGRRPYLFSGFYPSLARISKIVQISAQELDHKKQVENGVVGIPRKCLEAKARILASRGEWAPFIDILALLIFGGVLFPNVDGLVDLATIDAFLAYHDHKESPVVAMLADLYDTFDRRCEKTSTRIVCCTPALYVWLVSHLFRQEVRHACLLESHCSCIEKGGADWDRLLANKEGASVNWFPRWKEGRTRVLISCEGFPNVPLIGTRGCISYNPVLAIRQLGYPMRGVTLEEELAPIISRGFNKTNVETL

SEQ ID NO: 117778 - protein, 241 aa, Glycine max
  Coding DNA Sequence Number=SeqID_26093
  Gene Ontology: Cellular component=membrane; Biological process =transport
  Homolog annotation: Hit_ID=A8GB97; Match level="QueryCoverage=100%, HitCoverage=100%, E-value=1e-120, Identity=90%"; Hit description =Nicotinamide mononucleotide transporter PnuC
  Pfam annotation: Domain name=NMN_transporter; Domain location=1-194; Score=302.3; E_value=9.2e-88; Accession=PF04973.3; Description =Nicotinamide mononucleotide transporter
MSFFSTSNILVHIPLGAGGYDLSWIEAIGTLFGLLCIWYASKEKIINYLFGLINVTLFAVIFFQIQLYASLLLQLFFFGANIYGWYAWSRQTQDNQAELQIRWLPLPKALAWAAVCVIGIGLMTFNIDRVFAWLTQIAVAVMQGLGLNVQMPELQPDAFPFWDSAMMVLSIAAMILMTRKYVENWLLWVVIDVISVAIFAYQGVYAMALEYVILTLIALNGSWLWIKSAGRNGSNPLSSAP

SEQ ID NO: 117779 - protein, 131 aa, Glycine max
  Coding DNA Sequence Number=SeqID_26094
  Subcellular localization annotation: CTP_CleavageSite=94; ConfidenceScore=5.42e-01
PLKVRTRSPLKARACSPLKFRMCRLLKARECSPMMARTCSSLKARTCSPLKLKTCSPLKARACGPLKARTCNPLMAECVFRPAPAWGRMYFLMKARLVSPCRPIPEKQEMTHRELGEGEIGIAVAGQNVAK

SEQ ID NO: 117780 - protein, 75 aa, Glycine max
  Coding DNA Sequence Number=SeqID_26095
MARACSPLKVRTCSPLVARACSPLKVRTCDPLKVRACSPTKIDWPFERGDNSCNLILSFLQISPGTPSECVFCLI

SEQ ID NO: 117781 - protein, 42 aa, Glycine max
  Coding DNA Sequence Number=SeqID_26096
MVDALATLASMFQLKPHGDLPYIEFMCHGRPTHCYLVEEERD

SEQ ID NO: 117782 - protein, 239 aa, Glycine max
  Coding DNA Sequence Number=SeqID_26097
  Homolog annotation: Hit_ID=UPI00006A16D8; Match level="QueryCoverage =93%, HitCoverage=97%, E-value=2e-15, Identity=29%"; Hit description =UPI00006A16D8 related cluster
GLHALAFRGPHILTFRGRHALALRGLHTLAFIGLHALTFRGLQALTFRGQHVLAFRGLHALAFRGLHALAFRGLHALAFKGLHAFAFRGLLALAIRGLHVLALRGLHTLTFRGLHVLALRGLHTLVLRRLHALAIRGLHVLTFKGLHALTFRGLRVLTFRGLHALACRGLHAFAFRGLHALIIRGLHALTIRGRLAHAFRGLHTLAFRGLHALAFRGLHALTFRGLLVPSPSEDYMSSP

SEQ ID NO: 117783 - protein, 76 aa, Glycine max
  Coding DNA Sequence Number=SeqID_26098
MGIEIHKTQCGPPWVHRMNRKAWFEQNRGGGCRPARPGELSSPRRARLLPPEATAFWRNLLEGPSGPGCYLHPHFY

SEQ ID NO: 117784 - protein, 73 aa, Glycine max
  Coding DNA Sequence Number=SeqID_26099
  Subcellular localization annotation: CTP_CleavageSite=43; ConfidenceScore=5.10e-01
MWLRMPPDSWVTHFVSKQPFRGNSGSNKDRRESLKVYQSHTVRGEKVASAQDFVGNQRERITLGRGSFSLFTW

SEQ ID NO: 117785 - protein, 72 aa, Glycine max
  Coding DNA Sequence Number=SeqID_26100
MAMDLNFSSTTRALSSSALGLPLMIAADDPITASPKLSVLSSRRIPRLANSLEYPRVVVTKTPCDERRDAFV

SEQ ID NO: 117786 - protein, 104 aa, Glycine max
  Coding DNA Sequence Number=SeqID_26101
MPIGWTSQKSGASIEEEEPTDLRSNPLQGGGDDSILPRKGPVTRAISKRLQEDWARAIEEGPRVLMNLRAKGPSGEGQSLQVEKDEGPEAETLSRLLIVAEGPN

SEQ ID NO: 117787 - protein, 134 aa, Glycine max
  Coding DNA Sequence Number=SeqID_26102
TIPPPPISASLSLEEIDDRWMHFSDHVAPAGEICVVPGQISHMFVTPTQAGDQPRHPPAPQDEEYVEPHIPEVPVASDLPRHSVDACEGCEAIAERLERVLNLRMITEGTELHEIMQDCLRIARGDASNGSLRA

SEQ ID NO: 117788 - protein, 156 aa, Glycine max
  Coding DNA Sequence Number=SeqID_26103
  Subcellular localization annotation: CTP_CleavageSite=51; ConfidenceScore=5.13e-01
MGNQQRQGYNQGGFLGFQQGPYNQPPQQGPNIFQRTTKLEETLAQFMQVTMSNHKSTESALKNLEIQVGQMAKMLAEKSSNSFGANTKKNTKEECKAVMTRSMKLVAAEDKDVVALKEQVSLKDTTVKKKNRKILPPKHEDPGSVTIPCSIGEVTV

SEQ ID NO: 117789 - protein, 103 aa, Glycine max
  Coding DNA Sequence Number=SeqID_26104
MTFKELMKWLKHSTGGIKVNKTRIKHCTKITSGPTRSKHPQNGVAKAVAGTYPLKIEEREEDERRTSREACSTKGIRAEIPHQRLFEENVTEKLRKRRDLRAF

SEQ ID NO: 117790 - protein, 217 aa, Glycine max
  Coding DNA Sequence Number=SeqID_26105
MVSPQGRNTWTVDDLVPYVEKITMLSEEQERVTEPVSHGPASERQFPEQLFHILQSSVETQGIDRRRETVEAEEYSQQMAERGHGMYYTPQTFAQYPTQMYQYPFQGHHTDTSASQQSFGGVAETQAHFSWPTITPSQQYHGPIPTPNAPLGTQWNVPGQIPNTGDLFGVDLRNAFSAEADEEEAGRHRGRRNPDRQARRWDRPCGTSSRHHRHQNE

SEQ ID NO: 117791 - protein, 71 aa, Glycine max
  Coding DNA Sequence Number=SeqID_26106
MSIFTLRSKKGERRKIPNQRVGESKKKRKKIPNQRMGERKKRDEEEGKKAPDQGSKKIEEMCREVFGPDNI

SEQ ID NO: 117792 - protein, 49 aa, Glycine max
  Coding DNA Sequence Number=SeqID_26107
MLLSSNVIYICVKVVMLARMIHTRLFAAARVKSCPVGRPPLSVGGPGTN

SEQ ID NO: 117793 - protein, 72 aa, Glycine max
  Coding DNA Sequence Number=SeqID_26108
MEGGLLTSLEDIESPKARATSKILRAMTNVHLQLSFVIKVMSSSLVIGLVVNLTCWIDLLVKCVLGESSIEL

SEQ ID NO: 117794 - protein, 227 aa, Glycine max
  Coding DNA Sequence Number=SeqID_26109
MEGRLLNGSLARRKEESGFYLHAKDVPREECHQTKASRLSSHELSVTTTRGYSKEFARHGMRREERTESLGEAVMGSSAAITVRDDEVKASEESDEVQALRQSLKEPGAAIVSSSSEEVKGIITGQRHDLEGRAKGNMWAIIDKCKEKLNLAATHEQRLEDEYAKISAEREARERVIDSLHQEATMWTDRFALTLNRSQELPPLLAKAKAVADTYSAPEEIHGLLSY

SEQ ID NO: 117795 - protein, 127 aa, Glycine max
  Coding DNA Sequence Number=SeqID_26110
  Homolog annotation: Hit_ID=Q84VI1; Match level="QueryCoverage=100%, HitCoverage=18%, E-value=2e-51, Identity=84%"; Hit description =Envelope-like protein
MATSPKETAASGSPAVPSSPHQEQLEFNIQPIQIIPGQASVPEKLVPRRQQGVKISENPSLATSPREVDTEMDKKIRSIVSSILKDASVPEADEDVPTSSTPNVSVPDVNKDVPTSSAPNAEALPSP

SEQ ID NO: 117796 - protein, 95 aa, Glycine max
  Coding DNA Sequence Number=SeqID_26111
  Subcellular localization annotation: CTP_CleavageSite=57; ConfidenceScore=5.19e-01
MKAITRSMPLSSLSFLNGLLHALWTLCITLRLCAPRSLTRRGERLSSVGAPLMGYPNCLMASDSLLAFLPSGKPIDCAAPYPSQMLVDRGRTRIK

SEQ ID NO: 117797 - protein, 306 aa, Glycine max
  Coding DNA Sequence Number=SeqID_26112
  Homolog annotation: Hit_ID=Q2HW90; Match level="QueryCoverage=92%, HitCoverage=71%, E-value=3e-24, Identity=27%"; Hit description =Putative uncharacterized protein
MGTNQTGKRFYQVKVKSLDTTSIKELGRLMEPLQMQAFRKTYGKILELTIAEVSIEAIVSLTQYYDQPLRCFTFGDFQLVPTIEEFEEILGCPLGGRKPYLSSGCLPSLSRIATVVKDSARGLDRIKQTRNGIAGLPQKYLENKARAIDAFLAYHHSKESPVVAVLADLFDTFDRRIDWDQLLAGIGGRTISWFPRWKEGKEGVLFSCGRYPNIPLVGTRGCINYNPALAIRQLGYPMRGAPTEESMSPFLVRDLGAQNSKTIQRIHKAWETPLRKDQELRGICNGIIGGYHEWLKVRIRGLDWLA

SEQ ID NO: 117798 - protein, 108 aa, Glycine max
  Coding DNA Sequence Number=SeqID_26113
  Subcellular localization annotation: CTP_CleavageSite=42; ConfidenceScore=5.18e-01
MPEIHHSLRSPDNTILIKTRISFINNRRVATYPSAGGRRVTRGMRVPRKEYARSRHQRLFEENVGKTGKDAIYELLSERFGSCIYARGRVFPFAPTYSSIWDEKIRPT

SEQ ID NO: 117799 - protein, 234 aa, Glycine max
  Coding DNA Sequence Number=SeqID_26114
  Gene Ontology: Mol. function=transporter activity; Cellular component= outer membrane-bounded periplasmic space; Biological process=transport
  Homolog annotation: Hit_ID=A8GKE2; Match level="QueryCoverage=100%, HitCoverage=66%, E-value=1e-129, Identity=97%"; Hit description =Extracellular solute-binding protein family 1 precursor
VPEWAKDQDGHWALAYTGTIAFIINKQQVKDIPHSWADLLKGSYQVTIGDVGTASQAASGVLAATYAMGGNEKNLKPGLEFFGKLAKAGRLSLSNPVIASLEKGEVQVGVVWDFNGLNYRDQIDKTRFEVLIPSDGSITSGYTTIINKYAKHPNAAKLAREYIFSDAGQINLARGYARPIRAEHLTLPDDVKAKLLPAEQYKNAHPIADPAAWEQSAKALPRLWQENVIMFMQQ

SEQ ID NO: 117800 - protein, 150 aa, Glycine max
  Coding DNA Sequence Number=SeqID_26115
  Homolog annotation: Hit_ID=Q6WAY6; Match level="QueryCoverage=85%, HitCoverage=21%, E-value=9e-09, Identity=26%"; Hit description =Putative uncharacterized protein
MGSNQAPSFKKRFYHVKIKSLELVPTVEEFEGILGCPLGGRKSYLFSGLYPSMARVAKVVKISTQELDRVKQNRNGVVGIPKKHLEEKAKALADQGEWTSFIYVLALLVFGVILFPNVDGLVDLAAIDAFLAYHHNKESPTVAILADAYD

SEQ ID NO: 117801 - protein, 112 aa, Glycine max
  Coding DNA Sequence Number=SeqID_26116
  Subcellular localization annotation: CTP_CleavageSite=52; ConfidenceScore=5.55e-01
MTDVWGANTFPVRKYNSRTFSFKVRRSRLFRFFRRFPQINVGGDSARIPFVEHASRESRVALPPKAHKVDSYNLALASRLKFFNEMTPILLSNSLCGNSQTRKKEIKQSKTI

SEQ ID NO: 117802 - protein, 76 aa, Glycine max
  Coding DNA Sequence Number=SeqID_26117
  Subcellular localization annotation: CTP_CleavageSite=15; ConfidenceScore=5.03e-01
MLTQHAPQSTLQSPSCTEKRSFCYRWHAQVGCVPMNPRVDLSIMKFATLASTFIVGGSCRWFHLYRMYQLTKKPGR

SEQ ID NO: 117803 - protein, 102 aa, Glycine max
  Coding DNA Sequence Number=SeqID_26118
MEEIHGEEDEEQGIKLEGRKRCDASSIGACRPRIFFINGFLCFLEDEWQRNGERKREKRRHFKEKMSLEEAHHHRRPWIRAWRKKEMNEGRGREEHEILCSK

SEQ ID NO: 117804 - protein, 125 aa, Glycine max
  Coding DNA Sequence Number=SeqID_26119
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDIIEESSSESTDPGPITISLELASMA

SEQ ID NO: 117805 - protein, 69 aa, Glycine max
  Coding DNA Sequence Number=SeqID_26120
MLTPPEREQMTTLASARQSHLGSLNDEVRITVRCLRGLPAFGSCLHRKMLTSPERAQMTTLASARQSHL

SEQ ID NO: 117806 - protein, 221 aa, Glycine max
  Coding DNA Sequence Number=SeqID_26121
MAHLERLDSWRGFPSSSHRPTYLKFENRSVGRCAPDASISLALPDRTQPAELQLILRETSLGGNHATKRQLIAVVAAGSPPEFHSGEFGQTAQDIQPTISRPGMLGESLHPRAATLLHVVRGNECDTQAGGPSLPNGLRVYSPVQDSTRCQTPWSVFQDGPNGEPTGRRQERAGAEARQGRALPSTIAMMTSPRAYQQPGLGPPSQSASVNVPSRSADRLS

SEQ ID NO: 117807 - protein, 83 aa, Glycine max
  Coding DNA Sequence Number=SeqID_26122
PLGPSGIFLQKAVASGGSNPARLGELGGNHLPYFAINRGGSEEERAEALPKRFRNVFHEESRKAFNRSSTFFIRSSSFFDLQR

SEQ ID NO: 117808 - protein, 66 aa, Glycine max
  Coding DNA Sequence Number=SeqID_26123
GVIIKKGEIVEAMPSKVIFYDAKESRVKQCFEQRFKNQVSRLKIQESRKDSIKISFKKFYKTLNST

SEQ ID NO: 117809 - protein, 202 aa, Glycine max
  Coding DNA Sequence Number=SeqID_26124
  Gene Ontology: Biological process=transposition, DNA-mediated
  Homolog annotation: Hit_ID=Q1J7G7; Match level="QueryCoverage=20%, HitCoverage=71%, E-value=5e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTKGANNHKVCPRAIGPLGHYSEIETFTWSWPKGADISGKGADDHIGLCVSIGLGGADNRKVSSCAIGLSGHRIAKSVCEWPS

SEQ ID NO: 117810 - protein, 105 aa, Glycine max
  Coding DNA Sequence Number=SeqID_26125
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALFSQLL

SEQ ID NO: 117811 - protein, 106 aa, Glycine max
  Coding DNA Sequence Number=SeqID_26126
MEREIMIVMVATSSLLYYEKRVGWAPSNLSGLVFASLRSLVDLKRGKFNLPAWTNEKTGANKEGDDEGETHAVTAIPVRPSFPPTQQCHYSTLLLTYRPFIHKGHP

SEQ ID NO: 117812 - protein, 102 aa, Glycine max
  Coding DNA Sequence Number=SeqID_26127
HHQKVGHSWENSFDSSLSLNQKCSKVVLRTDDNKDDAKVMNKKLKRSKNNSNESKNISSESRTSQDFKDQEEFKTQEESLQSIIKIQDLKNQDQDSRLKIQE

SEQ ID NO: 117813 - protein, 180 aa, Glycine max
  Coding DNA Sequence Number=SeqID_26128
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P12862; Match level="QueryCoverage=52%, HitCoverage=18%, E-value=3e-45, Identity=98%"; Hit description=ATP synthase subunit alpha, mitochondrial
  Pfam annotation: Domain name=ATP-synt_ab_N; Domain location=84-152; Score=90.2; E_value=6.3e-24; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-150; Score=46.4; E_value=9.7e-11; Accession=PF09378.1; Description=HAS barrel domain
  Pfam module annotation: Pfam domain module=ATP-synt_ab_N::Complex1 _49kDa::HAS-barrel; Domain location=84-152::1-87::84-150
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASGVKGIALNLENENVGIVVFGSDTAIKEGDLVKRTGSIVDVPAGKAMLGRVVDALGVPIDGEGL

SEQ ID NO: 117814 - protein, 78 aa, Glycine max
  Coding DNA Sequence Number=SeqID_26129
MYRPMMSYQMSLSLQSQGFTSFPCPTPDQFRAEVAWPEAQSGEAPVEAPAEAPDEADEAREDEEMTDLLDFLGGSGAT

SEQ ID NO: 117815 - protein, 62 aa, Glycine max
  Coding DNA Sequence Number=SeqID_26130
MGGGAWAFLVGGAICLGLWPLRPRKFEAITGLVMPLDVSGARTRATLMYFNESYSPWPTGSR

SEQ ID NO: 117816 - protein, 36 aa, Glycine max
  Coding DNA Sequence Number=SeqID_26131
MATKMKRCPFEALGSMAPIMSMPNIENSHGAANTFN

SEQ ID NO: 117817 - protein, 160 aa, Glycine max
  Coding DNA Sequence Number=SeqID_26132
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
CEGRFFEEPNNEGLTINFDRDISQMINEEEEEDVLSPELESPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 117818 - protein, 128 aa, Glycine max
  Coding DNA Sequence Number=SeqID_26133
  Homolog annotation: Hit_ID=Q2HW90; Match level="QueryCoverage=54%, HitCoverage=14%, E-value=5e-07, Identity=40%"; Hit description =Putative uncharacterized protein
MGPLQMQAFRKAYRKILDLTIAEIFTEAVVSLTQYYDQPLRCFMFGDFQLVPTVEEFEENLGCPLGGRKPYLFSGVGSCKANSKRHSGPTTEVLGRQGKGYGESRGVGLVCGRVSVANLWGCPLSKRG

SEQ ID NO: 117819 - protein, 62 aa, Glycine max
  Coding DNA Sequence Number=SeqID_26134
MMFCSGLDQLLLKTDLLPIIMRSDTQIGVGRKILLEEILGVGNVGVPSSFVGNQWLEGKVGW

SEQ ID NO: 117820 - protein, 203 aa, Glycine max
  Coding DNA Sequence Number=SeqID_26135
HPFQASYPRLILVVNLLLPWLIQDEATTSPSSSESEEAKGEESSEEIYPQEEGQPLMTNIKEASPLRQPPHLLLCKKTLVSTATPLGFEVIPQVNELLDEGLVCINRHQIPKISDMMNVLKVTTLFCKISHAPNIFMIHVHRDSLGSDQRVPTDPKRIKVIPDWPTPSSVKGRSPEFDEHWDLRSNPFQGRGDDAILPPKGIR

SEQ ID NO: 117821 - protein, 56 aa, Glycine max
  Coding DNA Sequence Number=SeqID_26136
MWRLQSSFFLLHSIVIDLQEAKDSIDEEDPRPTSSTWSYIMWYQEHLRLSRASSSR

SEQ ID NO: 117822 - protein, 60 aa, Glycine max
  Coding DNA Sequence Number=SeqID_26137
MVAITPARVPQLPFLQGYDSNATCACHGEVPGHSIEHCMTSKRKDFQVYAIIVNHGYNAK

SEQ ID NO: 117823 - protein, 181 aa, Glycine max
  Coding DNA Sequence Number=SeqID_26138
TSPSSSESEKAKGEESSEEIYPQEEGQPLVVKEKCKEVSVSSKSLAKKETHFTIETNIKETFPLRQPPHFLFCKKALASIATPLGLEFIPQVKKLLDEGLVRKSLNPCALLVPKIGIIRHQVPKIGDMMNVLSGAFLFCKITRTPNIFMGRSPEYEEPRDLRSNPFQGGGNDAILPQKGIG

SEQ ID NO: 117824 - protein, 47 aa, Glycine max
  Coding DNA Sequence Number=SeqID_26139
MKKHNEEKRKTKGEEERGGTHPLGNKPRKKELHHQELPWIRSLKRML

SEQ ID NO: 117825 - protein, 94 aa, Glycine max
  Coding DNA Sequence Number=SeqID_26140
MIAHIPDPRVDPSQYRDLVHYWCSEKGQKISKINKRSRSKYEDLHCMGTNNLPRWIHEMTTKAKGVQPSRAEIYIDTRTRKDGSIVTEKAAIVI

SEQ ID NO: 117826 - protein, 54 aa, Glycine max
  Coding DNA Sequence Number=SeqID_26141
VIRHQIPKIGVIRHQIPKIGGVPMNPKRIKVIPEWPAPPSVLRKKAQSFKNLRI

SEQ ID NO: 117827 - protein, 85 aa, Glycine max
  Coding DNA Sequence Number=SeqID_26142
ILQDSGTLKRVAWGLDVGIKLIDTVDLEGGPVGKPVVPAALMNRPTRGGEAVCDWALAECILAYYVGLMRLSVKCFMWQEKKAAP

SEQ ID NO: 117828 - protein, 70 aa, Glycine max
  Coding DNA Sequence Number=SeqID_26143
MSVKNLVERLGVHDKTNHTLASQCFARMLQPYGINIGLKEYSNRVTPKAYTPKSSSGPLPPDSGPTQKIF

SEQ ID NO: 117829 - protein, 59 aa, Glycine max
  Coding DNA Sequence Number=SeqID_26144
  Subcellular localization annotation: CTP_CleavageSite=22; ConfidenceScore=5.01e-01
MATTPPVLLKNGIPGLPGHPWVASGGSNPARLGELRSPGRAKVAGRAGRHLLPLFPIKG

SEQ ID NO: 117830 - protein, 293 aa, Glycine max
  Coding DNA Sequence Number=SeqID_26145
  Gene Ontology: Mol. function=unspecific monooxygenase activity
  Homolog annotation: Hit_ID=Q9AVH2; Match level="QueryCoverage=73%, HitCoverage=97%, E-value=2e-57, Identity=48%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAVNYLSHDGLNPAHVPSWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQ

SEQ ID NO: 117831 - protein, 73 aa, Glycine max
  Coding DNA Sequence Number=SeqID_26146
LGFDGELKKPPTDALRPIIPDNACILCLTAAAGTELADAYSPDTVIASSPGKEVHDPPSVADHPLGPATDHRL

SEQ ID NO: 117832 - protein, 170 aa, Glycine max
  Coding DNA Sequence Number=SeqID_26147
MLWLEASSFLLSVPGPPPDIGGRPTVRAHPEREAITHLLCIPGQDFTRAAAKRRVRIMRTNMTTLTWIWMTLLFSNILPSDHNANLPLQMYQLGSRPQDAQWTRRSPTGPWGFQLWLRAFVSPTGCPFPQQGIAPTKTPSGPREVQQGPGVSNSGIAPARHPVDPKESNR

SEQ ID NO: 117833 - protein, 82 aa, Glycine max
  Coding DNA Sequence Number=SeqID_26148
MAVQSGAWMMGVVVSVLLSWIGKGYFAKISYKAPENLYPKKSHLIRHSIEGYQGHCIAKDILLIYWPKMPKGQEKQKWFFPK

SEQ ID NO: 117834 - protein, 144 aa, Glycine max
  Coding DNA Sequence Number=SeqID_26149
  Homolog annotation: Hit_ID=A7Q8B9; Match level="QueryCoverage=31%, HitCoverage=12%, E-value=8e-18, Identity=87%"; Hit description =Chromosome chr14 scaffold_63, whole genome shotgun sequence
YGSYMNVVESWLSRVSSFGILGKKDQAGPCEQLDALSPFNPLSEMWQKEKESMDRPHRLPPRRNYEITPRTPSASRGIYCWPLWLGTERRMVYPGEVSAQLVELRSCNWVVAITGWMSNCPGEDRNMPLKDSTETKTGCQERRG

SEQ ID NO: 117835 - protein, 24 aa, Glycine max
  Coding DNA Sequence Number=SeqID_26150
GSTYEKVMEACLWGFYGGWIFELQ

SEQ ID NO: 117836 - protein, 159 aa, Glycine max
  Coding DNA Sequence Number=SeqID_26151
MSRNLTDYAIIPSLASGMLQNFTDCALARPFNSRHVTEHHGLPNDGCQVPRSGQARVAPQQTDDPRTKLGCRMTIICLCVPSDTIVWMAKRCEMTIICLHMSSARHLWMTKRAQNDHNLSLRAIGHDCLRMVKKVCGMTIICLWMSSGSPPLDDKKGAE

SEQ ID NO: 117837 - protein, 144 aa, Glycine max
  Coding DNA Sequence Number=SeqID_26152
MREKERKPQEVNINLPYFHGKDNVEGNLDWEIRVEQQLKRKSTSKSYGSHSYPKKDQGQGILGVTPSKPKDDKGKTIEKGHITSQCPTKKTMIMRGQDIYSSQDEATYSPSFSESKEAKGEESSEEIYPQEKEQPLMVKEECKE

SEQ ID NO: 117838 - protein, 110 aa, Glycine max
  Coding DNA Sequence Number=SeqID_26153
MWQSLNKIIEKEETLLFKTKKLFSLHTQQNKNFRQPSLSLTLPFSSSSFSIEAQHKASTFGHHFCSKSRKESIFGVVKCVATSGTSKIQELVESLLKLPCWDELDIPILF

SEQ ID NO: 117839 - protein, 139 aa, Glycine max
  Coding DNA Sequence Number=SeqID_26154
MSHHSSSVNRGGTSHKDLLSRILDELSSLKLWKEKLERKEKGKERVEINQGEREQIKEEERRKILKELRKEKQATYSSDDSCKSLSEELCDYYEGIRRSHLRPHSHRIEKERKPHEANINLPYFHGKDSVKAYIDWEIR

SEQ ID NO: 117840 - protein, 86 aa, Glycine max
  Coding DNA Sequence Number=SeqID_26155
  Homolog annotation: Hit_ID=A5C5L2; Match level="QueryCoverage=98%, HitCoverage=13%, E-value=9e-17, Identity=43%"; Hit description =Putative uncharacterized protein
MYDYKFWDDQNKKVIRSRNVTFNENLFYKDKFSAESTCAECFREAMQGNDSIEWKLEMKDEMTSLQKNKTWSSIKLLEGKKALQNK

SEQ ID NO: 117841 - protein, 77 aa, Glycine max
  Coding DNA Sequence Number=SeqID_26156
MEKIGGKQNNSRSMKEKDQRTFRPDKFSARLPFKVVLDWRYPTPPEQRGKDRNTQLPLQKNTTLEKILLVRDRTFDL

SEQ ID NO: 117842 - protein, 182 aa, Glycine max
  Coding DNA Sequence Number=SeqID_26157
  Gene Ontology: Mol. function=oxidoreductase activity; Biological process=electron transport
  Homolog annotation: Hit_ID=A8GHZ7; Match level="QueryCoverage=100%, HitCoverage=28%, E-value=1e-90, Identity=87%"; Hit description=Twin -arginine translocation pathway signal precursor
MGITRRDFLNGVAITIAAGLTPLQILRASPQTANQTLYYPPALTGLRGNHPGSFEHAHQLGRDGKTFDFGSVPAVEEFDLVVVGAGISGLAAACFWQQLKGEQQRILLIDNHDDFGGHAKRNEFNTDDGMLLGYGGSESLQSPRSNFSPVAMGLLRNLGVDIDRLEQAFDTTFYPDLNLSRG

SEQ ID NO: 117843 - protein, 138 aa, Glycine max
  Coding DNA Sequence Number=SeqID_26158
MERSTIDAASGGALGDMTPVEARNLIEKMTSNSQQFSARNNAIVIRGVYEVATNSSASSETMKLEGKLDTLVNLVTQLAMNQKSIPVARLCGLCSSADHHTDHCPSVQQSGAIEQLEAYAANIYNRPPYLSSKSTTTE

SEQ ID NO: 117844 - protein, 68 aa, Glycine max
  Coding DNA Sequence Number=SeqID_26159
MEGKGNKLLKAPNTLPMKGLFVTKLESNEALKVVGPFLRDTNSSRDGINPPSNSLYGNPQTRKQRDKQ

SEQ ID NO: 117845 - protein, 365 aa, Glycine max
  Coding DNA Sequence Number=SeqID_26160
MAPRKLASKRSRKDKAAEGTSSAPEYDSHRFRSAVHQEHFEAIKGWSFLWERRIQLRDDEYTDFQEEIGRRRWTSLVTPMAKFDPEIVLEFYANAWPIEEGVRDMRSWECEYGQRRNRSDGFDEEAITQLLCTPGQDFARTAAGRRVRIMRTNMTTLTQIWMTLLLSNILPSDHNFDLPLPKCQLVYAILTRMSVHVAQLIADAIYIFAGMAPTKHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGFASFSCPTPDQFRAEVAWPEDWPEAQAGEHPQKLPA

SEQ ID NO: 117846 - protein, 79 aa, Glycine max
  Coding DNA Sequence Number=SeqID_26161
MKRCAKRTSTAHLFLDSSSRLAQECCVVVVVDKPVDWLSENSLDWDSELCMSRVSRERKVQVPSKKRTAHLSSSDNDMQ

SEQ ID NO: 117847 - protein, 68 aa, Glycine max
  Coding DNA Sequence Number=SeqID_26162
MDDQIVRKYYITRKFGCQAPNNGILTSHCHEKLYTLGTDVGRRREMDRGGERDKGHRKRVSLIRDDQA

SEQ ID NO: 117848 - protein, 105 aa, Glycine max
  Coding DNA Sequence Number=SeqID_26163
  Subcellular localization annotation: CTP_CleavageSite=49; ConfidenceScore=5.37e-01
MVQPKPSAGLKGKPHQHAFTFMPSFISKNQRLGPLSLSHVLAFILTFASCPHPKNGEKNIEAFHLALGGRTFGYQQQGNGGNVACPIISEHNLGLRPSPTTPQFK

SEQ ID NO: 117849 - protein, 72 aa, Glycine max
  Coding DNA Sequence Number=SeqID_26164
MRTCSPLKARACSPLQARMCSPLMARTYGPLKIDCPFEKGDNSCNPILSFANLSGNSLRVYVLFDLVTTILE

SEQ ID NO: 117850 - protein, 235 aa, Glycine max
  Coding DNA Sequence Number=SeqID_26165
  Homolog annotation: Hit_ID=Q2HW90; Match level="QueryCoverage=39%, HitCoverage=18%, E-value=5e-10, Identity=35%"; Hit description =Putative uncharacterized protein
MGSSQKPSLKKRFYQVKIKSLEVTSLRELGQLMGQLQQQAFRKAYGKIWDLARVEVSMELIASLSQYYDQPLRCFTFEDFQLVPTVKEFEEILGCPLGGRKPYLFSGSIPPRQELPRVSGLAVIDAFLAFHHGKESPVVAILAMYDTFDRGCEKSDARIFCCALALYVWLVSHPFLQEGRPVYPLQGHRSCVEKGKANWDQLLASMEGRLLICSLARRKEESGFYLHAKDVQMFP

SEQ ID NO: 117851 - protein, 154 aa, Glycine max
  Coding DNA Sequence Number=SeqID_26166
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPYERLNWEPGGQTRNGTELEFVIMVIAVSFGKPVVPAALMNRPTRGERRFAYWALFRFLAH

SEQ ID NO: 117852 - protein, 81 aa, Glycine max
  Coding DNA Sequence Number=SeqID_26167
MEKSIGVYVMQREKTGRLCSEESRPDGEKTNNSRQRKTQKMMRIMKLAKYRLKAQVEKDEGPSGEGQSPRVEKDEGPSGEG

SEQ ID NO: 117853 - protein, 75 aa, Glycine max
  Coding DNA Sequence Number=SeqID_26168
MNIDWIKSEQIDKKADGVMMYQARLFSYLGTTSDLSLGQDMARSIVMARQELQSTHNARNSDAIAGASVKTRRDV

SEQ ID NO: 117854 - protein, 31 aa, Glycine max
  Coding DNA Sequence Number=SeqID_26169
MGQVGSVADLGVAFVDDWVFLADRVVSNEKG

SEQ ID NO: 117855 - protein, 63 aa, Glycine max
  Coding DNA Sequence Number=SeqID_26170
MAENTRNQSLLHEVEECLSSKLDERFLQLAGSLWQMLRADMDELLQQEVVEHSPSSSVGITTR

SEQ ID NO: 117856 - protein, 79 aa, Glycine max
  Coding DNA Sequence Number=SeqID_26171
MKTLKTTMDGKTDQVAPQWIEVKSHVQSGGYECGYYVMHWMWNIVRGGLKNDWAMRMDSSGALSRISPHSANMHNSSFF

SEQ ID NO: 117857 - protein, 75 aa, Glycine max
  Coding DNA Sequence Number=SeqID_26172
MTKEGGDNIDMEGLINVALGADGGNQEEQQRCINESANARGEAVCVLGALPLPRSLTRCARSFGCGERYQLTQRR

SEQ ID NO: 117858 - protein, 99 aa, Glycine max
  Coding DNA Sequence Number=SeqID_26173
  Homolog annotation: Hit_ID=B0HC01; Match level="QueryCoverage=31%, HitCoverage=65%, E-value=1e-09, Identity=100%"; Hit description =Putative uncharacterized protein
MEKRQQRGLFTVLAFCWPFAHMFFLRYPLILWITVLPPLSELIPLAAAERPSAARNSYDHDYEFELGTLPPSNKLITMLLQTIGRAINNFGSVNLIGDS

SEQ ID NO: 117859 - protein, 141 aa, Glycine max
  Coding DNA Sequence Number=SeqID_26174
  Gene Ontology: Mol. function=zinc ion binding
  Homolog annotation: Hit_ID=A8GD52; Match level="QueryCoverage=100%, HitCoverage=100%, E-value=3e-61, Identity=83%"; Hit description =Transcriptional regulator, TraR/DksA family
  Pfam annotation: Domain name=zf-dskA_traR; Domain location=64-134; Score=39.8; E_value=1e-08; Accession=PF01258.8; Description =Prokaryotic dksAtraR C4-type zinc finge
MTVMTLPDAQQLLAMPDSDYMNSVQRAFFRQLLQDERQKLLMHIDELKKEIDGGEATGDEADKAAREEDLRLLFRQLDRESRLLPKIDAALARLQNGEYGYCRETGEPIGLARLLLRPTAELSIEAKTAQEMREPHMRKGG

SEQ ID NO: 117860 - protein, 754 aa, Glycine max
  Coding DNA Sequence Number=SeqID_26175
MTPERVILRQRLAGEHVQRGGGQLPLLQRRQQIGFYQVRAARDVDEIGARTQLREQLAVENADGLRRIGQQVDQQFDAVEEGGALRLPGEALHAIDLFGAAAPAAHAEAKLGQLVRHALPQHAGAEDADGEIIQRRLILVETAEIAQHIAQRVFLHLLRHAGILQPQQRHAGRQRAGVFALLIEDRVDAGAEGEHRFQIAAVGQHLVRRAPHQRVIGRPLVAALPFADLGLRQALLDTGQPFLGVKQGVVINDVHTAGSRLFLLVYLQPFAIRRRMQALKPKIKTAPTSGAVVHVSQSGGSWAVAPDKAPQQRNENQHRHADARRPPTQRAEDFAVAGVGLQRRAAAVFRHQAGDVARQHRGDAGHHHPAAHHHALIARRRQLANHGVTDRRDHQFTDALQHIADDDPFKRHQPVAARHADAQRQHQHAEPDAEQRSGELQRNVDVATASAQAVEPPGQQRAAHHDHQRVDVLDPLRRHLNAVNVQVDVVLGEQHQPHRRQLVQRPEHQRAQRQDQIGRHSAALIARMVAQRHHAQHQEDQRAEHDHEVAAELGVGQHHADDRHQRHQHRQPDQHAPTVLAAAGVAQRRIEIRQNAPAADGDDDRRRVAQRSEQEQRAVVFRQLEIPGDGKADEEPEVHAGVVPQERRFAPIIVRLETLGEHHIDAGDVKAAAGQEHRQPPVQPPHARDGDQRTAYHLQHHAEHEQIAVAEESAAEVTAEHVQAIVEGAEHAHHGVGAAFVEAQSLGGVQHQRG

SEQ ID NO: 117861 - protein, 107 aa, Glycine max
  Coding DNA Sequence Number=SeqID_26176
  Subcellular localization annotation: CTP_CleavageSite=47; ConfidenceScore=5.33e-01
MHTRSFTNPRFIKIGLTHKKSPVESPTVVTCPFAGERRRGSRVRFPKEERYAESPPTFICGKRRKNRWKPVKMKILSSGVVFTFEEGRQKRGFCSYVPSIEEEIRPM

SEQ ID NO: 117862 - protein, 272 aa, Glycine max
  Coding DNA Sequence Number=SeqID_26177
  Homolog annotation: Hit_ID=A5B6Y9; Match level="QueryCoverage=15%, HitCoverage=8%, E-value=2e-13, Identity=83%"; Hit description =Photosystem I P700 chlorophyll A apoprotein
ERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLK

SEQ ID NO: 117863 - protein, 37 aa, Glycine max
  Coding DNA Sequence Number=SeqID_26178
GVHHLVGNSLVAQADHRGGELRCTTRWPRQLQHSFPK

SEQ ID NO: 117864 - protein, 115 aa, Glycine max
  Coding DNA Sequence Number=SeqID_26179
  Gene Ontology: Mol. function=oxidoreductase activity; Biological process=metabolic process
  Homolog annotation: Hit_ID=Q9SLN8; Match level="QueryCoverage=51%, HitCoverage=17%, E-value=1e-17, Identity=72%"; Hit description=Allyl alcohol dehydrogenase
MTQVRNKQVVLRDYVTGFPKESDMNIVEGTIILKVPEGSNDVLLKNLYLSCDPYMRLLMAKDRSFGDGSFTLASTQMRQLQSHWDHRSPINLIGSAKITVLMTPCSLIFFFKKTC

SEQ ID NO: 117865 - protein, 97 aa, Glycine max
  Coding DNA Sequence Number=SeqID_26180
  Gene Ontology: Mol. function=nucleic acid binding
  Homolog annotation: Hit_ID=A7QJ07; Match level="QueryCoverage=79%, HitCoverage=34%, E-value=2e-14, Identity=36%"; Hit description =Chromosome chr2 scaffold_105, whole genome shotgun sequence
HLFSKNQQLVSELSSYETCEMEGEGNFSQVALPLFDGKGYDLWSVRMQSYLEGLDVWDAVEENYIVQPLPTRTMTLKSPKEIWEFLKEENAGDDKIR

SEQ ID NO: 117866 - protein, 132 aa, Glycine max
  Coding DNA Sequence Number=SeqID_26181
  Homolog annotation: Hit_ID=Q84VH5; Match level="QueryCoverage=64%, HitCoverage=12%, E-value=8e-29, Identity=78%"; Hit description =Envelope-like protein
MLNYTDSVMKRESPLSLHYKLFEGTHVPDIVSTSGKAAASGAVSKDALIAELKDTCKVLEATIKATTEKKMELERLITRLSESGIDDEEAAEEEEEAAEEDKEAAEEEEEAAEEEEDAAEETESDDDSEATP

SEQ ID NO: 117867 - protein, 119 aa, Glycine max
  Coding DNA Sequence Number=SeqID_26182
  Homolog annotation: Hit_ID=Q3BKH8; Match level="QueryCoverage=52%, HitCoverage=82%, E-value=1e-18, Identity=71%"; Hit description =Putative uncharacterized protein
ADLPQELTSTGRFGTSMSALRHWGCSMFQGLGCSPIKAVRELGSERRETVRSISGVGVRALRGPFPSTRGPGRTHLWCASYRAHGKRWVAKASGSTAETAMGSLPQRGWSERSFENSRE

SEQ ID NO: 117868 - protein, 108 aa, Glycine max
  Coding DNA Sequence Number=SeqID_26183
MPRDIPMVRVSCVRIIPLWERGLLDLPGSYYDHLVGDEGREEVFVRHWEWVNSGIGFGGKFLIALELPSGRAVVGAGAWGASLWIGAGALGCTGAELEEFPARAKKLE

SEQ ID NO: 117869 - protein, 139 aa, Glycine max
  Coding DNA Sequence Number=SeqID_26184
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPNPIFRGGTELEFVIMVIAVSFGKPVVPAALMNRPTRGERRFAYWALFRFLAH

SEQ ID NO: 117870 - protein, 57 aa, Glycine max
  Coding DNA Sequence Number=SeqID_26185
MTVLYKDWHEMLPFALHGEGRVVEFEVRFFLFEILSGNRLPMAKKIYNSYKTIGIQI

SEQ ID NO: 117871 - protein, 137 aa, Glycine max
  Coding DNA Sequence Number=SeqID_26186
  Gene Ontology: Mol. function=nucleic acid binding
  Homolog annotation: Hit_ID=A5C7C5; Match level="QueryCoverage=91%, HitCoverage=17%, E-value=6e-21, Identity=36%"; Hit description =Putative uncharacterized protein
  Pfam annotation: Domain name=zf-CCHC; Domain location=23-40; Score =27.7; E_value=4.3e-05; Accession=PF00098.14; Description=Zinc knuckle
MRGNQRRQNFKPKRRTEESSQIPKCFECNQPGHLRVDCPIFKRKIEKSEKKTIGDKKAKKAYITWDDNDLEFSDDSEKEMVNLCLMGKNYESDEEVSLKKKWYIDNGCSKHMRGDSSKFTHISPKKSGHVTYGDNNK

SEQ ID NO: 117872 - protein, 152 aa, Glycine max
  Coding DNA Sequence Number=SeqID_26187
MEAMKEQMAMIMKAMMIMKKIMEASAVAVAATSTVAKVNPMPQSGLNQMNHPTSAMVGKDLGSMGGPYDVQIQNEHAFPPCGLPLNYTPPNVAYSPNKNVNNSTPIPIESRQPQTVHAHVSQPMGETHEIPHHNLADFEPWLGYATEGQAVG

SEQ ID NO: 117873 - protein, 133 aa, Glycine max
  Coding DNA Sequence Number=SeqID_26188
MTPSQQHDAPMATPNAPFAPQWNRLSKQKRGDNAVAKEILIIKREDGIDHVAHLHDIMDTIMTDFDCGLWLGVTVYVFGFRVRAYGFGLAVGVFGFGLGLGLDVRGLRDRVFGLVVRVRFYGLYGLGLFPSAW

SEQ ID NO: 117874 - protein, 107 aa, Glycine max
  Coding DNA Sequence Number=SeqID_26189
  Subcellular localization annotation: CTP_CleavageSite=51; ConfidenceScore=5.32e-01
MVHDISVKVKLEVTGTSTALNVFGSRRSNDVTRSIFCPNFCKMVTFMLQLDSMNLWVKARAWFNPITQGMAILIANTSTTFHRDERLGNTHAMHGKWENARVTHEQT

SEQ ID NO: 117875 - protein, 131 aa, Glycine max
  Coding DNA Sequence Number=SeqID_26190
LRIANDDFFAVSAGRLLTSLEEVSLEDVDIFGKDVGDDPEDADISRKSASDDSRLEDADISGEGADDDSWPKDADISGKGAEDVDISGKGAGRLRMPTDSQVTIAKSGAVDKSKAFAPTYPQFVMRNSDLR

SEQ ID NO: 117876 - protein, 136 aa, Glycine max
  Coding DNA Sequence Number=SeqID_26191
MKFCNIPGVKKSIVTKKEGANSNQAHLGLLEGSNRRRCLLVEATLLAWASWVATTSLFSPINRGMRAEQIVQPFWYLRILSKLVRKIVSVKKNPSRGASVTLPRRFRERFPEDSSPFFVVLHHSSFVLHGFSVFNR

SEQ ID NO: 117877 - protein, 111 aa, Glycine max
  Coding DNA Sequence Number=SeqID_26192
MPSFRDWSRNDGQRLELCVELQWRMREKRMATQPDNLPSQHEPNPKREDVNVVMTRSKRIQEDSEKKEIFFPKVADGILTKKDKASRKVEVPTDENPVANKEGEKEVVTLP

SEQ ID NO: 117878 - protein, 294 aa, Glycine max
  Coding DNA Sequence Number=SeqID_26193
MEDLFKRWNEHLDSTRLRISQPPLTNCDFCGGEHYNDNCHLYSMNNFGWGWELSPYNQHEEEKTPSLESVFEEFMAYHASSKADQTSMKNHEFQFGKSYSIEDYQGGPELQPYNQNEAERGSNLDNLLMQFKETTESTQQAFKSAEIQVGQLAEEVTQFVARRKEDFVEVEAQEESPVKEHESREKDEEKGEEKVQQWEEYSTVENQQESFSKSIPFLINRLSRKKASKKQWKKNNLEKSFSSPLAKRTLRAKRHFLHAPSELLLALSALTPDHWLNILAKHICCAKPKRFSGI

SEQ ID NO: 117879 - protein, 140 aa, Glycine max
  Coding DNA Sequence Number=SeqID_26194
  Homolog annotation: Hit_ID=UPI0000ECBAF8; Match level="QueryCoverage =29%, HitCoverage=48%, E-value=1e-16, Identity=100%"; Hit description= UPI0000ECBAF8 related cluster
ERTRELPGGNAWYLIVLSGFATSDMSVDFCDARQGGGAYGKTPATRPLYADTARRSRTTERSESVSEEAEERPIRKPPLPARMQAWHWPSFYNVVTGKTLALPNLIALQHIPLSPAGVIAKRPAPIALPNSCAARMVNGG

SEQ ID NO: 117880 - protein, 52 aa, Glycine max
  Coding DNA Sequence Number=SeqID_26195
MAHQNPPYLAFCTPGQKETKNKIQGYQRETYKNIYIFLNDHQGMKGIVAFEN

SEQ ID NO: 117881 - protein, 97 aa, Glycine max
  Coding DNA Sequence Number=SeqID_26196
MSSRMHCTLVSSFVTGSQKVHITFLTAHMGHCAPECNIGGQNFHSLAYGVEPSSCFYEKVHQVKLKYGSNHLAKNWGKRWIELHRCFVYYQAHLGIL

SEQ ID NO: 117882 - protein, 157 aa, Glycine max
  Coding DNA Sequence Number=SeqID_26197
  Homolog annotation: Hit_ID=A6FJQ2; Match level="QueryCoverage=24%, HitCoverage=84%, E-value=3e-11, Identity=92%"; Hit description=50S ribosomal protein L5
MQLPGDGHSLSVSGCREQTSPSGRVSGCWRMRKEKIPHQAPFAIQAAQLLGRAIGAGLFAITPAGERGMCCKAIKLGNARVFPVTTLLFRKSIFGAADEIELKFMNSRETCRASCINESANARGEAVCVLGALPLPRSLTRCARSFGCGERYQLTQG

SEQ ID NO: 117883 - protein, 107 aa, Glycine max
  Coding DNA Sequence Number=SeqID_26198
MRKMLALKLIASNAFNTSELFGSRDEVLQWTQSLAHDIGFVVVIIRSYINTGVQGRILFLLIACERSGEYRPKKHKLLKKDEKIVVADMTKFHGEAKKYFVDVEGAQ

SEQ ID NO: 117884 - protein, 74 aa, Glycine max
  Coding DNA Sequence Number=SeqID_26199
MSEVEEAQEQMKADMEAMKEQMATMMEAMMSMKKIMEANAVTVAATSTVAKVNLLPPSDLNQMNHPTSDIRMTL

SEQ ID NO: 117885 - protein, 72 aa, Glycine max
  Coding DNA Sequence Number=SeqID_26200
MEVLLSPIALKVVGSLLLDSNSSSGTSKGYIYLGLTEIKRGYISCGSVLVEGTSTRVSKRTREGTSLVDLCL

SEQ ID NO: 117886 - protein, 96 aa, Glycine max
  Coding DNA Sequence Number=SeqID_26201
  Homolog annotation: Hit_ID=A6FJQ2; Match level="QueryCoverage=39%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARAVCVLGALPLPRSLTRCARSFGCASGISSLKGGNTVSTDQGYAGRH

SEQ ID NO: 117887 - protein, 53 aa, Glycine max
  Coding DNA Sequence Number=SeqID_26202
MEVMILHEIEAISKKLVRRVTVATYPFGERDRGHGVFPSLLRILNCDEEIRPM

SEQ ID NO: 117888 - protein, 74 aa, Glycine max
  Coding DNA Sequence Number=SeqID_26203
  Homolog annotation: Hit_ID=A6FJQ2; Match level="QueryCoverage=51%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGLVPYDDKINVYFLGPNLCFLVCNNYID

SEQ ID NO: 117889 - protein, 264 aa, Glycine max
  Coding DNA Sequence Number=SeqID_26204
  Gene Ontology: Mol. function=unspecific monooxygenase activity
  Homolog annotation: Hit_ID=UPI00006A2901; Match level="QueryCoverage =26%, HitCoverage=44%, E-value=1e-25, Identity=86%"; Hit description =UPI00006A2901 related cluster
RQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPNARTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 117890 - protein, 513 aa, Glycine max
  Coding DNA Sequence Number=SeqID_26205
  Gene Ontology: Mol. function=aldose 1-epimerase activity; Cellular component=cytoplasm; Biological process=carbohydrate metabolic process
  Homolog annotation: Hit_ID=A4W898; Match level="QueryCoverage=62%, HitCoverage=93%, E-value=1e-112, Identity=62%"; Hit description =Galactose mutarotase
  Pfam annotation: Domain name=Aldose_epim; Domain location=187-509; Score=362.4; E_value=7.4e-106; Accession=PF01263.11; Description =Aldose 1-epimerase
  Pfam annotation: Domain name=GHMP_kinases_C; Domain location=78-162; Score=57.2; E_value=5.8e-14; Accession=PF08544.4; Description=GHMP kinases C terminal
  Pfam module annotation: Pfam domain module=Aldose_epim::GHMP_kinases _C; Domain location=187-509::78-162
MPEDVAVVIINSNFRRNLVGSEYNTRREQCETGARFFNKKALRDVTLEEFAAAEQQLDPLVAKRVRHVITENARTLEAADALSSGDLQRMGELMAASHASMRDDFEITVPPIDQLVEIVKAEIGPRGGVRMTGGGFGGCIVALMPTELVDQVKAAVAQQYEAQTGIKETFYVCKASAGAGQCRGASPCCAIRNGMVATFMDWGATWLSARVPLQDGSVREALLGCATPSDYLHQDAYLGATIGRYANRIAFAELKPLNRLLAANQGPHQLHGGPQGFDKRRWQILSQSDSEVHYRLDSPDGDQGYPGNLIADVIYQLDDDNCLSIRYEAQTDQACPVNLTNHAYFNLDAHHGDARQHRLQLQADRYLPVDSAGIPNAPLKAVDGTSFDFRQPKRVADEFLADDDQRAVKGYDHAFLLTTVGDSSQPAAQLWSADDKLSVSVFTAAPALQFYSGNYLEGTRAREQGSYTAFQGIALESEFLPDSPNHSEWPQPDCWLQPGDTWHSVTRYRFTPH

SEQ ID NO: 117891 - protein, 137 aa, Glycine max
  Coding DNA Sequence Number=SeqID_26206
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
AVIIQLNGLVIGYIEQLTEMPQNVLYDAIGIYSTVGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 117892 - protein, 86 aa, Glycine max
  Coding DNA Sequence Number=SeqID_26207
MEVEEPWLGLWLPLNYRVDRGSSLAYDNGIWGEPYRLFAAKFLFVGVFGMAFVDNWVVGKEEEWQSQHGFLPLSHPLHLPQFSQSS

SEQ ID NO: 117893 - protein, 190 aa, Glycine max
  Coding DNA Sequence Number=SeqID_26208
  Homolog annotation: Hit_ID=A0ST23; Match level="QueryCoverage=13%, HitCoverage=51%, E-value=5e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGAKGGSTSRKVLVVVTGIVSSIIAILVIFVLVYCNKFRSKGGARYQLLFPLVRVNFELGVIMVIAVSFGKPVVPAALMNRPTRGERRFAYWALAECILAYYVGTDEGVSEVLHVAGEKGCT

SEQ ID NO: 117894 - protein, 69 aa, Glycine max
  Coding DNA Sequence Number=SeqID_26209
SAKRNTPRLSARKNPEKDELYRDQSMKQELASWYGKLNPLLDLPCSGTWSNSRVLDSVGLICRAFTRNQ

SEQ ID NO: 117895 - protein, 102 aa, Glycine max
  Coding DNA Sequence Number=SeqID_26210
MDDVATQQHSAQQPLRRSPPAEVLVGFCHHDIGITPPRHLVDPEKSNRVLGFPALITGPCQFYEVPITPDKVIRPLINQVFIKKYCAPKQAQGEAPQWPGDD

SEQ ID NO: 117896 - protein, 247 aa, Glycine max
  Coding DNA Sequence Number=SeqID_26211
MGSNQTPFLKKRFYQVKIKRLEVTSLLELRQLTGQLQRQAFRKAYRKCLGSRTQGLDWLLKLKATREEKAEALEERKEVQALKAELKKVQAVKEKFKSIAVKVRKEYDELKDVNTAATEALERETKRARKEEHGRNKFRRALWGSNKELKLRKEKRDQSRVDDMVFELKACLKSTRSLSQQLSEMEGNVMAIIAKYKEELNLATTHEHKLVDEYAKVENIITKRAPRHPYRTQSKSRTMVDLEKVHE

SEQ ID NO: 117897 - protein, 81 aa, Glycine max
  Coding DNA Sequence Number=SeqID_26212
  Homolog annotation: Hit_ID=UPI0000ECAFAB; Match level="QueryCoverage =39%, HitCoverage=39%, E-value=1e-11, Identity=100%"; Hit description= UPI0000ECAFAB related cluster
GRHRGGAPIRPIVSRIKIHWPSFYNVVTGKTLALPNLIALQHIPLSPAGRGGCGGYAQRDRYTLPALMSGGAFAVTAPPRQ

SEQ ID NO: 117898 - protein, 364 aa, Glycine max
  Coding DNA Sequence Number=SeqID_26213
  Pfam annotation: Domain name=zf-CCHC; Domain location=180-197; Score =19.0; E_value=0.002; Accession=PF00098.14; Description=Zinc knuckle
MSLHSSSSVNGEGSTPKDPLYKILDDLRSLKLWKEKQERKEKGKKRVEEISQDEREKIREEERRKIMKEMKREKHASYSSHNSCKSLSEELRDYYEGRHRSHLRPHSHRRENERKPQEVNIKLPYFHGKDNVEAYLDWEIRKDQGLGILGAALSKPNDDKGKTIEKQPPKASMQEKTSSIKCFKCLGRGHITSQCSTKKTMIVRSQDIYSSQDEATTSPSSSESEEAKGEESSEEIYPQEEGKPLIVKEECKEVSVSSKRLAKKERHFEIKTNIKEISLLKQPPHFLLCKKTLVSIATPLRLEFIPQVKELLDEGLVCKSLNPCALLVPKIGIIRHQIPKIGGMMNDLGGAHSFVKSLVHPTSS

SEQ ID NO: 117899 - protein, 195 aa, Glycine max
  Coding DNA Sequence Number=SeqID_26214
  Homolog annotation: Hit_ID=A5AX49; Match level="QueryCoverage=72%, HitCoverage=39%, E-value=3e-07, Identity=28%"; Hit description =Putative uncharacterized protein
MTDKRKVLGKNNEETRSYFTWNLEMERVLADVLRDQRNLSNKGDGGWKRSALNDAAAVLFTSFNVNVTSDNVKNRIKLWRSCDILGESGFDWDSTKHMITIENENAWNEYCTSHKSTKPVLIQDRATCHGVETVMDDDEVMSRETNEVKFMGLGATATIDLEEPSSNTKRRRGSLLRHHSHRGEKEDALLSEVSP

SEQ ID NO: 117900 - protein, 104 aa, Glycine max
  Coding DNA Sequence Number=SeqID_26215
MAYERGGDFLEDARKILNREAFPPGGSLVRSPVPAFRFTGVIPLLWPRLSHSTPDTQFRVGSSLQGWTVCTNPPFSPTAAPLSGNYRLESNPGKTCKSTTGSSH

SEQ ID NO: 117901 - protein, 203 aa, Glycine max
  Coding DNA Sequence Number=SeqID_26216
  Gene Ontology: Cellular component=mitochondrion
  Homolog annotation: Hit_ID=Q6R9A5; Match level="QueryCoverage=31%, HitCoverage=57%, E-value=3e-13, Identity=59%"; Hit description =Putative uncharacterized protein orf111-b
MTVTGEEAPANFVPAAAADRSVRGEIPGLNPGTAFDTVDLEYGRGTPVAKAAYWSITDAEVRKRGEQTGLDTLVVHAVNDESTRRTLPALDIRGMGIGDDVLQLGWPQNRGLPVISREEGGDDVKSSWPLRAGLHTCYNGGDSGQRDSDVELISKSHLSSDCTLQLECMKLESLVIADQHAACANRKEAANHGRVSDWGEVVT

SEQ ID NO: 117902 - protein, 117 aa, Glycine max
  Coding DNA Sequence Number=SeqID_26217
MTAETKFGRLHPCIIRGGGPMIRGDTFEAAGPMIRGDTLRLSAPFFHPEAAGPMTSRDQVWSFCTLVSSRGGGPDDTRRYLTVIRTLLSSRGGGPDDKQRPSLVILHPCIIQRRRAR

SEQ ID NO: 117903 - protein, 148 aa, Glycine max
  Coding DNA Sequence Number=SeqID_26218
  Gene Ontology: Mol. function=endonuclease activity
  Homolog annotation: Hit_ID=Q9AY32; Match level="QueryCoverage=42%, HitCoverage=95%, E-value=7e-27, Identity=96%"; Hit description=RRNA intron-encoded homing endonuclease
MVVTVKARSGPWVGSIGPPPVCTGRLVPSAGDALLSLTGRVVPPHGITPQDSDPIVLAFGIGVMINRDSRGHSYFIVRERKLGARRRSDTVLVSTINDADQGSADVAFRTPLAPYEKSKSLGSGGSMVARLKLKGIDGRAPPGVEPAA

SEQ ID NO: 117904 - protein, 107 aa, Glycine max
  Coding DNA Sequence Number=SeqID_26219
MTLAFRGLHVLAFRGLHTLTFRGLHILAFRGLNGLPFIGLHVFAIRGLHALTFNGLHVLNFRGLHVLPFQRATSPRLRRATHPHLQRTTHTHFQEWLHGPALSEDYN

SEQ ID NO: 117905 - protein, 17 aa, Glycine max
  Coding DNA Sequence Number=SeqID_26220
MADNRQPGPKPKVVKIP

SEQ ID NO: 117906 - protein, 15 aa, Glycine max
  Coding DNA Sequence Number=SeqID_26221
MNLVRGSRMTVAGCK

SEQ ID NO: 117907 - protein, 344 aa, Glycine max
  Coding DNA Sequence Number=SeqID_26222
  Homolog annotation: Hit_ID=Q2HW90; Match level="QueryCoverage=61%, HitCoverage=40%, E-value=8e-24, Identity=35%"; Hit description =Putative uncharacterized protein
MGTNQNGKRFYQVKVKGLDVTSLKELGRLMGPLQRQAFRKVYGKILDLTVAEVFTEAVVSLAQYYDQPLRCFTFGDFQMAKARDMASQEKWGPFADVLALLIFGVVLFPNVDGLVDLAAIDAFLAYHHSKESPVVAILADLFDTFDRRCEKNSARIVCCLPALCVWLISHLFRQDTRHPCPLQSYRSCIEKGRVDWDQHLAGIGGSMINWFPRWKEGKEGVFFSCVDYPNVPLIGTRGCINYNPALAIRQLGYPMRGAPTEESLSPFLVRDLGAQGLKVIQRIHEVWRSPLRKDKELRGIRNGVIGGYHGWLRIHTRGLDWLSKLKVIDEENFEARRKMKKSEL

SEQ ID NO: 117908 - protein, 37 aa, Glycine max
  Coding DNA Sequence Number=SeqID_26223
MGRSLMQSYPARALDRRLQVDWARDPREDPRVLMSLR

SEQ ID NO: 117909 - protein, 121 aa, Glycine max
  Coding DNA Sequence Number=SeqID_26224
  Gene Ontology: Mol. function=DNA binding
  Homolog annotation: Hit_ID=Q0TK69; Match level="QueryCoverage=37%, HitCoverage=21%, E-value=6e-18, Identity=100%"; Hit description =Putative uncharacterized protein
MSEIVRELSQLGWDDNKIGKELGMDSDEVLRLKQINGLQELFADRSSLSIPSTSRGGPVPAFVPFSEVGKPVVPAALMNRPTRGERRFAYWALAECILAYYVGTDEGVSEVLHVAGEKRLH

SEQ ID NO: 117910 - protein, 103 aa, Glycine max
  Coding DNA Sequence Number=SeqID_26225
MDPKSTLRLMRTVEPSLASLAQSSWSLLSNALGGVAPLNTQHIHHTTYHRDLVTHNTYFGHQQSTRILALTNQTIIQQLLYLRNNLKLKRYGSAKGCFPDRKR

SEQ ID NO: 117911 - protein, 71 aa, Glycine max
  Coding DNA Sequence Number=SeqID_26226
MEDMEHMLKLLSKIKVQKNHTFPMVYEHEYYDVKGLVLVEVMNQQLENDWEGALEGLKAELVEQSDVFGKP

SEQ ID NO: 117912 - protein, 118 aa, Glycine max
  Coding DNA Sequence Number=SeqID_26227
  Subcellular localization annotation: CTP_CleavageSite=67; ConfidenceScore=5.16e-01
MSFKESTPLCTRIGSLYGWTEGLSQTRFNSFFAGIPGSSSREEKRKRNSLLSSYSFSLPCGGLSGVYGGSDQSREEVFSDLPLRKQVGDANLWFLCFNRVPIAWMRLKPRDYFKKNSF

SEQ ID NO: 117913 - protein, 115 aa, Glycine max
  Coding DNA Sequence Number=SeqID_26228
NRTHKDTQWTRRSPTRPWGFQLWLRASVVLQGARSPRQGHIIIRIAPTGHPVDPKKSNRVLEFSMEYLSPPARASGPLLIKLSSRSTASPGRRRAKYHNSLGMAGSGQQTHRHHL

SEQ ID NO: 117914 - protein, 139 aa, Glycine max
  Coding DNA Sequence Number=SeqID_26229
MGEVEEVQEQMKADMEAMKEQMATMMEAMMSIKKIIEANAVAVATTSAVAKVNLMPPSGLNQMNHPTSNMVGKDLGKYGRPPIMRKFKTSMPSHHMWHTLPVRMSIIPLPYSLKADNLKLIMQMSLKPWERHMKFPTTI

SEQ ID NO: 117915 - protein, 170 aa, Glycine max
  Coding DNA Sequence Number=SeqID_26230
MYPPLFSLKPYWMYPPLELIHKRCTLSCSQSNPSRWYPTYTTKDVPSNVLRQRSQAVKPLILCEWGYKRILREWEESKEFSDCVILNSLTREKGDTKEFRRLVPCSFGKERKETQKEFRRLVLGEFFLAKGEENEKMNSTSFQGLENQKTSESFWYRRRRRRTSKRFQGL

SEQ ID NO: 117916 - protein, 157 aa, Glycine max
  Coding DNA Sequence Number=SeqID_26231
MDDQSEWTIQTLEDMLRVCVLDEGGSWDKFSFATGNLRCSGRSFTITIPVHEGSTVVHNIPLLHGQVKVGVEKDKDAEAVVPVPIDEVILVGQTLNTFLAWPTHLVKCLSEQLCLQQKLQIGRIMRSMIPIFDDIDHPTALFEAFPGYVGSYRVRGV

SEQ ID NO: 117917 - protein, 210 aa, Glycine max
  Coding DNA Sequence Number=SeqID_26232
  Homolog annotation: Hit_ID=A5BP71; Match level="QueryCoverage=35%, HitCoverage=19%, E-value=1e-08, Identity=41%"; Hit description =Putative uncharacterized protein
CGYVSMNYYQYIDVVYTNEHILKAYSAQWWPLGNEAAIPPSDEAWTLIPDPTTIRAKGRPKSTRIKNEMDWVEPSDHRQKCSRCGAAGHNRCRCPMQSDRGSLGVNILGFVPGSLWAMKNELVFSQHHQTIAGLQKYQCDDPEKDTHTFVSDTEQMLVACNTFHGHVPPFVGNILPLQQSPFVCLCPEFQHLTEVCETVVREIDALMHDH

SEQ ID NO: 117918 - protein, 77 aa, Glycine max
  Coding DNA Sequence Number=SeqID_26233
  Subcellular localization annotation: CTP_CleavageSite=54; ConfidenceScore=5.22e-01
MSKEARIVSQVNSISNHATRIIAPTISCGGTLFSSSTLFYVAINAATSALYAPTSMTATPINIIPTCHIATFLTHQV

SEQ ID NO: 117919 - protein, 125 aa, Glycine max
  Coding DNA Sequence Number=SeqID_26234
  Subcellular localization annotation: CTP_CleavageSite=44; ConfidenceScore=5.32e-01
MGSNQVQTFKKKVLSCQGQKSRSTQLAKVGAGDGSVSTNHRGVRGDLRMPDRRRKPYLLSYPNFVRGLLFDGMQPLADRLEGVQIATRTTWAFQIVPPEGGCFWRKQPGSPGRAGWQAPPLFSYK

SEQ ID NO: 117920 - protein, 143 aa, Glycine max
  Coding DNA Sequence Number=SeqID_26235
MYSKQNSITSYAVYLSTIDALGQCRFFVYPFKIFMYHSTGYIHFDVSLSELNVLSECHPLSEASTCLADRRNLEGNLSRRHALSASSARSASHLSPSRLSASLALSETSLTRSTRGFSIERCIVSLELDRAGLGYRMFGHGVW

SEQ ID NO: 117921 - protein, 335 aa, Glycine max
  Coding DNA Sequence Number=SeqID_26236
  Gene Ontology: Mol. function=endonuclease activity
  Homolog annotation: Hit_ID=A7PL80; Match level="QueryCoverage=49%, HitCoverage=25%, E-value=3e-47, Identity=60%"; Hit description =Chromosome chr7 scaffold_20, whole genome shotgun sequence
MESTPVNWEALDALLIDFAKSENLIEDSSAPSSSPSPSPSPSSSSYHSRLVIRQIRRAVETGAIDAAVALLRLHAPSILTDHKILFRLHKQGTAEDRDSAIECLRTALAPCALDAYPEAYEEFKHVLLAFIYDKDDKNSPVANEVLESWEATMTRLLACNVRVDLQVVARKQRAVWLEYSVKRARAAASLPGCSEKRIRFGTWNIGTLTGKSMEIVDVMVRRKINFMCLQETKWTGEKAKELDNSGFKLWYTGKIRSRNGIGIIVDKEWKKDVVDVGLAEHFKVKFWEDLEGVLQDIPQGEKVFLGGDLNGHVGSVARGFEGVHGGFGLGEMNGE

SEQ ID NO: 117922 - protein, 105 aa, Glycine max
  Coding DNA Sequence Number=SeqID_26237
MFALLGLLFCLWHLRSGGLTPTTNNFQVLTMPRTLRHLWAWRSLQREWAWSCKYNVEPIHPVEVRTDRGDHSDISFEEIEEYMELLWQLELTSKEDSDDPFEDKS

SEQ ID NO: 117923 - protein, 627 aa, Glycine max
  Coding DNA Sequence Number=SeqID_26238
  Gene Ontology: Mol. function=protein transporter activity; Cellular component=mitochondrial inner membrane; Biological process=protein transport
  Homolog annotation: Hit_ID=A7PL81; Match level="QueryCoverage=78%, HitCoverage=95%, E-value=1e-159, Identity=44%"; Hit description =Chromosome chr7 scaffold_20, whole genome shotgun sequence
  Pfam annotation: Domain name=PPR; Domain location=178-212; Score =34.8; E_value=3e-07; Accession=PF01535.11; Description=PPR repeat
  Pfam annotation: Domain name=PPR; Domain location=246-280; Score =25.4; E_value=0.00022; Accession=PF01535.11; Description=PPR repeat
  Pfam annotation: Domain name=PPR; Domain location=350-384; Score =37.9; E_value=3.5e-08; Accession=PF01535.11; Description=PPR repeat
  Pfam annotation: Domain name=PPR; Domain location=447-481; Score =41.5; E_value=3e-09; Accession=PF01535.11; Description=PPR repeat
  Pfam annotation: Domain name=PPR; Domain location=482-516; Score =14.7; E_value=0.14; Accession=PF01535.11; Description=PPR repeat
  Pfam annotation: Domain name=PPR; Domain location=518-552; Score=6.9; E_value=1.2; Accession=PF01535.11; Description=PPR repeat
  Pfam annotation: Domain name=PPR; Domain location=584-618; Score =12.9; E_value=0.23; Accession=PF01535.11; Description=PPR repeat
  Pfam module annotation: Pfam domain module=PPR::PPR::PPR::PPR::PPR::PP R::PPR; Domain location=178-212::246-280::350-384::447-481::482 -516::518-552::584-618
  Subcellular localization annotation: CTP_CleavageSite=76; ConfidenceScore=5.18e-01
MTMKHQTKPSNNKKKKNALIHVNPHTLIQLSAPSLQNPKPSKAAPPPDSPHRLTPQPFLRNQANPNLRRFQRPSFRSNTASPNFPPQRLRLHFNPLLPLQARPRAPMHPNLRGTEAKRRRPRWLSRFGSGRGVHKDVVVFGEESNLQVRNSVLDMYSKCGDVGSARQVFDEMSERDVFSWNSMMSGYVWNGLPHKAVEVLGVMKKDGCGCEPDVVTWNTVMDAYCRMGQCCEASRVFGEIEDPNVISWTILISGYAGVGRHDVSLGIFRQMVNVGMVSPDVDALSGVLVSCRHLGALASGKEIHGYGLKIMCGDVFYRSAGAALLMLYAGWGRLDCADNVFWRMDKSDVVTWNAMIFGLVDVGLVDLALDCFREMQGRGVGIDGRTISSILPVCDLRCGKEIHAYVRKCNFSGVIPVYNALIHMYSIRGCIAYAYSVFSTMVARDLVSWNTIIGGFGTHGLGQTALELLQEMSGSGVRPDLVTFSCALSACSHSGLVNEGIELFYRMTKDFSMTPAREHFSCVVDMLARAGRLEDAFHFINQMPQEPNNHVWGALLAACQEHQNISVGKLAAEKLISLEPHEAGHYVTLSNIYSRAGRWDDAARVRKMMDGHGLLKPSGHSLVGTGS

SEQ ID NO: 117924 - protein, 115 aa, Glycine max
  Coding DNA Sequence Number=SeqID_26239
MTGELGQAFGAVKGSCNCNLRFECKLQLPLATPIAGQLATTSGVFRATWLCPANSPLEVAVCYIIHAKKKKNYKRILITLITSTRMMRVDIPDMRRWITSSSMLGKTIYTSYLPC

SEQ ID NO: 117925 - protein, 71 aa, Glycine max
  Coding DNA Sequence Number=SeqID_26240
MKENNLRKLITTKKFYPLLAMNPKAVSLLDPVINQEANLLLAMNPKTVSLLSLVFNQEDLVLKYSHQESVS

SEQ ID NO: 117926 - protein, 41 aa, Glycine max
  Coding DNA Sequence Number=SeqID_26241
MIHTHMCYSNFNDIIHPIIDMDVDADVITIHTHISLDLQLR

SEQ ID NO: 117927 - protein, 211 aa, Glycine max
  Coding DNA Sequence Number=SeqID_26242
MEALFEKLHAYEHELIQQSHVEDIEKKRKGIALKASSLKEDHKEDSSDDEDAENLNLMVKKFGKFLKRSKDKKFSKSSKKEDNASTSSNSSSEEEIENVCLMVDSMDDYSTIEEIEVNSEFKEVLEAFNEMHEEVQKLVVFNNKLRSDLKWHITKLASTQSELDKLKQENEKLVSSYKATGCVCASTSLNMDYCKSLQDEFEKFKNDHDEE

SEQ ID NO: 117928 - protein, 88 aa, Glycine max
  Coding DNA Sequence Number=SeqID_26243
  Subcellular localization annotation: CTP_CleavageSite=57; ConfidenceScore=5.29e-01
MGQKSTLRLMRTLGPSSTALTQSSWSLLSNALGGRIASINQKRLQWIIPRATQGLTGASSKKGKCTESPPMFIRGKRQKNRKGVIYEL

SEQ ID NO: 117929 - protein, 142 aa, Glycine max
  Coding DNA Sequence Number=SeqID_26244
  Subcellular localization annotation: CTP_CleavageSite=53; ConfidenceScore=5.56e-01
MYRDKWAHTKPMDPKSTLRPMRTLRPMRTLGPSLASLAQSSWSLLSNVLGGVATSKVKAKFSKTKLISKSIESPKSLERAKEGYVFVLFWHVTFYEDNGAPGSAQGLGGQMTSSKPDETLQQVVAKILEVAHVVKDIEPKLF

SEQ ID NO: 117930 - protein, 153 aa, Glycine max
  Coding DNA Sequence Number=SeqID_26245
MGAKYLEVVKRKLHATKKWSPDEIRAGAGGDDPPYLDGAQRLLLDAMTEQMQRVTRQNNEELYGRIEGIENQLNHNVGGPNVDRRERFRDEEPEVDTWAEMRSYEKEICANQLQQDRASKTLAIEYVELEDQLHKVMHVKQQLKRTGAARRNS

SEQ ID NO: 117931 - protein, 145 aa, Glycine max
  Coding DNA Sequence Number=SeqID_26246
MGVSIRFNIDKGGVWEEVDMVLNGTRRREVGGFAKNVREVTEDKGNLWGCNEDEDSDALGLGKVLKLLAEAREGVNDDDKGDDKKLKDQSRTIQEVQDKNQEEFKTQEESLETRIKIQGSRSQESRSRFKTQDSRMKRRLNQDKY

SEQ ID NO: 117932 - protein, 326 aa, Glycine max
  Coding DNA Sequence Number=SeqID_26247
  Gene Ontology: Mol. function=nucleic acid binding
  Homolog annotation: Hit_ID=A7NX16; Match level="QueryCoverage=93%, HitCoverage=54%, E-value=7e-25, Identity=33%"; Hit description =Chromosome chr5 scaffold_2, whole genome shotgun sequence
MEECHLSVESFHSSGLFLASRKRSKLQQVIIGSKKFKKQTQETCSKSYVKLDSSFMNFISNMIKGCSQSTQDEDKSLALNLENPNHHLQQPDQKLLKCNKNEYLELKNAGFRSNFQSMVEAKFKNVGTRMSQIGEASKDFEPGTKVHGIDATPITFYAKNNSLYRQYLQSNKLEISEGRFDACPPRQPQIRPINSLNSHQHWKNNSTENENCYNLELTREKEGMALLSLHSPSTRQNRNDNENVESCAMYESKEMCHRSGNVEEDSTVLEDDKGNQYHTAKLNKFNSFTPFPGLRAAGLMVFVFARRLGALKRKHLVISIKWIIIY

SEQ ID NO: 117933 - protein, 268 aa, Glycine max
  Coding DNA Sequence Number=SeqID_26248
  Gene Ontology: Mol. function=inositol or phosphatidylinositol phosphatase activity; Cellular component=integral to membrane; Biological process=abscisic acid mediated signaling
  Homolog annotation: Hit_ID=A7QX67; Match level="QueryCoverage=66%, HitCoverage=29%, E-value=8e-41, Identity=50%"; Hit description =Chromosome undetermined scaffold_213, whole genome shotgun sequence
  Pfam annotation: Domain name=LRRNT_2; Domain location=224-260; Score =23.8; E_value=0.00065; Accession=PF08263.3; Description=Leucine rich repeat N-terminal domain
MEIEHYECGKRTWFGDKREEQAPIESNEFLPRLRRQKSVTSRSQYINKKELRVCVGTWNVGGKLPPDDLDIDDWLGINELADIYVLSLQEIVPLNPGNIFCVEDTRPRQKWENIIRDALNRVRSKAPKMKSFSDPPSPSKFKPSNDAPDIEEETLLESDGDIGEEVHPLDEEHNVYDGGANKPTTYEEALNTNFQASDVVDIANTKEPIGNDLKRQIYDGKRLSDALAVLKNSMSDPNNVLQSWNCTLVTPCTWFHVNCNSENSVTRV

SEQ ID NO: 117934 - protein, 62 aa, Glycine max
  Coding DNA Sequence Number=SeqID_26249
MSKWTLATDKDGVDDTVCEKYDIRRKSRPNFVRATKTLRGRMCERKHGPFRNKIVPSCVSRG

SEQ ID NO: 117935 - protein, 164 aa, Glycine max
  Coding DNA Sequence Number=SeqID_26250
MEEGDKHTRVFILVWQQPVPTSSPPMALEISFQPCKNPFTSQDPQGMYPPLFSLNNLVDSTTQVDVPSTCTTKDVPSNVLRQSSQAVKPLKLCEWGYKRILRREKGDTKEFGREKRMKRMNSTSFQGLENQKTLESFWQKEEEEEVQKDSKVVKDCIVKVVQDH

SEQ ID NO: 117936 - protein, 31 aa, Glycine max
  Coding DNA Sequence Number=SeqID_26251
MAHILTDLCVSSNSSWKCLTYIPHIGRALNI

SEQ ID NO: 117937 - protein, 155 aa, Glycine max
  Coding DNA Sequence Number=SeqID_26252
PTAKVLFGYLHVRTILSSGEHPAVRVRAPCVWRWQRRKHAQHHKAKVAGLEENHRKVKEDLAKAQMELARYMGPEFVRKLSPNYGGESSLKGKFVAHLQPTTMELDFAPSIAIDVDDLDKWDPFPPWETSFQNVGPSSSHAHGEGGNRKGKGVAP

SEQ ID NO: 117938 - protein, 380 aa, Glycine max
  Coding DNA Sequence Number=SeqID_26253
MSLTTSFANPRQYTSPPSFEFNLLAKEVIKHRGWLRLDGLSRVSMFSFPSSLLSGHMLRMCVAFLHVSLRERAHLKDGLHGLVGITSWRKFSGSVYLVFFIFTLERPLPSSLQLLVRIVTEVPYEASDNGSSFCERLMDPSSISEGSSRLHDGELREGAIVVKLGFRPEIGIVIVMKCPHPLPLLLPGDSRKMTIMACGEDEFLFMHVAPDCPSFYVYRWVMVKAFEILRPFFNIRPNIPVFPYFFQMKLTGKIGWVSLNNESKKMFEFDSNVFRKFRDRFLKVKATSIITDSLDHALNEYHLLSETSARLASKRNLEGNLPRKHEVSASSARPTSHLSLWALNGPGLLSQRSLTRAKRAFEDRMPFLKPGVKEKRELGR

SEQ ID NO: 117939 - protein, 169 aa, Glycine max
  Coding DNA Sequence Number=SeqID_26254
  Pfam annotation: Domain name=DUF217; Domain location=65-124; Score= -3.1; E_value=0.051; Accession=PF02697.5; Description=Uncharacterized ACR, COG1753
  Subcellular localization annotation: CTP_CleavageSite=53; ConfidenceScore=5.10e-01
MPIDFVSPFDKTLIQSVGVQNSSNVVKVFLHRSLTTLEENRQRHKEALTRITSLEYKVAKLRATARTIWVDDVFAKLVSIRLDGDEVFECCIDLLKEKNDLMSKTKLKESELKATKEKKANKQVRFFIEGLDLSFFDPFKDVKDGQLLNEDEIAAWEEDDGEKDDGANV

SEQ ID NO: 117940 - protein, 53 aa, Glycine max
  Coding DNA Sequence Number=SeqID_26255
  Subcellular localization annotation: CTP_CleavageSite=46; ConfidenceScore=5.18e-01
MAIETTMGSSWFIGLMPFKSLSCLVLSSPSLGGGMRGNCMGIFALKASSRMVA

SEQ ID NO: 117941 - protein, 229 aa, Glycine max
  Coding DNA Sequence Number=SeqID_26256
  Gene Ontology: Mol. function=aspartic-type endopeptidase activity; Biological process=RNA-dependent DNA replication
  Homolog annotation: Hit_ID=Q69F85; Match level="QueryCoverage=33%, HitCoverage=4%, E-value=2e-09, Identity=38%"; Hit description=Gag -pol polyprotein
MASDAASSSPRQPSILVEDTDEFTTMKITGVNPDIRSASNYSKLALDVPKETSTSLTRLMSIPRESGNPNRPAVNLPLGWKSLNLEHYDGTIDPDEHLDALLTQANLYTNDDAILCRFFPMSLKGSALMWYRGFPSRNLNPKVALHSMLQAPRLGKFTCSLWKKLPATWMSYRSEPRATFRWKKCRDSETKFDRLDKSTRKEKVAQRPTHTRWTSDTNWTRANHFKGDQ

SEQ ID NO: 117942 - protein, 147 aa, Glycine max
  Coding DNA Sequence Number=SeqID_26257
MSIVSNSALGLGGSDSRGSIRKPLVEWEVVPIVDSLSEEVPREVFDNIYSSFERLMDLGNVDEGSSGLRMGTESLEDQTSPESLETIKAVGRGDGDKVRVSPRNRHYRSDETPLSPPYIVGFKWVTGNILKYHSTITSSTSIGAQWR

SEQ ID NO: 117943 - protein, 31 aa, Glycine max
  Coding DNA Sequence Number=SeqID_26258
MSQEEAHHYAMDKSLKPTNPRSSPRFSTKCA

SEQ ID NO: 117944 - protein, 200 aa, Glycine max
  Coding DNA Sequence Number=SeqID_26259
MESMRWPGSRKKLPSFEHQEDTTPNQDRLFDLPHQVYRYPPPGERKGGPTKMDFGAQAIEESRKIPRVGKRGPNWEGLFRVVASLDKRAYKLQELGTLEARQTQGPSLVSLAKPRTNVFLVKSPKAHQTQGSSLVSLAKPRTNVFLVESPMAHQTQGPSMVSLTKPRTNVFLVESPKARQTQGPSSVGLSMPKIHPTRIF

SEQ ID NO: 117945 - protein, 62 aa, Glycine max
  Coding DNA Sequence Number=SeqID_26260
MSLSHPPFMSVWMRGVVIIHGIVGLIGVRFTVGALVDRVSSVMSNNLIIKTHIYQDLNSLTT

SEQ ID NO: 117946 - protein, 84 aa, Glycine max
  Coding DNA Sequence Number=SeqID_26261
LPEEPLTGLPEGSAVSLLSPFFPASSPLVFYPKVTILRGVRETNLVRGEEEDEVRACLAEKKKQFAEKGEEAVRGEGEEASRKE

SEQ ID NO: 117947 - protein, 63 aa, Glycine max
  Coding DNA Sequence Number=SeqID_26262
MGPILRQTCRRPAVTTRRHIFTADVTQDMMEHTNHLVLPASALNFLFGSKKYVPVQRPNGRRN

SEQ ID NO: 117948 - protein, 42 aa, Glycine max
  Coding DNA Sequence Number=SeqID_26263
MDKSLKVGEDELRERERKSTKFCAPNESTNPRSSPRFSTKYA

SEQ ID NO: 117949 - protein, 168 aa, Glycine max
  Coding DNA Sequence Number=SeqID_26264
MGTTPMRRWQMQREGYKRDDEVANATRTWKTRRRGCKRDVEREGEAYEVLGAHGRKINIKPLNQQHSLLNTKIVANNPNPSLPSLKTKVESPEHFEEASKLGDSGADTNAFQPTTPRGSPSSPNAKVLVTEGSKDDFKPTDLGHNPSVHYYKSNILRRGFNDGCKQPS

SEQ ID NO: 117950 - protein, 43 aa, Glycine max
  Coding DNA Sequence Number=SeqID_26265
MVRVFLGPMVAADFLPAWRKTMKAEKSWKLEVEVGSWKLEVGS

SEQ ID NO: 117951 - protein, 416 aa, Glycine max
  Coding DNA Sequence Number=SeqID_26266
  Homolog annotation: Hit_ID=A5B5G7; Match level="QueryCoverage=54%, HitCoverage=15%, E-value=1e-11, Identity=25%"; Hit description =Putative uncharacterized protein
MASRKRKTPSTPTQARFDRSRFTSQEAWERYTDIVVPRKILPERNVVVYYTEFEEFKEELERRHWDEELTDFLDDNIDVAIVKEFYANLYDPEDKSPKRVRVRGHVIKFDEDTLNTFLKTPVVMEEGQKLCAYSRFALLRPDPQELATKLYIPRRGFELNADGQPLKILRKNMTTLAQTWSVLSFSNLIPTSHTSDVTLDRAKLIYGIIMKMNMNMGYLISHQISLIAQHDTSRLGFPALITALCKARGVQSNSRSLESLSPAINLAYIKKNCWNFDDPIVTFRGPRKVRGKRFEVPTTSAPETLASSSTTAPLPPIQTPVIPPTPTQIPLPAPLSADVALHAPEHPQGAVYYHAKPSGLGLALHFEHGGEPDTKEPPAPVAAEEETTPDQTPQPSPSSAPTPEETQPSTLVVESE

SEQ ID NO: 117952 - protein, 99 aa, Glycine max
  Coding DNA Sequence Number=SeqID_26267
MYGSPSIAGNPDEANHVSASTSASGIISLLKEELDQKDRSTEKVKIDGENNHSTGDKETMEDDEEGNMEPDKPFNPRSNIAINLQLMIDGEDRGNTPSL

SEQ ID NO: 117953 - protein, 92 aa, Glycine max
  Coding DNA Sequence Number=SeqID_26268
  Subcellular localization annotation: CTP_CleavageSite=18; ConfidenceScore=5.18e-01
MVQLSAHRCAKTNIFTVSCTLSNGLSVHAALSAPSYAKPQIHSVVALSLNHSLLSAYCRKILGITESAKRRCRTKPQMLTKVYNFKLGLVQG

SEQ ID NO: 117954 - protein, 61 aa, Glycine max
  Coding DNA Sequence Number=SeqID_26269
MTFLDHYYFMNINFVSKHHQSELIAKQNMELCQEEMGLYIYVSLIKDTVKEYGIILLAALL

SEQ ID NO: 117955 - protein, 275 aa, Glycine max
  Coding DNA Sequence Number=SeqID_26270
  Subcellular localization annotation: CTP_CleavageSite=38; ConfidenceScore=5.32e-01
MTNRNLHNFLMQMSKISMLKASTRHNEGFKKQSTTAISTATSRETISAISHNIVMKVRSQFKTLDIITATERKRVNAKKIEAALNCLIQLLHAATHIAFIQKQQPPLLLANSSPSKFLKPPLPSSSSSSSSSITLKAANPFSPTCLTSSLASLFFILLLFQNFMKPLVLNVLNVVIVVRLSIAVRRDAFLLLRHRRILCYRYLVEAREGRGWGSRSSLGTRAMLRRQGQLRRWPWRQPSRAEGTRSAAMWKTHVNASLQRMMSSWDSVPLWREGS

SEQ ID NO: 117956 - protein, 91 aa, Glycine max
  Coding DNA Sequence Number=SeqID_26271
  Subcellular localization annotation: CTP_CleavageSite=19; ConfidenceScore=5.21e-01
MGRSVLSAKSKSIQPRTISTASFQALKFVPFSIGIEFTWAVTFAALRLLWQHNGSTNLIKNTGHAIKWKGSVMVKFATNCDSSKCLKNNTK

SEQ ID NO: 117957 - protein, 181 aa, Glycine max
  Coding DNA Sequence Number=SeqID_26272
MGGCPDLVGCPLCGKLEWLKNLSISEGMLRHFNSSIVMYLTTLMFHTLDVVYVHGGCSDLVGCPLCGKIEWLKNLNISEGMLRSFNSSMVMYLMLPMFIRRMLCMFMGGCADFVGCPLCGKLEWLKNLSISEGMLRGFNSSMVRYLMTPMVHASYDIGNSINCGSYFLGIGYGTYRIASES

SEQ ID NO: 117958 - protein, 152 aa, Glycine max
  Coding DNA Sequence Number=SeqID_26273
MSGHQRAASKTLAISRTLEGLRLFHELDGDEGADGAKASVAEARVEGVGGTAEDGEGEAVQQGVCAMKRGMTKVAKPISVPSSSHQLCSGPSKTGSMARKKTPSELREQEASGYAQDEEAADDQEETGWKYIHGDVFRFPKYKFFFSAALGS

SEQ ID NO: 117959 - protein, 39 aa, Glycine max
  Coding DNA Sequence Number=SeqID_26274
MVDEVVRVCLALRQETAPPANMKIRVHTWAYIKLPTADA

SEQ ID NO: 117960 - protein, 158 aa, Glycine max
  Coding DNA Sequence Number=SeqID_26275
MAFGTRAACPSELMLHPKVIGSPRRATAHPSKLVPLALSNLGAQASQKLVWNIVFGLMNMDARGDAVTMMDIPGGGNRVVKEFYASLEGDGLESLIIHGQCIDGAHVSYFILHENISHEGEYLYFGACHSIWNSLETQADHYGGELHVHEKVTSTLVA

SEQ ID NO: 117961 - protein, 204 aa, Glycine max
  Coding DNA Sequence Number=SeqID_26276
  Subcellular localization annotation: CTP_CleavageSite=44; ConfidenceScore=5.47e-01
MHIDIPPGSPPPESAPSPSMSKRTRKVTQLRSLSARPMGLERPLAHVDPNTRKVPVAQKDLIWKDNQDSLEEQDVLTIVIGQPEHPGRVRAAEGIVHPVMPKVAPSSAHVSTKRSCVDPLGQDPDTDASDMCGLYVDDNPPCRNMPFCGRAKARLTGALSKGGKMRGVVTNEGISTSHVDKSGAFAPTYPPSMRKSDLRSSFRK

SEQ ID NO: 117962 - protein, 84 aa, Glycine max
  Coding DNA Sequence Number=SeqID_26277
LATRPPGAERPVVNVDPTIGKADGPHKKKLRTYLGIVARDKVDVTYDTWKEVPTAQKDLIWENIQGEIKTFLFSLSMFLVFSFL

SEQ ID NO: 117963 - protein, 85 aa, Glycine max
  Coding DNA Sequence Number=SeqID_26278
MWNESAYLKLMISSLAMAIPRATRHLLRRPPLAQLANETDEFQAAQIANGTGETSATCQRQPKVANGADDLHVGLWKSLTMHLHI

SEQ ID NO: 117964 - protein, 121 aa, Glycine max
  Coding DNA Sequence Number=SeqID_26279
MLYGGGGDLWSPNRYWSWRFPPTKSPVKLAIHNEPAPASTSSATRLQPSEMPAILGKAHVAQLANQAGESHATQIANDTDETSVTCQRQSKVANGADDLHAIYVKNSLMQKIVSKEHHLQK

SEQ ID NO: 117965 - protein, 76 aa, Glycine max
  Coding DNA Sequence Number=SeqID_26280
MESRNKNVPVIVYYDAYVGDCDEGIEFKGENNVLVSMRRGMTFNVLKKIQPVTISDDEDIDGMFDVYNRYQCLSGF

SEQ ID NO: 117966 - protein, 67 aa, Glycine max
  Coding DNA Sequence Number=SeqID_26281
MKNKKVVVAGVSLSEACALSENHPLSEALSPLSKLGESAKHLRAQRIISSLSKSFVFSRAKRAQLAQ

SEQ ID NO: 117967 - protein, 258 aa, Glycine max
  Coding DNA Sequence Number=SeqID_26282
MDGHIDMALVKEFYSNLYDPKDKSPKQGAHRSSGACFQAPHSMGAGFNYTSPDLEYVIILQPRPNFSYVRFEYGQGKVSLWASYEHGHGHGLPHITPNFSDGLVQLLAARLPSPHHRFMRCPRRTRKAQARGSEGPSSSAPAPASTSAPASTDPAPSPSAPPSSILAYIHDSDQHRPIISMEDFMAQVAWPRVQPSPLGGGEAFTAQEPQPKPQMKVAPEATPKATPQASPVTTPGVEVSEEEDYAAYVDYAADMTVA

SEQ ID NO: 117968 - protein, 152 aa, Glycine max
  Coding DNA Sequence Number=SeqID_26283
MESKNENVHAVVYYDAYVADCDDGLEFKGGNNAITIRDDEDIYGMFDVYNQHQFLSGFQFLVQYEQQPSSTTNVKTTVQSPQIHKTPYTDYHTMITTIMTYNYFSNKHQLKMSIIHIQIELMLVTTKCPTTPTIVTSRAKRINPTHWLKGPH

SEQ ID NO: 117969 - protein, 24 aa, Glycine max
  Coding DNA Sequence Number=SeqID_26284
MVVVVMVGLVVNGDTSKIVNPYKF

SEQ ID NO: 117970 - protein, 96 aa, Glycine max
  Coding DNA Sequence Number=SeqID_26285
MYKQNQKDFLRLVVSLYWEQRMQLSFKAGESGGAATLLSESSGMIIKGGADGAGGGGRISTFREAGGSTTWWLRLSWCRLCPCWYGTVGHNLGRSS

SEQ ID NO: 117971 - protein, 210 aa, Glycine max
  Coding DNA Sequence Number=SeqID_26286
  Homolog annotation: Hit_ID=Q2HTA0; Match level="QueryCoverage=66%, HitCoverage=23%, E-value=1e-16, Identity=39%"; Hit description=IMP dehydrogenase/GMP reductase, related
  Pfam annotation: Domain name=DUF1723; Domain location=107-156; Score =59.9; E_value=8.5e-15; Accession=PF08330.1; Description=Protein of unknown function (DUF1723)
MSFLPLRLWLESEDVHHVDDVANEVFQQPQEAVVNAHGFLGGPHDTSVLIGYVDHVAVIVWNEEEHPELKLSSHERKVQKFERPAAKIEGLVAATRLSPLIACSLDTGDRGLISTFAERWHKETSSFHLPIGEVTITLDDVASLLHLPITGAFHSFETLHVDEAVLLLVELLEVSQMKPKLRQYSVMGHMYNYHGYETFIIANVMPHTGL

SEQ ID NO: 117972 - protein, 146 aa, Glycine max
  Coding DNA Sequence Number=SeqID_26287
  Gene Ontology: Mol. function=aspartic-type endopeptidase activity; Biological process=DNA integration
  Homolog annotation: Hit_ID=Q2QSQ2; Match level="QueryCoverage=54%, HitCoverage=6%, E-value=2e-09, Identity=37%"; Hit description =Retrotransposon protein, putative, Ty1-copia subclass
MFNTLKTDGEFGHFKLGNGTKMKVEGIGSVRMKLHDGAIHTFSNVRFVPSVIVNIISMGEMTSQGYKYVGSKWGCKKHKDNLCYLDGQALKRNHDSKVKKKGKFSTFVKCWEILSMDEEFVHFQIDRMIFLFWLEGECGVPKLMTS

SEQ ID NO: 117973 - protein, 85 aa, Glycine max
  Coding DNA Sequence Number=SeqID_26288
  Gene Ontology: Mol. function=secondary active sulfate transmembrane transporter activity; Cellular component=integral to membrane; Biological process=sulfate transport
  Homolog annotation: Hit_ID=A3B8B5; Match level="QueryCoverage=63%, HitCoverage=8%, E-value=7e-14, Identity=70%"; Hit description =Putative uncharacterized protein
MDLAVGPVSIASLVLGSMLTEEVSPNEQPHLFLQLGLTSTFFVGIFQAALGILSLVLSYPNFVWGPLLRGMQLVFGHFEVLGTHH

SEQ ID NO: 117974 - protein, 69 aa, Glycine max
  Coding DNA Sequence Number=SeqID_26289
YGAEVTFISRGNPDLLIVRDFHLKSLRSALSLWSSNYVPFFSRPHVGEASVTKEISFANIPLGIPPKRP

SEQ ID NO: 117975 - protein, 84 aa, Glycine max
  Coding DNA Sequence Number=SeqID_26290
MTKLGLCLSSGPPPLDDKRVRITIRMTKLGLCCQRTRLCLNGKGVRITVRMTKLGLCLPTDTTVSEWQRGADNRKVSSRIMCAE

SEQ ID NO: 117976 - protein, 24 aa, Glycine max
  Coding DNA Sequence Number=SeqID_26291
MAFKISKVFNGLAQDPTTLSYLSL

SEQ ID NO: 117977 - protein, 283 aa, Glycine max
  Coding DNA Sequence Number=SeqID_26292
PKYLDVEFFNDETFDCYQVFQNSGLVDFMSLKLPHYLELVKVFYCNLKIQDGIISSEVHGIPMIIDQSLFFSLTHLPSQGAPFEGTIVDDWKFDYSSHDARRMVCNDQAGMTAQASEEDLILMWAFLTGRQIDWAHLVRYRMHKALRVNAPLPYPQLITLFLRHFQIPLDDEPFVHVKRSFAIGVGAVTSFGYRKDQNGQWLKKGALPPQDERTPSPPPQREDSALLNEVLTELRGLRSYVGERFDSLDTHFAGMDIRLTQVEEDVSFIRTCFDPPPPPPSSS

SEQ ID NO: 117978 - protein, 99 aa, Glycine max
  Coding DNA Sequence Number=SeqID_26293
MCARHGEAPRRSIEHCRALKRKDFQVCTIIVNHSYNVKMDKVDIFVPHPLTNASLLIQLSPECGCKPLVCLLKRPVLLSLDFQDRSIRDYSSCALVGLP

SEQ ID NO: 117979 - protein, 62 aa, Glycine max
  Coding DNA Sequence Number=SeqID_26294
MTIICLYMSSGSPPLDDKKVQNDHNCLCVPSDTIVSKWQKGQYDRDCGAADKSEALTPTYPQ

SEQ ID NO: 117980 - protein, 113 aa, Glycine max
  Coding DNA Sequence Number=SeqID_26295
MNLAVYMGNQPRQNFNGQWRNHPGNQFNKDQGGPSNRPQQQGPSLYDQTTKLEETLAQFIQVSMSNPKSTESAIKNLEVQVRQLAKQLADRPSSSFGANTEKNPKEECKAVMT

SEQ ID NO: 117981 - protein, 35 aa, Glycine max
  Coding DNA Sequence Number=SeqID_26296
MGLPGHSHYHRLKGALKPGDPQGLHSEESVRVSPS

SEQ ID NO: 117982 - protein, 61 aa, Glycine max
  Coding DNA Sequence Number=SeqID_26297
MSVKNLVGRLGVHDNTNHTLASLVTLTSLKEHSNRVTPKAYTPKSLSGSLPPDSGPTHKTF

SEQ ID NO: 117983 - protein, 69 aa, Glycine max
  Coding DNA Sequence Number=SeqID_26298
  Gene Ontology: Biological process=transposition, DNA-mediated
  Homolog annotation: Hit_ID=Q1J7G7; Match level="QueryCoverage=43%, HitCoverage=42%, E-value=2e-10, Identity=100%"; Hit description =Transposase
LAQGFPVSTGTPDLFILRSDLPSQWLLFLSAVPPVQLLTGWCVTAKAPPDISAGKCSGHAARNHHTRRA

SEQ ID NO: 117984 - protein, 129 aa, Glycine max
  Coding DNA Sequence Number=SeqID_26299
MTSETKFGHSAPSTRRYLTVIRTPLPFRHSRVRWHAETKFGHSAPMIRGDTLRDQVWSFCTHDTRRYPTVIRTPLPFRHSRVRWHAETKFGHSAPMIRGDTLRLSAPLCHSDTVVSDGTQRPSLVILHP

SEQ ID NO: 117985 - protein, 78 aa, Glycine max
  Coding DNA Sequence Number=SeqID_26300
MRCRGARPGKLTYTFFFRGDISLGSSSSMDSFASWKMNGSGIEKEEGEETPLQGEDESRRSSPPQEAMDKSLEEEGDE

SEQ ID NO: 117986 - protein, 162 aa, Glycine max
  Coding DNA Sequence Number=SeqID_26301
  Homolog annotation: Hit_ID=A5B939; Match level="QueryCoverage=39%, HitCoverage=52%, E-value=6e-20, Identity=63%"; Hit description =Putative uncharacterized protein
LPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARIPTVPVYYPAKPQPRERAWRNQRGKKTLLSLTLVRLCEMTE

SEQ ID NO: 117987 - protein, 81 aa, Glycine max
  Coding DNA Sequence Number=SeqID_26302
MTVDVGQESPCGEGRRPMWRRTKAHVEKDKAPEWRRMKAQVEKDERPEAETLLRLLIVAEGPSGEGRRPMWRRTKPPSGEG

SEQ ID NO: 117988 - protein, 54 aa, Glycine max
  Coding DNA Sequence Number=SeqID_26303
FHIKQVHLKALMQTIEFKSWEFAWKPCSCAPKVRFSAEECHKLIKVLEAIIQES

SEQ ID NO: 117989 - protein, 162 aa, Glycine max
  Coding DNA Sequence Number=SeqID_26304
MSVHAAQLIADAIYLFAGMPPTRHPLEPDKSNRALGFPALITGLFQSFGVPVTPSKVIRPPITGAFIEKYCTPRQAQDVPPPPHQADPTGSFGMERISQQRQGFAPFACPTPDQFRAEVAWPGDWPDAQAGEAPAEALDDAKEARMDEEMIDLLGFLGWSGA

SEQ ID NO: 117990 - protein, 102 aa, Glycine max
  Coding DNA Sequence Number=SeqID_26305
  Homolog annotation: Hit_ID=Q84VI1; Match level="QueryCoverage=46%, HitCoverage=7%, E-value=8e-07, Identity=59%"; Hit description =Envelope-like protein
RAPEPAPGDLIDLEEVESDEEPVATYPSAGGRRETRGMRVPRKEYARSRHQRLFEENVGKTGKDAIYELLSERFGSCIYARGRVFPFAPTYSSIWDEKIRPT

SEQ ID NO: 117991 - protein, 118 aa, Glycine max
  Coding DNA Sequence Number=SeqID_26306
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=77%, HitCoverage=84%, E-value=2e-44, Identity=95%"; Hit description =Chromosome undetermined scaffold_79, whole genome shotgun sequence
  Pfam annotation: Domain name=Complex1_49kDa; Domain location=1-96; Score=-99.3; E_value=6.3e-06; Accession=PF00346.10; Description =Respiratory-chain NADH dehydrogenase,
MTTGSSVYSTSIHHFELYTEGFSVPAPSTYTAVEAPKGEFGVFLVSNGSNRPYRRKIRAPGSAHSQGLDSMSKHHMPADVVTIIGTQDIVSGEIGRVVSVGDGIARVYGLNEIQAGEM

SEQ ID NO: 117992 - protein, 121 aa, Glycine max
  Coding DNA Sequence Number=SeqID_26307
QGAPFEGTIVDDGMFDYSSHDARRMVCIDQILMPCSSTLAQASGEDLILMWAFLTGHPIDWAHLVHYCMHKALRSSAPLPYPQLPFVLVKCSFAIGTGAVTSLGYCKDVDGHWLKKDAQPP

SEQ ID NO: 117993 - protein, 126 aa, Glycine max
  Coding DNA Sequence Number=SeqID_26308
MTIICLRMSSGSPPLDDKRCRMTIICLCVPSDSIVSRCEKGVRMTIICLRVSSSSPPLDDKRCKMTIICLCVPSDSIVSGWRKGVQMTIICLRMSHDLRVRLWGGRQKRGSCSYVSSICDEELRPT

SEQ ID NO: 117994 - protein, 37 aa, Glycine max
  Coding DNA Sequence Number=SeqID_26309
MVSMNGIKGSWTPLKSLQEIWETQVGCMRTLELGVNS

SEQ ID NO: 117995 - protein, 109 aa, Glycine max
  Coding DNA Sequence Number=SeqID_26310
  Homolog annotation: Hit_ID=A0PAV3; Match level="QueryCoverage=34%, HitCoverage=20%, E-value=2e-07, Identity=68%"; Hit description =Restriction endonuclease
GTSYVPINVSFSPKVGPGLPGINRDTRIYLFCEVLQWLLFLSAVPPVQLLTGVVRNGKSTAGHQRWQAAQLLGRAIGAGLFAITPAGERGMCCKAIKLGNARVFPVTTL

SEQ ID NO: 117996 - protein, 114 aa, Glycine max
  Coding DNA Sequence Number=SeqID_26311
  Homolog annotation: Hit_ID=Q51617; Match level="QueryCoverage=35%, HitCoverage=59%, E-value=1e-14, Identity=95%"; Hit description =Putative uncharacterized protein
  Subcellular localization annotation: CTP_CleavageSite=36; ConfidenceScore=5.22e-01
MTVKTSDTCSSRRRSQLVCKRMPGADKPVRARQRVLAGVGAGLTMRHQSRLCVRRKYRIRRHSPFSCATVGKGDRCGPLRYYPAGERGMCCKAIKLVTPGFPSHDVVNRRPVNL

SEQ ID NO: 117997 - protein, 64 aa, Glycine max
  Coding DNA Sequence Number=SeqID_26312
MSVKNHLGHLGVHNKTHHTMGLSGLKEHSNPVTPKAYTPKSPSRPLPPNSGPTPKIILAYRLYL

SEQ ID NO: 117998 - protein, 160 aa, Glycine max
  Coding DNA Sequence Number=SeqID_26313
MSSGCLLVDPYGQNGVLLTSTTKVFCLCSVLLGCDSLCCVNVCFCLDVVEAWGGLMAHPGVERNEDMGYVGVRELSLEGGQQGRSGTWRYCRGGQETLGTSGGGAICPKPKLDQSPTQPRHSRSVKNPGMFPKTGELLAVNRKKGTKDHKARRLVVAGQL

SEQ ID NO: 117999 - protein, 239 aa, Glycine max
  Coding DNA Sequence Number=SeqID_26314
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLEDVVLRKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 118000 - protein, 69 aa, Glycine max
  Coding DNA Sequence Number=SeqID_26315
MGEVLNSRKPTRNPFAKRKPHAKHIFCHTLSGESLALTAQPLHLRLIWSAKLAKAELSPFQFDLNWAKR

SEQ ID NO: 118001 - protein, 88 aa, Glycine max
  Coding DNA Sequence Number=SeqID_26316
MAKLSKKSPVESPTVATYPSAGGRRETRGMRVPRKEYARSRHQRLFEENVGKTGKDAIYELFSEKVRELYLRTGKGVSLCSYVFLNLG

SEQ ID NO: 118002 - protein, 223 aa, Glycine max
  Coding DNA Sequence Number=SeqID_26317
  Homolog annotation: Hit_ID=Q2HW90; Match level="QueryCoverage=46%, HitCoverage=31%, E-value=8e-12, Identity=30%"; Hit description =Putative uncharacterized protein
MASQEEWVPFADIVALLIFGVVLFANVDGLVDLAAIDAFDRRVDWDQYLAGIGGNTINWFPRWKEGKEGVPFSCGDYPNIPLIGTRGCINYNPALAIRQLGYPMRGAPTEESLSPFLVRDFSVQSFKIVHRVHKAVHTRGLDWLSKLKIINEENFEAPEEDEEVQALKSELGKARLAKEKFKLVATDIRKECAGLREENAATTRALERETKRARKEEHGRDKF

SEQ ID NO: 118003 - protein, 168 aa, Glycine max
  Coding DNA Sequence Number=SeqID_26318
  Homolog annotation: Hit_ID=Q17063; Match level="QueryCoverage=60%, HitCoverage=93%, E-value=2e-07, Identity=41%"; Hit description =Hemolysin
MSTTGRGRHSVLRIFKGRRGRTGHHATCGALPAAGPYLRLSRFQVPFTWNLSPLRPSKFSFEYLLLPPRSAPTTAPPGLAPWVLQRPPRPPTHRGLVLAPTAGYRSRALAPSIFGLVIRQVSAQLGTVTQLPVHPASPVLLTKNGPLGALDSMARLNRAAAPSYLFKV

SEQ ID NO: 118004 - protein, 75 aa, Glycine max
  Coding DNA Sequence Number=SeqID_26319
MGSEIYPEVHENLSQRALLRASEARLAGAVSKGGKMRGVATNEGISTSHVDKSGAFAPTYPPSKRKSDLRSSFLS

SEQ ID NO: 118005 - protein, 303 aa, Glycine max
  Coding DNA Sequence Number=SeqID_26320
  Homolog annotation: Hit_ID=Q84VH5; Match level="QueryCoverage=99%, HitCoverage=48%, E-value=1e-116, Identity=69%"; Hit description =Envelope-like protein
  Subcellular localization annotation: CTP_CleavageSite=39; ConfidenceScore=5.56e-01
FLNTSQIFTKPLQKLCFSMATSPKETSAPGSPSIPSSPSSTKAPSNQEQPEFNIQPIQMIPGPAPVPEKLVPKRQQGVKNSENPSFATSPREEDTEMDKKIRNVPTSSTPNAEVLSSSSEEKSTEEEDQATEETPALRAPEPAPGDFIDLEEVESDEEPIAKKLAPGIAERLQSRKGKTPITRSGRIKTTAQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKT

SEQ ID NO: 118006 - protein, 104 aa, Glycine max
  Coding DNA Sequence Number=SeqID_26321
MVISWFSLRLVVSSKKERETRLKRAIKGINSRKHQQESSQGYCASNQWGKTHQMIMMMDGSNSHKGDEEKKNSLSCNGEEGMEKGKVLTNSLKELEEQWGISAY

SEQ ID NO: 118007 - protein, 147 aa, Glycine max
  Coding DNA Sequence Number=SeqID_26322
MGRLADDALSPEDEWLKTSLLRQPPHLLLCKRTLVSTAIPLELDVIPQVKELLDEDLVCKSLNPCALLVSKIGIIRHQIPKIGGIMNVLSSATLFCKVTHAPNIFMIRIHRNSLGIPTDSKRIKVIPEWPIGDQGSPIFFYTSSTTH

SEQ ID NO: 118008 - protein, 155 aa, Glycine max
  Coding DNA Sequence Number=SeqID_26323
MIRGDTLRLSAPLCHPEAAGPMIRGDTLRLSAPLCHPEAAGPMIRGDTLRLSAPFCHPEAAGPMIRGDTLRLSAPFCHPEAAGPMTSRDKIWSFCTLVSSRGGGPDDTRRYLTVIRTLVSSRGGGPDDTRKYPSGYPYKYSFAICKTERLIACRD

SEQ ID NO: 118009 - protein, 390 aa, Glycine max
  Coding DNA Sequence Number=SeqID_26324
MAPRKLASKRSRKDKAAEGTSSAPEYDSHRFRSAVHQQRFEAIKGWSFLRERRVQLRDDEYTDFQEEIGRRRWAPLVTPMAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFADSASRSESRCTYQVIRPPITRAFIEKYCTQRQAQGDAPQAAGAPPPPHQAGQAGAFDIEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 118010 - protein, 115 aa, Glycine max
  Coding DNA Sequence Number=SeqID_26325
  Homolog annotation: Hit_ID=A5BP71; Match level="QueryCoverage=65%, HitCoverage=19%, E-value=4e-10, Identity=46%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MVIIVNAEACGYVSMNYYQYIDVVYTNEHILKAYTAQWWPLGNEAAIPPSDEAWTLIPDPTTIRAKGRPKSTRIRNEMDSVEPSEHRTKCSRCGAEGHNRRRCPMQFEHGSCSNH

SEQ ID NO: 118011 - protein, 111 aa, Glycine max
  Coding DNA Sequence Number=SeqID_26326
MLPHTNTGGPSDNPKTVQANLSVSPHRKHVLIANHVPVLHNSSDLKETGNTEFGDPIEEGFVQVKTKHQKKGKKVQLIKTTRTEDMHANVQRGRNHKAITRVREASSRSNP

SEQ ID NO: 118012 - protein, 295 aa, Glycine max
  Coding DNA Sequence Number=SeqID_26327
MSPFLVRDFGAQNSKTIQRIHKAWETPLKKDQELRGIRNGIIGGYHEWMKVHIRGLDWLAKLKVVSKESFEAPEEDEEVQALKSELGKAKLAKEKFKLAATHVRKECAGLREENAITARALEQETKRARKEEYGRNKFRGALWGSNSELKLRKEERDQSRAHSMVLKEELVACSRSKRSLSQRLCETETNMLAIIAKYQEELSLATAHEHRVADEYAQVYVEKEARGRAIDSLHQEETMWMDRFAFTLNGSQELPRLLAKAKAMADTYSAPEEIHGLLGYCQHMIDLMAHIIRNR

SEQ ID NO: 118013 - protein, 86 aa, Glycine max
  Coding DNA Sequence Number=SeqID_26328
  Subcellular localization annotation: CTP_CleavageSite=28; ConfidenceScore=5.54e-01
MATQLNQAQSQNSKKLPSQTLQNPKNVSAITLRSGNQIQVPPPVVAPAPEPVKLHSTPKKEDKIVAQKRRLPDQGANKNFHAGGPS

SEQ ID NO: 118014 - protein, 122 aa, Glycine max
  Coding DNA Sequence Number=SeqID_26329
MSSIVCRDCARKTPSGPEEGQQGLGVASSKYGSLSVLGSACRPQQSHQAPLPIELSSEVLRPQAGAGRNTTAALGWPVASNRHTATTSRVHLSSSIKRHPAQDVKEALLGGNLVPFESMLVI

SEQ ID NO: 118015 - protein, 56 aa, Glycine max
  Coding DNA Sequence Number=SeqID_26330
MGEMLATQLAQASKVPSSRSNRLLEESSGGPKLHNHPFFDLRNVTEPHELCNDASF

SEQ ID NO: 118016 - protein, 87 aa, Glycine max
  Coding DNA Sequence Number=SeqID_26331
MTLCIPGQDFTRAAAKRRVWIMRTNMTTITKIWMMLLLSSIPSNDHNVDLPLWNSGYGPLLVLQGARSPQQGHAIMTYDAILSRKGI

SEQ ID NO: 118017 - protein, 131 aa, Glycine max
  Coding DNA Sequence Number=SeqID_26332
IRPSKVGMIPPSGIVPVAGEHKLQAVQLLQIVAQKGKGYQVNPMGISSLPSTSYHFLMNFVATSCITPLSNSITSVLQGKVAEGPQLFVVSGAVAVVVGAGLVEERMVCLGQQHFENKAIVVAAVVKDSTI

SEQ ID NO: 118018 - protein, 91 aa, Glycine max
  Coding DNA Sequence Number=SeqID_26333
  Homolog annotation: Hit_ID=A9MFJ8; Match level="QueryCoverage=64%, HitCoverage=71%, E-value=3e-09, Identity=55%"; Hit description =Putative uncharacterized protein
MRLVMKQNASTSAESQLSEYFQHAGSEYASEKEVIALIYKQLAAVKLRVSNKDIILALLERLESEHDVVQLDIYRQALELIVQRTPDDIAS

SEQ ID NO: 118019 - protein, 384 aa, Glycine max
  Coding DNA Sequence Number=SeqID_26334
  Gene Ontology: Mol. function=alkaline phosphatase activity; Cellular component=periplasmic space; Biological process=metabolic process
  Homolog annotation: Hit_ID=A6T5A8; Match level="QueryCoverage=99%, HitCoverage=80%, E-value=1e-158, Identity=73%"; Hit description =Alkaline phosphatase
  Pfam annotation: Domain name=Alk_phosphatase; Domain location=1-383; Score=608.8; E_value=5e-180; Accession=PF00245.11; Description =Alkaline phosphatase
MGAGGFFPGIDALPLTGQYTHYSLDKKTHKPNYVTDSAASATAWATGTKTYNGAIGVDVNGTDQVTLLELAKAAGKATGNVSTAELQDATPAALMAHVTSRKCYGPEKTSELCPGNALEQGGKGSISEQLLQTRPDVTLGGGAKSFAERAKAGDYQGKTLREQAEIRGFQLVDNLAALNAVQQANQHTPLLGLFSEGNMPVRWQGPKASYHGNLDKPVVTCEVNKDRPASMPTLAQMTQKAIDLLSHNDNGFFLQVEGASIDKQDHAASPCGQIGETVDLDEAVQVALAYAREHGDTLVVVTADHAHSSQIVENGTKAPGLTQALNTKDGAVMTISYGNSEEDSQEHTGTQLRIAAYGPHAANVVGLTDQTDLFFTLKQAMALK

SEQ ID NO: 118020 - protein, 188 aa, Glycine max
  Coding DNA Sequence Number=SeqID_26335
MTTLAPARSYPAVKSRGEDVKNFLTRQRARIDPQIYGFSRQNQRDNRQIGLRRRRSGTAGGGHRVSWYTCSGPAAAAALKAIIQYFRPARRVSASSVRQLPTPPAPAHAASTQAAFQFRNHPAKPFSMRRWSTAQSGQRLPHASPRRIFLWLVVQSPDCWYRHGWCSSDRALYQTPDAAPARRAPGRW

SEQ ID NO: 118021 - protein, 1020 aa, Glycine max
  Coding DNA Sequence Number=SeqID_26336
  Gene Ontology: Mol. function=mannonate dehydratase activity; Cellular component=membrane; Biological process=glucuronate catabolic process
  Homolog annotation: Hit_ID=A7ZVL9; Match level="QueryCoverage=24%, HitCoverage=62%, E-value=1e-105, Identity=75%"; Hit description =Mannonate dehydratase
  Pfam annotation: Domain name=UxuA; Domain location=776-1020; Score =342.3; E_value=8.2e-100; Accession=PF03786.4; Description=D -mannonate dehydratase (UxuA)
QAGFDVGRQAQAGIVKRLTHRFWLRHFVVVPVEHIALVIDGGIARRELEGVARNSVLFAQADEVHQLVLRVRRIGVVHGRAAVSQTPFGAEQRFAGQAYEGFGDIQHPLTDKQVVINIATLRLPAAIRLVIVIQLVTQIEPAGAEVIVEQAKADVVTPREGEGHMFVERIGGGGVVTHSIQITHLIAFAVALQIAGFFAQTVVAVVRHAALIVRHAVAVCVDLIGAGGAIAGQQLPVASGITRKAGQAKPGQAVARTPFPRNILFRRNAPGAVQTVVAVALDHHAEQTFFQHVQAQMVFAIDVKHHMEDCTDQVKEAHGDKQRVKADFVSRHANHQRKQEAGDPGKRAAHAIHRGHLALIKFFHHQRTQHAGNDLMTKTANRDQGNRDVGVFGHRHQRQRQHQKGAGDRAGDNGIYLPEAKQPGIDARQVAAGCTAEIRREERQPGEHGNLFQVHSQVFCQIERHPETQHAPCRFSHKSGNGDTVKTLVSGDGFQGFEKGQFDRRWLIILTNKGQLIAAEIRVTFRIAIQQPPQHHPAQSQTAGKQECALPAERGVGKVDDGRCQHSANREADAGPAGRDRTLFFREPFTNHFGVGRRGGRFSSAHDKAQDGQVQPAGGAGMEQTGQRPDGGADEEAEFEANDVNQPAADWLKEVDGDTGEKQHQHPPAQMTDDAFRAGCGNPWIQTAVHRILHSLLTACVSNVCDCLAGGGVHTGQRITLALDCRAWRDASCFTYPPGVNHSTFYDSESASLVKLVNQNGRALRMILRPAGENDMKQTWRWYGPNDPVSLADARQAGATGIVTALHHIPNGEVWPVEEILQRKAMIEAAGLVWSVVESVPIHEEIKTGSGQCQQWISNYQQSLRNLAQCGIHTVCYNFMPILDWTRTDLAFELPDGAKALRFDQIEFAVFELHILQRQGAENDYSADEIAEAAARFASMSEEHKLRLTRNIIAGLPGAEEGYTLAQFRAQLARYDGIDKARLREHFATFLRGIIPVAEEVGIRMAVHPDDPPRPILGLP

SEQ ID NO: 118022 - protein, 292 aa, Glycine max
  Coding DNA Sequence Number=SeqID_26337
  Gene Ontology: Mol. function=glucuronate isomerase activity; Biological process=glucuronate catabolic process
  Homolog annotation: Hit_ID=Q57JX8; Match level="QueryCoverage=100%, HitCoverage=62%, E-value=1e-132, Identity=77%"; Hit description =Uronate isomerase
  Pfam annotation: Domain name=UxaC; Domain location=1-292; Score =289.1; E_value=8.6e-84; Accession=PF02614.5; Description=Glucuronate isomerase
MPIYDYHCHLNPQEIAEDRQFANLGQIWLEGDHYKWRALRAAGVEESLITGNTTSDYDKYLAWAQTVPKTLGNPLYHWTHLELRRPFGITDTLFGPETAPRIWHECAEKLATPEFSARGIMRQMNVRMVGTTDDPIDSLQYHRQIAEDSSFDIEVAPSWRPDRVFKIELEGFSNYLTRLEAAADVSIDSFDALRVALLRRLDHFSAHDCRAADHGIETLRYAAVPADSVLDGILARRRSGAALSELEIAQFSTAVLVWLGAEYARRGWAMQLHIGAIRNNSTRMFRQLGPDS

SEQ ID NO: 118023 - protein, 468 aa, Glycine max
  Coding DNA Sequence Number=SeqID_26338
  Gene Ontology: Mol. function=protein binding; Cellular component =flagellin-based flagellum; Biological process=flagellum organization and biogenesis
  Homolog annotation: Hit_ID=A1JSR2; Match level="QueryCoverage=99%, HitCoverage=100%, E-value=1e-132, Identity=55%"; Hit description =Flagellar hook-associated protein 2
  Pfam annotation: Domain name=Flagellin_IN; Domain location=129-186; Score=38.1; E_value=3.2e-08; Accession=PF07196.4; Description =Flagellin hook IN motif
  Pfam annotation: Domain name=FliD_C; Domain location=223-454; Score =231.3; E_value=2.2e-66; Accession=PF07195.3; Description=Flagellar hook-associated protein 2 C
  Pfam annotation: Domain name=FliD_N; Domain location=10-107; Score =88.4; E_value=2.2e-23; Accession=PF02465.9; Description=Flagellar hook-associated protein 2 C
  Pfam module annotation: Pfam domain module=Flagellin_IN::FliD_C::FliD_ N; Domain location=129-186::223-454::10-107
MASVSNLNAGTNLGLSDLYDQLQTAEQANLTPITTQQTSYKAKLSAWGIVQTALQKVQTAAAALKDTSAIASTKVSSTNTAFTATLANDAAAGNFSVEVTQLAKTQSLLSKSATSKDADLGDSSQASRTITITQPGQKDPMTITLSKDQTSLTDIKDAINKQQGSVTASIIKSDDNTYYLALTSRDTGTTNEMTVSTDDSALAQYIGFTKGGGSNGMTEQVEAADAKLSINGVAITRSSNTITDAPEGVTLSLTKTNTGSPETLSVTKDNAPMIAAVQAYVDAYNSLQTTIGNQTKYTAVDQGSTSQDSSNGDLIGDGTLRNIQTSLRSKLSTSAQSGGSISLLSQIGITQDVNGKLTVDSTKLNKALDEKSADVVSFLSGDGKTTGFATQTSNYLDQILGTNGSVQNATDGINKTLKKLSDDYDRVNAQITATMARYKTQFTNLNTLVSSMTQTQNYLTQQFANMSS

SEQ ID NO: 118024 - protein, 231 aa, Glycine max
  Coding DNA Sequence Number=SeqID_26339
  Gene Ontology: Mol. function=transferase activity; Cellular component= nucleus; Biological process=gibberellic acid mediated signaling
  Homolog annotation: Hit_ID=A9ISX7; Match level="QueryCoverage=95%, HitCoverage=19%, E-value=3e-50, Identity=46%"; Hit description =Putative uncharacterized protein
MVMGVPVITLPGPTFAGRHSASHLVHAGMPELVAKDWEDYRKIAKELANDSENLALIRCHLREILLSSPVCDGKRFARHFSDAMRAVWQRYAENKLPESLSFDENEDVYFKGEESSVILNRPMKMDTSSFCDNESGFAFNLDGQVKALDYGGILARQDKFKAIMATNGTFMIIIDPLGMVEDHYLPLKRNSLQKIQMQLLGDGNDTQLYMCLDAKYSSDLTCNQRNFTARM

SEQ ID NO: 118025 - protein, 574 aa, Glycine max
  Coding DNA Sequence Number=SeqID_26340
  Gene Ontology: Mol. function=DNA-directed RNA polymerase activity; Cellular component=flagellum; Biological process=regulation of transcription, DNA-dependent
  Homolog annotation: Hit_ID=Q6D6E6; Match level="QueryCoverage=40%, HitCoverage=95%, E-value=1e-107, Identity=85%"; Hit description=RNA polymerase sigma factor for flagellar operon
  Pfam annotation: Domain name=Sigma70_r2; Domain location=236-309; Score=73.3; E_value=7.9e-19; Accession=PF04542.5; Description=Sigma -70 region 2
  Pfam annotation: Domain name=Sigma70_r3; Domain location=310-392; Score=66.4; E_value=9.9e-17; Accession=PF04539.7; Description=Sigma -70 region 3
  Pfam annotation: Domain name=Sigma70_r4; Domain location=405-454; Score=43.6; E_value=7.1e-10; Accession=PF04545.7; Description=Sigma -70, region 4
  Pfam annotation: Domain name=Sigma70_r4_2; Domain location=399-451; Score=25.0; E_value=0.00028; Accession=PF08281.3; Description=Sigma -70, region 4
  Pfam module annotation: Pfam domain module=Sigma70_r2::Sigma70 _r3::Sigma70_r4::Sigma70_r4_2; Domain location=236-309::310-392::405 -454::399-451
AFLYFRRNDEARKSGRWKVIGETRVYAMLDPRSAEAQNLLNSRGFKLVLMRQTEEDEYWQLFDPQAHPCFPLSRKIQFLVVLSTPQQKMPSAVIPGTEVGRRVKAKVFQRASQAEFSAAVKARYGACIITGTRLTERHSWPWVEACHIDTQENEEGFLADNSVDNGLFLRSDLQRLFINKMISIDAETGQVLFNSALECDESISPFYQALEGKTCALVVNVNDLYTADGVMDKHSLWQRYVPLVRHEALRLQVRLPASVELDDLLQAGGIGLLNAVERYDALQGTAFTTYAVQRIRGAMLDELRSRDWAPRSVRRNAREVAGAMHQVEQALGRAATEQEVAERLNVSLEEYRQILLDTNNSQLFSYDEYREEHGDSAELVTEGHEEANPLHQLMEGNLRERVIEAIEALPEREKLVLTLYYQEELNLKEIGAVLEVGESRVSQLHTMGAKVKARPLSRYLKDYKHSQSNCSHCGKVLDRMALVFRGQIINKEAIARMDQMIDDQVWMKLQPELTALCRFCSDIFCNTHPNYFDIMAFKQYLFEQTEMSHSTIREYVVRLRRLDDMLKAKNFPAE

SEQ ID NO: 118026 - protein, 243 aa, Glycine max
  Coding DNA Sequence Number=SeqID_26341
  Gene Ontology: Mol. function=transporter activity; Cellular component= outer membrane-bounded periplasmic space; Biological process=transport
  Homolog annotation: Hit_ID=A6TB70; Match level="QueryCoverage=100%, HitCoverage=100%, E-value=1e-101, Identity=72%"; Hit description =Cysteine transport protein
  Pfam annotation: Domain name=SBP_bac_3; Domain location=43-239; Score= 256.5; E_value=5.6e-74; Accession=PF00497.11; Description=Bacterial extracellular solute-binding proteins, family 3
MAFSPIRRQLVMGMMAVALVAGVNVKSFAAEDLLAQVKSKGELRVGLEGTYPPFSFQDENGKLTGFEVEFAQELAKHLGVKADLKPTKWDGMLASLDSKRIDVVINQALTLKKNAGSITKPEDLSGKKVGVGLGSNYEQWLRDNVKGVDIRTYDDDPTKYQDLRSGRVDAILVDRLAALDLVKKTGNTMAVAGPAFSRLEAGVALRKGNESLLKAIDGAIADMQKDGSLSKLSEKWFGADVTK

SEQ ID NO: 118027 - protein, 307 aa, Glycine max
  Coding DNA Sequence Number=SeqID_26342
  Gene Ontology: Mol. function=1-pyrroline-5-carboxylate dehydrogenase activity; Cellular component=mitochondrial matrix; Biological process=glutamate biosynthetic process
  Homolog annotation: Hit_ID=A4W940; Match level="QueryCoverage=99%, HitCoverage=23%, E-value=1e-120, Identity=71%"; Hit description=L -proline dehydrogenase / delta-1-pyrroline-5-carboxylate dehydrogenase
VSDLDKEVFGPVLHVVRFARNNLPQLIEQINASGYGLTLGVHTRIDETIAQVTAGAKVGNLYVNRNMVGAVVGVQPFGGEGLSGTGPKAGGPLYLYRLLAHRPDGALRITFDRQDAERPVDSSVRTTLLSAHQALQSWAQDKPELLALCQRYDALSQAGTVRLLPGPTGERNTFTLLPRDRVLCIADNQQDALIQLAAVTSVGSQALWQDDELHRTLRQSLPTAVQARITLAKDVLAAEFDAVIYHGDADQLRSLCEQIAAREGAIVSVQGFARGETNLLLERLLIERSLSVNTAAAGGNASLMTIG

SEQ ID NO: 118028 - protein, 1262 aa, Glycine max
  Coding DNA Sequence Number=SeqID_26343
  Gene Ontology: Mol. function=proline:sodium symporter activity; Cellular component=integral to membrane; Biological process=sodium ion transport
  Homolog annotation: Hit_ID=P10502; Match level="QueryCoverage=36%, HitCoverage=92%, E-value=0.0, Identity=78%"; Hit description =Sodium/proline symporter
  Pfam annotation: Domain name=Branch_AA_trans; Domain location=103 -455; Score=-334.9; E_value=0.034; Accession=PF05525.4; Description =Branched-chain amino acid transport protein
  Pfam annotation: Domain name=Dyp_perox; Domain location=1088-1262; Score=-55.8; E_value=1.2e-09; Accession=PF04261.3; Description=Dyp -type peroxidase family
  Pfam annotation: Domain name=FTR1; Domain location=477-752; Score =307.5; E_value=2.5e-89; Accession=PF03239.5; Description=Iron permease FTR1 family
  Pfam annotation: Domain name=Peptidase_M75; Domain location=885-1099; Score=247.1; E_value=3.9e-71; Accession=PF09375.1; Description =Imelysin
  Pfam annotation: Domain name=SSF; Domain location=18-420; Score =664.7; E_value=7.4e-197; Accession=PF00474.8; Description =Sodium:solute symporter family
  Pfam annotation: Domain name=Voltage_CLC; Domain location=178-454; Score=-175.2; E_value=0.029; Accession=PF00654.11; Description =Voltage gated chloride channel
  Pfam module annotation: Pfam domain module=Branch_AA_trans::Dyp _perox::FTR1::Peptidase_M75::SSF::Voltage_CLC; Domain location=103 -455::1088-1262::477-752::885-1099::18-420::178-454
MVLIGFIAYRSTKNFDDYILGGRSLGSVVTALSAGASDMSGWLLMGLPGAIFLSGISESWIAIGLTIGAWLNWKIVAGRLRVQTEHHNNALTLPDFFTSRFEDHSKILRVISALVILIFFTIYCASGVVAGARLFESTFGMSYETALWAGAAATILYTLVGGFLAVSWTDTVQASLMIFALILTPVIVIIAVGGLDDSLAVIEAKSLENLDMLKGLNFVAVISLLGWGLGYFGQPHILARFMAADSHRSIRTARRIGMAWMILCLAGAVAVGFFGIAYFQNHPDQAAGVSENGERVFIELARILFNPWIAGILLSAILAAVMSTLSCQLLVCSSALTEDLYKGFLRKNASQKELVWVGRLMVLVIALVSIALASNPENRVLGLVSYAWAGFGAAFGPVVLFGVCWKRMTRNGALAGMIIGAATVLIWKQYAWLNLYEIIPGFLFASIAIVVVSLAGREPSAEAQQRLPSLTFKRLVMFVPFLIMLREGLEAALIVSLIASYLKRTQRSQWFPAMWAGVFIAAALCLALGIFINETTGEFPQKQQELFEGIVAVIAVVILTSMVFWMRKVSRNIKATLEKSVDQALQKPGGSGLPLVLMVFLAVAREGLESVFFLLAAFTQDVGYAPPIGAVLGLATAIVLGMLIYYGGVRLNMAHFFRWTSLFILLVAAGLAAGAIRAFHEAGLWNHFQATAFDFSNTLSTHSIFGTLLEGILGYQEAPSVSEVAVWLIYLIPALLLFFFPARPAPSAARDMTMTIRFRRKALLLSMLALSGAASAAAVPQVTVTVTDKQCEPMSLNVQAGKTQFIIKNNSQKALEWEILKGVMVVEERENIAPGFSQKLTANLEAGEYDMTCGLLTNPKGKLVVSGDSQTASSGKPDVLQLVGPIADYKVYVMGEVSALVAGTKAFTDAVKAGDVEKAKALYAPTRVHYERIEPIAELFSDLDGSIDAREDDFEKKAEDPKFTGFHRLEKLLFADNTTKGADAFADQLYKDVQDLQTRVSELAFPPAKVVGGAAGLIEEVASSKISGEEDRYSRTDLSDFQANIDGAQKIVDLLRPLLQKANPQLLAKVDANFKKLTTSDRNALKGPITTLADLSLLRGTLRMLGGAAADAALCLSLPGRTGAGGTPSQLPPLDSGILGADIAPDNLTLTLSVGDSLFDERFGLAAHKPSQLQTMTRFPNDSLDAAQCHGDLLIQICANTQDTVIHALRDIIKHTPDLLAVRWRRDGFIADHAAFSKGRETPINLLGFKDGTAIRIPTMRS

SEQ ID NO: 118029 - protein, 231 aa, Glycine max
  Coding DNA Sequence Number=SeqID_26344
MIMRGQDIYSSQDKATTSPSSSESEKAKKEESSEEIYPQEEGQPLVVKEKCKEVSVSSKRLAKKETHFTIKTNIKETFPLRQPPHFLFCKKRLASIAKPPGLEFIPQVKKLLDEGLVRKSLNPCAFLVPIIGIIRHQVPKIGGMMNVLSGATFFCKITRAPNIFMVCVHRDPLGSDQGVPMNPKGIKVIPECPTPPSVKGRHREYQEPLDLRSNPFQGGGDDSILPPKGIG

SEQ ID NO: 118030 - protein, 32 aa, Glycine max
  Coding DNA Sequence Number=SeqID_26345
MEVTSPRVLDTRLQEDWVRAAKQDRRVLMNLR

SEQ ID NO: 118031 - protein, 204 aa, Glycine max
  Coding DNA Sequence Number=SeqID_26346
  Homolog annotation: Hit_ID=Q2HW90; Match level="QueryCoverage=73%, HitCoverage=30%, E-value=1e-19, Identity=36%"; Hit description =Putative uncharacterized protein
MEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNSIAGLPRKYLEDKARGMANQGDWVPFMDVLALLIFGVVLFPNVDGLVDLAAIDTFLAYHHNKESPVEVEQSIGSPDERKEMRESFSHVRVPKHSADRNEGLY

SEQ ID NO: 118032 - protein, 395 aa, Glycine max
  Coding DNA Sequence Number=SeqID_26347
  Homolog annotation: Hit_ID=Q6WAY6; Match level="QueryCoverage=31%, HitCoverage=21%, E-value=8e-13, Identity=33%"; Hit description =Putative uncharacterized protein
QNTRHPCPLQSHRSCAEKRGIDWDQLLAGIGGRTISWFPRWKEGKEGVLFSCGGYPNIPLIGTRGCINYTPALAIRQLGYPMRGAPMKESMSPFLVRDFGTQNFKAIQRIHKAWETPLRKDQELRGIRNGIIGGYHEWLKVHIRGLDWLAKLKVVSEDSFEAPEEDEEVQALINELGKAKLAKEKFKLAATHIRKECAELREENATTARALEQETKRARKEEYGRNKFCGALWGSNSELKLRREERDQSRAHSMVLKEELVACSRSKRSLSQRLCETETNMLAIIAMYQEKLSLATTHEHRVADEYAQVYAEKEARGRVIDSLHQEATMWMDRFALTLNGSQELPRLLAKAKAMADTYSAPEEIHGLLGYCQHMIDLMAHINLETARKLGWSLRS

SEQ ID NO: 118033 - protein, 102 aa, Glycine max
  Coding DNA Sequence Number=SeqID_26348
GVVLAEVLLADSRFTRPDMGFHPTKLNFVPSDADEAPLDVSICLHAFGIVGPIPSRLFVGDAGGFQMNVGGLVPPHCSLKSVVSDDACPGACFVQRDATTLS

SEQ ID NO: 118034 - protein, 88 aa, Glycine max
  Coding DNA Sequence Number=SeqID_26349
MSPVGSPTVATCPFAGERGRGSRVRCPKEERCAESPPKFICGKRRKNRRKPVKMKILSSEVVFTLEEGRQKRGFCSYVPTFGEEIRPT

SEQ ID NO: 118035 - protein, 88 aa, Glycine max
  Coding DNA Sequence Number=SeqID_26350
MKLAHKFEAVIAIFPYDSAVIDFGNLECGHPETLLILSLLTPKTLVNNPSEFNIHRKVESKPKAINIPCLKKQIAGAGSLDIQTCKNY

SEQ ID NO: 118036 - protein, 149 aa, Glycine max
  Coding DNA Sequence Number=SeqID_26351
MLLSSNVIYICVRVVMLVRMVRTLLFAAAQEPLKGKLLAPLPRSASLGLAFKGQRTLNSFKACSPLKARMCSPLEVRACSPLLARMCSPLQGEDVRACSPLMERTCSPLKARTCSPLNGEEVRACSLLMVRTYSPLKARTCSPLNGEGN

SEQ ID NO: 118037 - protein, 131 aa, Glycine max
  Coding DNA Sequence Number=SeqID_26352
MSRFATIVAEEWLTGIILGRWMLSSMLDPWGVLVAVGGIAHIAVLILKVFAYRLQNCTCVLPFRVVVRHNQHFIFLILSVCLFLNAQTCDQRLQREFFGLVSEKVFEILPARRQLVYDDSNLKLLIQCHTL

SEQ ID NO: 118038 - protein, 43 aa, Glycine max
  Coding DNA Sequence Number=SeqID_26353
MSDYETVRGTPCPDNTVSTSGVATGALLLNLSLGHMQGVRRYH

SEQ ID NO: 118039 - protein, 212 aa, Glycine max
  Coding DNA Sequence Number=SeqID_26354
MEEGFSHGSVPIILGRPFMKIAQTKIDVYAGTLSMEFGDIVVHFNILDAMKHPSEDHSIFRAEIIDQIVDDYMFDFDSVLNGRKHPFLSDLHTCHSLCIKYESEFEFDLVSDFYAKSEIEFESGVVPLDVDILESKCTNHVAGSTYTYDLLYAVQAEEPSSSPTLVPPTVQPPPTPELKPLPATLKYAYLEDKFLVIIFASLDAEQEENLLL

SEQ ID NO: 118040 - protein, 75 aa, Glycine max
  Coding DNA Sequence Number=SeqID_26355
FLQKAVASGGSNPARLGELELAWGELGGKKILSRGAFRNGFRNVFREEFRKGFRPFFNVLHSFFIRSSSFFDLQR

SEQ ID NO: 118041 - protein, 150 aa, Glycine max
  Coding DNA Sequence Number=SeqID_26356
IYSELWNPQALGKILSNIGSPIRSDHLTASKGSISFARALVEVDASLELIDEMIGHRLTNCKTVTANKPVLIRACPTLDQPQVGDSAMPPHTNTAGPSDNPKNVQTNLSVPPHRKHVLVANHVPVLQNSSDLKETGNTELDDPIEEGFVQ

SEQ ID NO: 118042 - protein, 212 aa, Glycine max
  Coding DNA Sequence Number=SeqID_26357
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=82%, HitCoverage=16%, E-value=3e-94, Identity=98%"; Hit description=DNA -directed RNA polymerase subunit beta
  Pfam annotation: Domain name=RNA_pol_Rpb2_1; Domain location=14-198; Score=135.9; E_value=1.2e-37; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARGQKKMPFWSFIDNLLVLVEIQYFLNLYVKNYKKNFFNKDVN

SEQ ID NO: 118043 - protein, 156 aa, Glycine max
  Coding DNA Sequence Number=SeqID_26358
MPISPCGRIAPTRHPVDPEKSSRALRFPALVTGFYQSYRVLIPPARSCHRDIGIVPARHPVDSEKTNRVLGFPALITGLCQFYGVLVAPNKKYCAPQTGAGRDTTAAWGWPKASNRRTAATSKTPQLIYKSWSVAYDPCSTSRRPSPKPKVIVGHT

SEQ ID NO: 118044 - protein, 222 aa, Glycine max
  Coding DNA Sequence Number=SeqID_26359
  Homolog annotation: Hit_ID=Q2HW90; Match level="QueryCoverage=94%, HitCoverage=42%, E-value=4e-23, Identity=33%"; Hit description =Putative uncharacterized protein
MGTNQNGKRFYQVKVKSLDVTSLKELGRLMGPLQRQAFRKVYGKILDLIATEVFTEAVVSLAQYYDHPLRCFTFGDFQMVPTIEEFEEILGCPLGGRKPYLFSGFLPSLSKIAAVVGDSTKKLDRMRQTRNSVVGLPRKYLEGKARDMASQEKWGPFADILALLIFGVVLFPNVGGLVDLAAIDAFLAYHHSKESLVVAILTDLFDTFDRRCEKNSARIVCC

SEQ ID NO: 118045 - protein, 173 aa, Glycine max
  Coding DNA Sequence Number=SeqID_26360
MSQKGSKKPHRERKNKEKKFKSKCPDLDKSAHMKKFFKPEDMKVLMSTWEELDNTSSDEEIKEEEEANLCVMVALHRKGLKKSLKFSNDKLKQYEAFQKQPQDVVTLHREIEFLRETLSKFVGITEKLNKMLRYPKCLIVKFGNGYTGKNYAHEEETIVCYFYAKGWTHDIQV

SEQ ID NO: 118046 - protein, 96 aa, Glycine max
  Coding DNA Sequence Number=SeqID_26361
EDAAVNCFTAVGAWRQGEQKADNAAVNCFTAVGAWRQGEQKADVTIHDVGYNVQDILPENTGVAAQCTRQDKRIEAAGSTMSDTMSRTSCPKILDT

SEQ ID NO: 118047 - protein, 74 aa, Glycine max
  Coding DNA Sequence Number=SeqID_26362
  Subcellular localization annotation: CTP_CleavageSite=53; ConfidenceScore=5.05e-01
MAYTHIPDSQAILLKFQPARINWTLHLMLQGPTMLNRMPRGSSMITIHCVRVVSSEKWRLRKPSRGYGYHCSIK

SEQ ID NO: 118048 - protein, 91 aa, Glycine max
  Coding DNA Sequence Number=SeqID_26363
MSGFTRNSPQISASPHQLDLAPYASEPYHAQWNAPGLLRDKHTLRSSRILREMEVDEPWLGLWLPLNYQVDMGASQHRTLELGWCSSLEVR

SEQ ID NO: 118049 - protein, 23 aa, Glycine max
  Coding DNA Sequence Number=SeqID_26364
FEKHVILWHHQNIQLDPLSTCSN

SEQ ID NO: 118050 - protein, 207 aa, Glycine max
  Coding DNA Sequence Number=SeqID_26365
  Gene Ontology: Biological process=transposition, DNA-mediated
  Homolog annotation: Hit_ID=Q1J7G7; Match level="QueryCoverage=19%, HitCoverage=71%, E-value=5e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPASQVIKLIDTVDLEGGPVGKPVVPAALMNRPTRGERRFAYWALAECILAYYVGTDEGVSEVLHVAGEKGCTGASAEYVIQDIFRFLAH

SEQ ID NO: 118051 - protein, 36 aa, Glycine max
  Coding DNA Sequence Number=SeqID_26366
MGIEDQKISFELFDEERILLDQNVGLEVKESEEKHV

SEQ ID NO: 118052 - protein, 158 aa, Glycine max
  Coding DNA Sequence Number=SeqID_26367
PFHPGLFVGDAGGFQSPTREPLNVGGLVPPHCSLKSVVSDDACPGACFVQRDATTLSSACCFDDHDNSSDRTAFVPATHHSNFCPITFDVKKLVVGPWVGSIGPPPVCTGRLVPSAGDALLSLTGRVVPPDSDPIVLAFGIGVMINRDSRGHSYFIVR

SEQ ID NO: 118053 - protein, 135 aa, Glycine max
  Coding DNA Sequence Number=SeqID_26368
  Subcellular localization annotation: CTP_CleavageSite=16; ConfidenceScore=5.18e-01
MHQSPSLLLPSWPSMLCSVASKCWTKLLLDLEQAANSSFKTKPCTRDWSLSSLRSLSSLLLPHKAPRNLSRPYSSLRALLVSRSRALAVATFSSRNLAHSFRMCRNLPFGGRATRDSRDACSTKGIRAESPPTFI

SEQ ID NO: 118054 - protein, 174 aa, Glycine max
  Coding DNA Sequence Number=SeqID_26369
GAEIDREFRDLNLAIEMRPKSLFVGALQITNEFVDHIREAQENDPFLQGKVLDVMGDKDVEFEKDTTGWSRLSYPECTNRHSKSLPKTVDMMLCGLIDSPNAQFFPVEYEVLRSGKLGVVHQGSSEGSEVHFAILDKSTSWGQSFEAFQLDHRVLKCRVRQGTQYEATKMDGVP

SEQ ID NO: 118055 - protein, 69 aa, Glycine max
  Coding DNA Sequence Number=SeqID_26370
GGGCRPARPGELSSPRRAGLLPPEATAFWRNLLEGPNGPGFGFSPILKFGGEGGFGIADNCPVPAPAPH

SEQ ID NO: 118056 - protein, 144 aa, Glycine max
  Coding DNA Sequence Number=SeqID_26371
  Gene Ontology: Mol. function=ARF GTPase activator activity; Biological process=regulation of ARF GTPase activity
  Homolog annotation: Hit_ID=A7P3Q5; Match level="QueryCoverage=88%, HitCoverage=87%, E-value=2e-48, Identity=66%"; Hit description =Chromosome chr1 scaffold_5, whole genome shotgun sequence
  Pfam annotation: Domain name=C2; Domain location=4-61; Score=17.7; E _value=0.0031; Accession=PF00168.21; Description=C2 domain
MEERDWHRELYKLKTRVVKNNCNPDWNEELTLSVKDVKTPIHLTVYDKDTFSVDDKMGEAEIDLKPYVQCKQMGLGKLPNGCSLKRIQPDRTNYLAEESSCIWQNGKIVQEMFLRLRNVESGEILVEIEWVDVVGCKGLSEVEL

SEQ ID NO: 118057 - protein, 62 aa, Glycine max
  Coding DNA Sequence Number=SeqID_26372
MDPKRIKVILEWPTPPSVEEKIHEFQEPSGFEDKVSAYTSSSSEFSEEAQKGKTSEELPSED

SEQ ID NO: 118058 - protein, 110 aa, Glycine max
  Coding DNA Sequence Number=SeqID_26373
MASNLTHIVFKPGNRLHPVVIDYQRPSWPPVFIFKPCNRLPTLGNRLPETIPHIPIKVHSWPATTSLLALWSLFLLSVDCQELACLGTSQVLTDRLCPGWSGLVRLGFGQ

SEQ ID NO: 118059 - protein, 50 aa, Glycine max
  Coding DNA Sequence Number=SeqID_26374
GADNRKGADNRKGADNRKGQYDKDYGAADKSKALAPTYPPMRNSDLRSSG

SEQ ID NO: 118060 - protein, 46 aa, Glycine max
  Coding DNA Sequence Number=SeqID_26375
MAGGKIGGEGFRESERLQVQGSVVIDYTNMVIDYQRTILPEITACN

SEQ ID NO: 118061 - protein, 96 aa, Glycine max
  Coding DNA Sequence Number=SeqID_26376
MVVILPKGTLSCLGLDDAPQPKSKAPARWIVVKCNRQKGTTECGYYVMHWMSTIILGTFTNNWEAYFNDPRPLEPERLKALRIQWAQFYLRIRDQA

SEQ ID NO: 118062 - protein, 188 aa, Glycine max
  Coding DNA Sequence Number=SeqID_26377
MSASSDGDFSSLTSYPELRRSEFLIGGYAAGPMIRGDTLRLSAPFCHPEAAGPMTSRDQVWSFCTLVSSRGGGPDDTRRYLTVIRTLLSSRGGRPDDKQRPKTKFGHSAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 118063 - protein, 61 aa, Glycine max
  Coding DNA Sequence Number=SeqID_26378
MWFNFSFRLKDEEEEGEALSSLSELGESKRESVILARAQCAISSLSESFVFSRAQRAQLAK

SEQ ID NO: 118064 - protein, 59 aa, Glycine max
  Coding DNA Sequence Number=SeqID_26379
MSEWIVIIKKGEIVEAMASKVILMMPNNQELSKVSSKDSRIKFHDSRLKNQVSRINIQE

SEQ ID NO: 118065 - protein, 83 aa, Glycine max
  Coding DNA Sequence Number=SeqID_26380
LIADAAVRAWRQGEQKADVTKAGVAARDVQRYDKESDWAAQCTRQDKMSNEELKLQDPRCRIRCPGHPARKYWTHKSVISLTD

SEQ ID NO: 118066 - protein, 136 aa, Glycine max
  Coding DNA Sequence Number=SeqID_26381
  Subcellular localization annotation: CTP_CleavageSite=55; ConfidenceScore=5.13e-01
MQSEEKKVPPTPKALVICFTRKGTGSRPMYPPTAPKPTPFAYQSNKAVPWKYTPRAFGERVATEVDSLSAKVTNITGLSGVTRSGRVFTPPHSAELPSKGKAPMIQEPTDVATPSKEVDSPVVKGAEKKDGLQGQA

SEQ ID NO: 118067 - protein, 233 aa, Glycine max
  Coding DNA Sequence Number=SeqID_26382
  Homolog annotation: Hit_ID=A4APM1; Match level="QueryCoverage=97%, HitCoverage=53%, E-value=4e-90, Identity=67%"; Hit description =Putative uncharacterized protein
DWGDVQPEHDWGVHLDENSHIALDIYDNAMFLIALDNYMDLLPEKKEKWGKIRASIASNTMKHLWDEKNQKFIPHIYIKGSPFAADFDENQIYYHGGTAIAIEANLLSKEQIKVSLDKMIKNVKDAGAATIGLTVYPTYPAGSFKNKGMYPYGYQNGGDWTWFGGRMIQQLVKNGFQQEAYEQIQPMLARVIKNKGFYEWYTKDNKPEGSGTFRGEAGVLYDAIELLEGAGKK

SEQ ID NO: 118068 - protein, 111 aa, Glycine max
  Coding DNA Sequence Number=SeqID_26383
  Subcellular localization annotation: CTP_CleavageSite=69; ConfidenceScore=5.13e-01
MGQTPANTHGTHQYAQHHPSFSAHAGNASSSTPVQPDEVHKDPQRLCSEGCRVLSPDPRRAPTQARSPSSNIAASPIFLEGPPVIPTRQGGSSISEETIEGRKDFIPVPMT

SEQ ID NO: 118069 - protein, 142 aa, Glycine max
  Coding DNA Sequence Number=SeqID_26384
  Homolog annotation: Hit_ID=Q2HVN2; Match level="QueryCoverage=54%, HitCoverage=23%, E-value=4e-07, Identity=35%"; Hit description =Putative uncharacterized protein
MRWKIVGGDKVRLWEDKWNQQQQPLAERYPRLYQISTQQNQIIRHMGQHMQSGWEWQFLWRRSLFENEIESTVNFLKDIEGSAMSFLQRSCRGGISLVLPLRLYPTNLVGIDVMAELTNCLSSWAETEFSTAYIYPGSRIKE

SEQ ID NO: 118070 - protein, 63 aa, Glycine max
  Coding DNA Sequence Number=SeqID_26385
MKDKWNVHESHSMLVQEETRLKNQGSHRVHYRFLTIQTISLNEKFIFMGNRVRLQCKQSILIA

SEQ ID NO: 118071 - protein, 66 aa, Glycine max
  Coding DNA Sequence Number=SeqID_26386
VANSDDEGSTDLRTNPLQEGWDDEIIPRRGPITRAMARRLQEDWARDAGEDPRVLMSLRVNFGPMG

SEQ ID NO: 118072 - protein, 111 aa, Glycine max
  Coding DNA Sequence Number=SeqID_26387
MDENIISKVMDKTPQASNVAPTNEGEPSVVIIYSTSSAPIPLNYVPLIVVTKEQVQEMIGSDDHAGSCVAPTSMPTLVPPTLEPTPSSIEQTPPPPPSSPPLTQLPSPPQV

SEQ ID NO: 118073 - protein, 81 aa, Glycine max
  Coding DNA Sequence Number=SeqID_26388
MIITKDDDKGDDKKLKDQSKNNSSESRRIQEFKIESRRRKLRVKNQDSRFKISRIKIKIQDSRKGLIKISMKSFSQKLSST

SEQ ID NO: 118074 - protein, 57 aa, Glycine max
  Coding DNA Sequence Number=SeqID_26389
MRHVKHEGHAQRLHQIAMQGERLRRSEKLKKRRKMQKGEKEEEKEKSRHCQIESRIV

SEQ ID NO: 118075 - protein, 129 aa, Glycine max
  Coding DNA Sequence Number=SeqID_26390
MVGYTPSSFADLVFASERIEVGLKRGKVNHPAWTNEKTGANEEGENEGETHAATVVPTWKIPHQLNNIITQPISALLITHHAVIHKAITPARVPQPPFFRGYDLNATCAYHGGVPRHSIEHCMTSKRKV

SEQ ID NO: 118076 - protein, 68 aa, Glycine max
  Coding DNA Sequence Number=SeqID_26391
MKFGYVARNSISHTLTVGICEIIFVVGEKGIAWRQYKRRLQSLLRLSDVREFYRSSRRKNLRNLKETL

SEQ ID NO: 118077 - protein, 27 aa, Glycine max
  Coding DNA Sequence Number=SeqID_26392
DSVEFFIVLRRSSPFFIRSSFVLRSST

SEQ ID NO: 118078 - protein, 118 aa, Glycine max
  Coding DNA Sequence Number=SeqID_26393
MVDTLPKFYYEKLIGYMPANFADLVFAGERIESGLRKGKFEYASNVVPNNNRRAPVVGARKKEGDAHAVTTAPTWMKAPYQPNPPNFSIRARSSLPTQVKGPPAAERTPAQRTAPATP

SEQ ID NO: 118079 - protein, 51 aa, Glycine max
  Coding DNA Sequence Number=SeqID_26394
MTLRQHGLSLGSSSSMDSFASWKMNGSGMEKEEREEMPLQGEDESRRSSPP

SEQ ID NO: 118080 - protein, 99 aa, Glycine max
  Coding DNA Sequence Number=SeqID_26395
MGKFCKSVNDNQDGVEPMRSISCNATFFIVACSIFGIILLEVQTKTTSSFMTKNQQLDSPFWPCIQSHNHIPKTCVTTPVVQVSVGVVPSMISSFFDQF

SEQ ID NO: 118081 - protein, 117 aa, Glycine max
  Coding DNA Sequence Number=SeqID_26396
  Homolog annotation: Hit_ID=A5C7Z4; Match level="QueryCoverage=96%, HitCoverage=40%, E-value=2e-09, Identity=32%"; Hit description =Putative uncharacterized protein
MVVIVPKEHLVVWFCSLHNRPDNYLKGILNSALKGFDDAPQPKSKAPARWIIVKCNRQKGSTECGYYVMHWMSTIILGSFMNNWEAYFNDPRPLEPERLKAIRIQWAQYYLQVRAQS

SEQ ID NO: 118082 - protein, 98 aa, Glycine max
  Coding DNA Sequence Number=SeqID_26397
MYLVGAGGPRDIVLSGSARLVHGPLDGRCKARNWNTLIPLVPVLRFRACPSVWASFLLPFLLTRKGSGPPQRLRSRLNISAIGGNFARIRSPILVHPG

SEQ ID NO: 118083 - protein, 207 aa, Glycine max
  Coding DNA Sequence Number=SeqID_26398
  Homolog annotation: Hit_ID=Q5QJQ3; Match level="QueryCoverage=50%, HitCoverage=81%, E-value=1e-56, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLLNDGQCQACMPAGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPT

SEQ ID NO: 118084 - protein, 224 aa, Glycine max
  Coding DNA Sequence Number=SeqID_26399
MGAKHLKMTRHKLHATKQRSPDEIRRQRSPKQPNFLSSAQLNLLSYSPMTHFDGLYHFSSYVLVVQLQNAWSNLNFPVITKGFCISIDTLHPLWFMLLCCIPCFLLLNLTFIRGCTRTINTNLCFFLVYQLNIFPFNFCFVNYSVVYKSKGETEDIELVEEEQARIGADSSSETSNKSENYKEDARNATHKHKPKRVESVNADAEAFGDHWKIQIAPCILKLNH

SEQ ID NO: 118085 - protein, 83 aa, Glycine max
  Coding DNA Sequence Number=SeqID_26400
MPFCGRAKARLTGALSKGGKMRGVATNVYLGKTSKKPKETGQKMKILSSGVVFTFEEGISTSHVDKSGALAPTYPPSKRKSDL

SEQ ID NO: 118086 - protein, 130 aa, Glycine max
  Coding DNA Sequence Number=SeqID_26401
  Homolog annotation: Hit_ID=A0ST23; Match level="QueryCoverage=34%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARGTELEFVIMVIAVSFGKPVVPAALMNRPTRGERRFAYWALFRFLAH

SEQ ID NO: 118087 - protein, 102 aa, Glycine max
  Coding DNA Sequence Number=SeqID_26402
  Homolog annotation: Hit_ID=A5BEV8; Match level="QueryCoverage=97%, HitCoverage=12%, E-value=1e-12, Identity=42%"; Hit description =Putative uncharacterized protein
MNCLKELGRWSHEYMNLFGGTERFEQLKLSLLVDGFSKVSVDKWMDITDMGYVIASRYNVILVSLSQQQSMTFFPLRSQPPPDSSGHRIICVGHVFGNHFVQ

SEQ ID NO: 118088 - protein, 223 aa, Glycine max
  Coding DNA Sequence Number=SeqID_26403
  Homolog annotation: Hit_ID=A2Q4S5; Match level="QueryCoverage=46%, HitCoverage=15%, E-value=3e-14, Identity=40%"; Hit description=IMP dehydrogenase/GMP reductase, putative
ALRDLTLAGLYAWELLGSSICTISLMMPVLAPVDSLLCLIYEHFPSVGECNADLDYDEVSPHACQWIATKRTVKKCLIYEHFPSVGECNADLDYDKVSPHACRWIATKRTVKKVSTATYRQCLDHLRILDVCQMPYSEYRPVQDFHPISCFSGQLRWGPVVVRYRPERVMRQFGYIQCIPAHPVHPWVSYDDVDNTWTHYSNHLAAAGDPCVVPGQCAPDYID

SEQ ID NO: 118089 - protein, 96 aa, Glycine max
  Coding DNA Sequence Number=SeqID_26404
SNRVLGFPALITGLYQFYGVPISPSKVIRLPTNQAFIKKYCAPRQAKGETPQQPGDGQQRATDAPSPPPEPFSSSTKAGALPMTHGRPAGDQVQSQ

SEQ ID NO: 118090 - protein, 100 aa, Glycine max
  Coding DNA Sequence Number=SeqID_26405
LICDSPLISASPHQLDFAPYASGSYNAQWNAPGLLHDKHTLHLSRILGKMEAFCCKIPSLVGVLVRAKGMDFVDNWVVGKEKGCYWLSNDIVGLVGNLAV

SEQ ID NO: 118091 - protein, 113 aa, Glycine max
  Coding DNA Sequence Number=SeqID_26406
MTTLTPTWMTLLLSNILPNDHNSDLPLPKCQLVAHVQTHDCLYQFSLSLQSQGFASFPCPTLDQFRAEVAWPGDWPKAQAGEAPAEALGEANEARMDEEMTDLLDFLGGSGAT

SEQ ID NO: 118092 - protein, 198 aa, Glycine max
  Coding DNA Sequence Number=SeqID_26407
  Homolog annotation: Hit_ID=UPI0000ECBAF8; Match level="QueryCoverage =18%, HitCoverage=42%, E-value=3e-12, Identity=100%"; Hit description= UPI0000ECBAF8 related cluster
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLPLVSMAISKPRACSASIRGLSSCSSGSGDPLESTCRHASLALAVVYNVVTGKTLALPNLIALQHIPLSPAGVIAKRPAPIALPNSCAA

SEQ ID NO: 118093 - protein, 79 aa, Glycine max
  Coding DNA Sequence Number=SeqID_26408
MERSMIDAASGGALGDMTPAEARNLIEKMASNSQQNLIEAVPESNKHENAAPHTPVSPSSIKHERKLGSEAINRTRSVH

SEQ ID NO: 118094 - protein, 78 aa, Glycine max
  Coding DNA Sequence Number=SeqID_26409
MHETQCGPLRVHRMNRKAWFEQNRGGGCRPARPGELNSPRRAQLAQASRVASSEATAFWRNLLEGPNGPGCYLHPHFY

SEQ ID NO: 118095 - protein, 67 aa, Glycine max
  Coding DNA Sequence Number=SeqID_26410
MAGRKFGGEGFQEKEELQGHIVVDYAKMVIDYQRATLLEITACNRLHCYGNRLPVLILAKKQKQKAS

SEQ ID NO: 118096 - protein, 134 aa, Glycine max
  Coding DNA Sequence Number=SeqID_26411
  Homolog annotation: Hit_ID=A6FJQ2; Match level="QueryCoverage=28%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPRVRAEYPNQLDYNGFDAYFRQYLKFNVSIIPKNKKGGIAY

SEQ ID NO: 118097 - protein, 236 aa, Glycine max
  Coding DNA Sequence Number=SeqID_26412
MRGYHMVIRSFCHPEATSPLTCGDGKSDDMRGYRMVICTFGHLETASPMICRDGKSDDMRGDRMVICTFGHLKTTSPMTFMGIVWSSAPLVIERWQGYRMVIDNFGHLETASPMTCGDGKSDDMQRYRMVIRTFGHLETASPMTCGDGKSDDMWGYRMVIHTFGHLETASPMTCGDRKSDDMQGYRMVIRTFCHPETASPMTCGGTNVVLCTFRQPKGNEPVDAQRLASSSKPLVI

SEQ ID NO: 118098 - protein, 37 aa, Glycine max
  Coding DNA Sequence Number=SeqID_26413
MNRGARGRVRADARPVISRSSSNVLLRKIKNHYWEAA

SEQ ID NO: 118099 - protein, 226 aa, Glycine max
  Coding DNA Sequence Number=SeqID_26414
MTTLVSACDRTLESDGRNETFLRSRPEDADISGKGADDYTLEYDGRKETFSWSRPKDADISGKGADDYMTTLVSGCYRTLEFDGRNETFSRSRLEDADISGKSADDYVGLWMTMLVSACYRTLESDGRNETFSRSRPEDADISRKGADDYLGLCLSIRLGTLGSQDSKKCARITIGARMEILIPGQGLWWFEVLAQMACRMVGHDICQGVDLASGSGIKECLILFP

SEQ ID NO: 118100 - protein, 80 aa, Glycine max
  Coding DNA Sequence Number=SeqID_26415
  Subcellular localization annotation: CTP_CleavageSite=67; ConfidenceScore=5.10e-01
MDATVLSCSNFLLLSALFLLNVSSMKRDVSTMHSVATYPWAGGRRETHGCVFQGRKAHRVTTNVYSRKTSKKSDRVVYEL

SEQ ID NO: 118101 - protein, 212 aa, Glycine max
  Coding DNA Sequence Number=SeqID_26416
FATSNIQSCGFGMTDPLDESISCFLIRVNPWGYPPSPWVLVTLTLRGLHVLTIRGLHALTSRGLHVLALRGLPALTLGTSYPHLQRTTRPHLRGLHVLTFRGLRVLTFVGLHALAIRGLHVLTFRGLRALAFVGLHAFTFRGIHVLALRGLHALTLGLHALTLGTSYPHHQRTTRPRLERTTRPHHQRAARPHLQRTTCPRLERATRPHLGY

SEQ ID NO: 118102 - protein, 35 aa, Glycine max
  Coding DNA Sequence Number=SeqID_26417
MGARDKSIMHKGNKNPDPVNDPVQSPWHAHSSPVQ

SEQ ID NO: 118103 - protein, 185 aa, Glycine max
  Coding DNA Sequence Number=SeqID_26418
  Subcellular localization annotation: CTP_CleavageSite=41; ConfidenceScore=5.54e-01
MAESSKKRKGSSISSAAAAHRQHGPSGAPTTPLPPSLSSLRSSTLFSSDDQRPWYNSQFSSRIILDLKYLDIDFFNDETFECYQVFQNFGLVDFMSLKLPYYPELVRVFYSNLKIQDGTIRFEVDMTGRLLAGSLTFDCRIMYYIIVRILLPRSSNLAQASEEELILMWAFLTGRQIDWTHLVRY

SEQ ID NO: 118104 - protein, 245 aa, Glycine max
  Coding DNA Sequence Number=SeqID_26419
  Homolog annotation: Hit_ID=Q5QJQ3; Match level="QueryCoverage=38%, HitCoverage=74%, E-value=8e-51, Identity=98%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPHVFGCCAKCFPVADIWITSLNSLYFFPATRMMYISKWGTELEFVIMVIAVSCSAPLTSITKIDAQVRGGETRQDYKDTRRFPLEAPSCALLFRPCRLPDTCPPFSLREAWRFLIAHAVGISVRCRSFAPSWAVCTNPPFSPNAAPYP

SEQ ID NO: 118105 - protein, 245 aa, Glycine max
  Coding DNA Sequence Number=SeqID_26420
EATTSPSSSESEKAKGEESSEDIYPQEEGQPLVVKEKCKEVSVSSKSLAKKETHLTIETNIKEVFPLRQPPHFLFCKKALASIATPLGLEFIPQVKKLLDEGLVRKSLNPCALLVPKIGIITHQVPKIGGMMNVLSGATLFCKITRTPNIFMVCVHRDPLGRNNQYENTEKGVPMNPKRIKVINEWPTPPTPLIELVRNHVPSWEDAQEIGVEGRSPEYEEPRDLRSNPFQGGGNDAILSRKGIG

SEQ ID NO: 118106 - protein, 182 aa, Glycine max
  Coding DNA Sequence Number=SeqID_26421
  Subcellular localization annotation: CTP_CleavageSite=41; ConfidenceScore=5.65e-01
MAEPSKKRKGSSSTATAAAHRRHGPSGAPTTPIPPSLSSPRSSTLFSSDDQRLRYLSQFSSRIILDPKYLDVEFFNDETFDCYQVFQNSGLVDFMSLKLPYYPELVKVHGTSMVIDQSLFFSLTHLPSQGAPFEGTIVDDWKFDYSSHDARRMVCNDQTKMTGRLLAGSLTFDKSHHALYHC

SEQ ID NO: 118107 - protein, 199 aa, Glycine max
  Coding DNA Sequence Number=SeqID_26422
  Gene Ontology: Mol. function=transporter activity; Cellular component= integral to membrane; Biological process=transport
  Homolog annotation: Hit_ID=Q48I10; Match level="QueryCoverage=81%, HitCoverage=66%, E-value=5e-37, Identity=44%"; Hit description =Dipeptide transport system permease protein dppc AGR_L_321
  Pfam annotation: Domain name=BPD_transp_1; Domain location=65-198; Score=21.9; E_value=0.00061; Accession=PF00528.13; Description =Binding-protein-dependent transport s
MSEISLAKSRSGVLSGLRWGMEHPSLTLGGIIVALIVDLLNILSAPSADHWLGTDDYGRDIFSRTIYGARISLIEVVVSVALSLLMGLPLGIIAALVLGAGLMNMLLAIAIFSVPVYARLSRNLTLGIKNMEYMEAARALGIGYRRQIIHYILRNTLGPITVQATLTGGSVILAAASLSFLGMGVQPPMPEWGTMMSDG

SEQ ID NO: 118108 - protein, 69 aa, Glycine max
  Coding DNA Sequence Number=SeqID_26423
  Subcellular localization annotation: CTP_CleavageSite=43; ConfidenceScore=5.37e-01
FSSILCSALGSRSLFRPPLHSPQFRLKKGFLSVKRHSRAKRIRDNLLAEQADDALSAKRLMSSLAVESH

SEQ ID NO: 118109 - protein, 84 aa, Glycine max
  Coding DNA Sequence Number=SeqID_26424
MVPFGNLVQPPIVDADSPTVLHPSRNHGEVGFLWNYLDETHPLDVEDRINDSSLQKLGYLLLHYIKNHRVESSLWLSYWFNPIL

SEQ ID NO: 118110 - protein, 153 aa, Glycine max
  Coding DNA Sequence Number=SeqID_26425
  Homolog annotation: Hit_ID=A5AZG1; Match level="QueryCoverage=53%, HitCoverage=26%, E-value=8e-08, Identity=37%"; Hit description =Putative uncharacterized protein
  Pfam annotation: Domain name=zf-CCHC; Domain location=58-75; Score =22.6; E_value=0.00058; Accession=PF00098.14; Description=Zinc knuckle
QQLKRKSTSKSFGPHSYPNKDQGQGILGVTTSKPKDDKGKTIEKQPLKASMQEKTSSIKCFKCLGRGHITSQCPTNKTMIMRGQDIYSSQDEATTSPSSSESEEAKGEESSEEIYPQEEGQPLMVKEECKETLVSTATPLGLEVIPQSTGVVG

SEQ ID NO: 118111 - protein, 210 aa, Glycine max
  Coding DNA Sequence Number=SeqID_26426
MVLTVWSVMTGRLLVGSLTFDCRIMHYIIVRILLFRSSNLAQASEEDLILMWAFLTNHQIDWAHLVKYRMHKALRTNAPLLYPQLVTLFLRYFQISLDDEPFVQVKRSFTIGAGAVTSFGYRKDIDGQWIRKQDLPPPIPDECTPSPLPQRDASFTLMHEVISKLCGLQAFVGDRLDAMDAHFEGMDTRITQLKDNMGFIRCCFDPPTAP

SEQ ID NO: 118112 - protein, 257 aa, Glycine max
  Coding DNA Sequence Number=SeqID_26427
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=36%, E-value=1e-143, Identity=91%"; Hit description =Photosystem I P700 chlorophyll a apoprotein A1
  Pfam annotation: Domain name=PsaA_PsaB; Domain location=1-257; Score=- 20.2; E_value=4.1e-06; Accession=PF00223.10; Description=Photosystem I psaApsaB protein
MSALGRPQDMFSDTAIQLQPVFAQWIQNTHALAPGTTAPVGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGSISDQGIVNHITGGNFAQSSITINGWLRDFLWAQASQVIQSYGSSLSAYGLFFLGAHFVWAFSLMFLFSGRGYWQELIESIVWAHHHLKVAPATQPRALSIVQGRAVGVTHYLL

SEQ ID NO: 118113 - protein, 183 aa, Glycine max
  Coding DNA Sequence Number=SeqID_26428
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=44%, HitCoverage=53%, E-value=3e-24, Identity=72%"; Hit description=LacZ -alpha
  Subcellular localization annotation: CTP_CleavageSite=32; ConfidenceScore=5.33e-01
MTMITNSSSVRTAATNSGKRNRKPITEALRRRCSIVDVFRRRKNPPVGEEHPAAVPLLVAGDHSLELRRRAVERAVAEPPLHLQKLPEGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 118114 - protein, 174 aa, Glycine max
  Coding DNA Sequence Number=SeqID_26429
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
LSGFATSDLSVDFCDARQGGGAYGKTPATRPLYGSWPFAGLLLTCSFLRYPLILWITVLPPLSELIPLAAAERPSAATGTTGFPTGKRAVSATQLIKDSTFCKEWTFCPVYTSSRKITGHGGMQAWHWPSFYNVVTGKTLALPNLIALQHIPLSPAGVIAKRPAPIALPNSCAA

SEQ ID NO: 118115 - protein, 76 aa, Glycine max
  Coding DNA Sequence Number=SeqID_26430
MAEDQPQRVTLEDYSSSIVLQFFTSIAWPEVQAHNITYPHSLIQLIQGNLFHGFPNEDPYAHLATYIEICNTVKIV

SEQ ID NO: 118116 - protein, 47 aa, Glycine max
  Coding DNA Sequence Number=SeqID_26431
MAHQKPPYLAFCTPRQNETKNNLQGYQRETNQNIHIFLNEHQGMKGM

SEQ ID NO: 118117 - protein, 112 aa, Glycine max
  Coding DNA Sequence Number=SeqID_26432
EDTHPKTYGCLSEEPLKGWIKTYSLPLFAHQFVDDKCIIHLVAWYKVCHLAKPIHHHKDRVYTSLGSRKPKDKVYTDVYPRCRGDGVLSIPKWPMSPPSWLSFTSNFLMDPW

SEQ ID NO: 118118 - protein, 94 aa, Glycine max
  Coding DNA Sequence Number=SeqID_26433
  Homolog annotation: Hit_ID=A5C0I1; Match level="QueryCoverage=52%, HitCoverage=21%, E-value=1e-07, Identity=50%"; Hit description =Putative uncharacterized protein
MEIFIQLIDPGAWNAIVKGPFIPTKEVNGEHFSFWQKRMEIFIQSIDLGAWNVIVKGPLIPTKEVNGELVPKEWNEMKDDDKRKVQDDQKAKTF

SEQ ID NO: 118119 - protein, 141 aa, Glycine max
  Coding DNA Sequence Number=SeqID_26434
VIRPPITRIFIEKYCTARQAQGGAPQAPEAPPPPPQDDPAGPFDTERYLRHLVRQQAANHRAHVQTHDSLYQLSLSLQSQGFASFPCLTPDQFRAEVAWPGDWPEAQAGEAPAEAPGEADEAREDEEMTDLLDFLGGSGAI

SEQ ID NO: 118120 - protein, 138 aa, Glycine max
  Coding DNA Sequence Number=SeqID_26435
  Pfam annotation: Domain name=G-patch; Domain location=49-90; Score =14.9; E_value=0.003; Accession=PF01585.14; Description=G-patch domain
ILVSCPSSTPYVEATKESLEMSFQALEVVSNAYMESLSVQPCSSGAILMVARVMLGHGYEPEMGFGRNDNGVASLVEFIGNRGRFGLGYEPTCADGRVSMIHDETPQEQPNWVRLCTPEFKLGNWKIVKQPRIFVANS

SEQ ID NO: 118121 - protein, 151 aa, Glycine max
  Coding DNA Sequence Number=SeqID_26436
  Homolog annotation: Hit_ID=UPI00006A2D9E; Match level="QueryCoverage =88%, HitCoverage=85%, E-value=1e-12, Identity=20%"; Hit description =UPI00006A2D9E related cluster
GLHALAIRGPHVLTFVGLHALTFRGPHVLTFRGLHALALRGLHVLTFRGLHALAIRGPHVLTFRGLHALAIRGPHVLTFVGLHALTYRGLHALTFRGLHALAIRGLHVLTFRGLHALTLRGLHVLAIRGLHALTSRGLHLLALRGAARPHL

SEQ ID NO: 118122 - protein, 122 aa, Glycine max
  Coding DNA Sequence Number=SeqID_26437
MIRGDTLWLFAPFCHPEAAGPMTSRDQVWSFCTHDTRRYLMVIRTLLSSRGGGPDDKQRPKADTVFCTFCSSGNNKSFTCGNFMVARDSRGAKLVSYTDFRGPLLDDMRPFFGPCEVLGTHR

SEQ ID NO: 118123 - protein, 120 aa, Glycine max
  Coding DNA Sequence Number=SeqID_26438
MFVLAGNGSEKASAKRSRKDAAAEGTSAAPEFDSHRFRSAEHQQCFAGVGRRWSLPWPNALSQFLGNPLVLEEGQECEYSQRRNRADGFDEEAIAQLLCIPGQDFARTAAGRQQHPAQRS

SEQ ID NO: 118124 - protein, 122 aa, Glycine max
  Coding DNA Sequence Number=SeqID_26439
  Homolog annotation: Hit_ID=Q2R2K3; Match level="QueryCoverage=56%, HitCoverage=7%, E-value=3e-08, Identity=39%"; Hit description =Transposon protein, putative, CACTA, En/Spm sub-class
MKVSERKQSKNVEELGLEKHNKTSLIEEECWPVYFGDATQASIVERYIVEEAIEFCFEYIEKAKPVRLPECRHDERVGSKGSRGLHVITPSVEDLLQAHLYVLKTVMKFFHTYFGMKVSERK

SEQ ID NO: 118125 - protein, 128 aa, Glycine max
  Coding DNA Sequence Number=SeqID_26440
  Gene Ontology: Mol. function=transcription factor activity; Biological process=regulation of transcription, DNA-dependent
  Homolog annotation: Hit_ID=Q1I8I6; Match level="QueryCoverage=81%, HitCoverage=35%, E-value=3e-25, Identity=52%"; Hit description =Putative transcriptional regulator, LysR family
MLLLARRCWRCAAKKNCLRYPLLHDGHHLWPAFLAFMFPGQSLQHQHHLRFNQTALALEAALSGQGIALTSPHFVQNDLASGRLVPAWHREMPVDAGWYLVAPRRPREQATVSAVRAWLLSQAEQSKD

SEQ ID NO: 118126 - protein, 75 aa, Glycine max
  Coding DNA Sequence Number=SeqID_26441
MTVSYQGLANEMLSIRVTRLPDFSANVNWGTPFSLEPDYKESEWAQTRYDQLKPLVFRHQAICRKQRIPARDCRQ

SEQ ID NO: 118127 - protein, 109 aa, Glycine max
  Coding DNA Sequence Number=SeqID_26442
MRICPSNTLYNLASEVWELWADKSAKAGSGAEVEDAGMPAIGAKEKRTSVAMSLVIHIPTVLSQPTLRREGDARLAGCVFHERNTRGVATNIYLRKTSEKPEKTRSTNF

SEQ ID NO: 118128 - protein, 33 aa, Glycine max
  Coding DNA Sequence Number=SeqID_26443
MEKGVALAPTYPQVPSSLSNLGAQASQRLAWAS

SEQ ID NO: 118129 - protein, 60 aa, Glycine max
  Coding DNA Sequence Number=SeqID_26444
SQCPKIPIPDRVPIAEVFSSEWLLLNLNSFTLFGLVERPRMASKKEDDRHAGKEKEGDVA

SEQ ID NO: 118130 - protein, 162 aa, Glycine max
  Coding DNA Sequence Number=SeqID_26445
MCWRIPILVKVVARAAVVVVSVYLGLPVFSVYFLVLVLLLLMSFRPCSFPGSGLYLVASDPGLRDFIWGSRTGTSRSKASSRIVVRLAVNGILHSRIWTFLLSGCNPWLVRAAHPCYQTGQGSQGHAMRPTGGVLNTESFDEGVEAIYGSWWESTIPCQGIL

SEQ ID NO: 118131 - protein, 188 aa, Glycine max
  Coding DNA Sequence Number=SeqID_26446
DPKVVLEFYANAWPTEEGVRDMCSWECEFSQRRNRADRFNQEAITQLLCTPGQDFARNAAGRWVRILRTSMTTLTQMWMTLLLSNVLPSDHNFDLPLPKCQLVYAILTRMSIHVAQLIADAIYLFAGMPYTRHHLDPDKSNRALGKVIQPPITRAFIEKYCTPRQAQGDAPQGAGAPPPPPQASPAGS

SEQ ID NO: 118132 - protein, 179 aa, Glycine max
  Coding DNA Sequence Number=SeqID_26447
MSCSEAINSIPDPQEKKGFLEKLKKTLEVKPKQKDFITNNKFDVSNILKRLENSSTKPTTIQDLQTEINNLKREVKELCQQQEIHQIILSQLEEEDSDSESANNKTMALFDTGADLNCILEGLIPTKFFEKTSEKLSLGSSSSMDSFASWKMNGSRMEKEERDETPLQGKDESRRSSPP

SEQ ID NO: 118133 - protein, 67 aa, Glycine max
  Coding DNA Sequence Number=SeqID_26448
MYEYPRRTRALTHKHSFQNSCGYSCFVGKREMAPKKLSTKRSRRDATGEGSSVIPEFDSHRFRSAEH

SEQ ID NO: 118134 - protein, 853 aa, Glycine max
  Coding DNA Sequence Number=SeqID_26449
MESAEHDEHQRANQHPAQQQADDAKAIAGALDAAYGALKPGGRKALQRPFAVPGLKQALQFDDGALVGKLVVRGVQRHAEVLFTGGNGQLQRVKTLVQPGRTGGRLHRGHGALHRYPGCVHCVDVHDERRTVNAAVNRPRREAVQKEAQATGQPGQRPHDQRNQDGEQQQQRPPPAVPLAERHRLNNHRHEHHAEHDHHAHGQHRQVRRYGHGRFHCAADAPGAAGNVHGVNEAVFRAAGQVTGLDDAELLIRYPLAQRIGQAKTGTEVLRTLGEDLRHGIAGFLPAPAVVVDKLLIGLFSAAAVQQVDPRCQPGVPVQVDDAAMRPHRIRDAAVNQPQQVLAQGHATAINPVKIGSHLALPAVEPHKAVIRFNNFEYAGAAVYSRMTTALAAAGVAQKYATDLSVGLHHVLHYRADADASFLPGNAAVRAEQRHQAQADQAGNDGRVEQQVFVDAKAAQALRNVRRRVGVDGGQHGGAGLYGLNDAVGGTRVAHLTVVDAVRVHTQQVFNGFCKGLQAERRLEHSLNRRLDRVFHGHDVFARVLARQKLGGDLTHRGLAVAGRPAEEGAARAGQRTPEHGFLCRRQAQLLKVQALLAAAHQTQCHRQPSLPARPAGKADSAEAVAVHKRLAYARVAGLVVQRVDEARAPLCRMGVHRAQVAVNAVEHARVFVLDADMNVRSAQAGRLGYHAENMILKVARPRHALAAVAELLRNFLELLAVAPHYARVKPLAAQLLAQLKELGAGVQFLQHVQAVRLALLVADKADALADRRGKGTAAGRRRKRQQGMGFFTQVHHDVTSVKGKDAPVRRAFDDHAAHRNGHHGVAAADAVARAHLRAAAVRKAQRGNRSRH

SEQ ID NO: 118135 - protein, 276 aa, Glycine max
  Coding DNA Sequence Number=SeqID_26450
  Homolog annotation: Hit_ID=A9IHI0; Match level="QueryCoverage=100%, HitCoverage=82%, E-value=8e-34, Identity=29%"; Hit description =Putative uncharacterized protein
MLRLDSVFSDYWLESLTDDLQRILRKVVSSTKSDVPDFDFRKIDSLTASKGFGKGYNPYINGSWFSNLSAWGRGMFPGKNLRSETLQDWKENVRHIEREGFRPDASLNVLYYEWYKRYVVSNTGGSHHAAKVIYQAQRDNLVYNRHAVIEYLSINQEAVSELEARYVSFIYRPRSKEVTWYERDTVTGFCQSLSELVSDDIEYLKPVHYSENIRLAFIPRSGLKIDEKQLDEWINTAIQAGKIISLTDYLKDPEPFHIKPYIHEVNGILLRSPFES

SEQ ID NO: 118136 - protein, 370 aa, Glycine max
  Coding DNA Sequence Number=SeqID_26451
  Homolog annotation: Hit_ID=Q88BK8; Match level="QueryCoverage=97%, HitCoverage=95%, E-value=4e-44, Identity=32%"; Hit description=TrbB protein
  Pfam annotation: Domain name=DSBA; Domain location=226-363; Score= -34.6; E_value=0.029; Accession=PF01323.11; Description=DSBA-like thioredoxin domain
MTMTVSRREGPFVAELTGELLSVQRISTDEGALTGRGLTMLFVCTLRKMPWFVMHGDGLYAQNAHDALTPLYHGSDAAQLLGCLKRLLTSAETARLRSRRHRKSGYAAAALFLTGILLSMPVIIHGLIMPGGSGQLAKANSPLSVPSDRAPVAAPPAAPAPAMLPSDGEGGRTGSQAPAQPQPPATYPDDGWNLPLNVRAELPAKLRSAASRALFTVPLSSGHARTLYVFADPECPNCRRMERHYETAAGMVNVVIFPVTIEGREASLQKLTPVMMLPEDQRAAAWKQLFAADAGMGVPGAAPRAPAAADDAQAETARGAIGVNEVAFRAYRLPGTPWTISDDGRYVPQGVLSSPAALTDFLNGGGHDRQ

SEQ ID NO: 118137 - protein, 210 aa, Glycine max
  Coding DNA Sequence Number=SeqID_26452
  Homolog annotation: Hit_ID=Q88BS2; Match level="QueryCoverage=100%, HitCoverage=20%, E-value=3e-70, Identity=61%"; Hit description=TraU protein
MHQTRVQQLDEEVKTRQYDELHNAKGVPFIFPMLETADREQRKFGVRTVLSSQYFRDMPEALRQSANSVYMVGVDPEDRALLKERFRVPDATLDRFERMGSGPSADGSGVPFLGIFRIKGGSTIAHIMKNTVGPEELWGHSTTPVDMSLRRMLEKDTGADTARRILGQFFPNGSAEKVIEHRRRTAGEAGGDSVIRQLASELIDKQGYDL

SEQ ID NO: 118138 - protein, 1140 aa, Glycine max
  Coding DNA Sequence Number=SeqID_26453
VDSRGSRNCAAPVRVLTGVGARGVTLVRHDGKPHRVVCCFHNASCAAVSGRLLAVGEPAVPPRAAAQAFAARQTGRAREKFGHAPAEQVQQPERGDNAGDDVDRVHADKAEPEEIEQEQPDGNAKKVEPAAGAPPESRRLPGLIHDASLLRAEDPVNMLPPLRPRHAGKLLAQVVVKKDEFADRHALPVGGAQQRLYHHTRKDLARRVDVRGGEQQMTELTGAYASLDGLKVAHLPHAHDRRCAPEVSADAGRKVGNVFTHLRLQRRQHVARAPQDELDRVFFGRDLTVGVRVQAVAVVHQLRLQPERFKRRYLGGNNAQRPADGAVLTPGGALQQVHAKADALAAVQPPAAGHVPVQLDCAGHRVVRYPEGTRPDQPAVAPHHKMVVALQVNVAHVVARAPDHKASQRVGVQPVAEIIKFKFRGWHQRFSAPFAIARRQLIAVAGDRLLALGHHRRGDEVLAAQQHILQHAVVVARQAVNVGLQRLVCALPAFCPALVNGRLPDVALDAVLRDKAALRLVRRHGAEARHQPAAPRRRVADEALRLNDFVHVACRADLVRGDARHVHRFGDDRRQPAAAADERAEVIGRIQLLRARLQVAPELPRALRLAAAKPQRAAALGKHLPAVIGDVSGVALLRRQVKSRAARQQRGQQQDTKPGFHRLPPFLWRTGSAGRDDINCSTICPGYVTIVARQALHRVTVPAESQPVAVGADGHHRQRRVTVENAAGSRTAAAPAARVPVIRKVSRRRRSAAGQPDGINFSCIQHAARLIAVGESGVVTAEALPGQAADLQVLRQYPGAGLHVKAGLRQEVAFVGDDPHGFKFCQVRGIDLHQTKVAAGHAALPVAVIAHCVRVHTAFHLRNGAQQLRRNVIAGTGFAKAIIGDRAAGLITRQFDVSRIHLAGVAHAKRLICIFKAGVVSADRRPVDAVLRNVSGQYPGADVNVLAGISKQHLPRDAHRAQYGQPGGVDLHHAEVFTQHPPVLFVEPDGAGIQPAFDFGDGLQQSPVDAEPHARLPKAAGGFRWHCRRLRHACRDKQQAANSDGRQHVQVTGGQRRGLGPQPGDEIQQQRRKQHNGCAAQCRQGVGSTRQQGCQRKPGEQENEQVRHPLRDAVDISGAGQQQHKQDKSRIVRQKPGGKR

SEQ ID NO: 118139 - protein, 124 aa, Glycine max
  Coding DNA Sequence Number=SeqID_26454
  Subcellular localization annotation: CTP_CleavageSite=20; ConfidenceScore=5.43e-01
MLVRMIRTRLFAAARVKSCPSMHSSSVIASLSSCARTVGAPPISGGGPGTVKRKLLVWIWSPLKVRIRSPLKVRACSPFKARMCSPLEVRACSPLLVRTCSPLKARTCSPLKARTCSPLNGEGN

SEQ ID NO: 118140 - protein, 114 aa, Glycine max
  Coding DNA Sequence Number=SeqID_26455
MAPEDMEKTTLKLLGQLPINGPVAFVDHILMHQEDRGQVRDLNNAKSTTGRTSPGGNPAPSLIQFTSPKRLRIIKEAPWPRCTLAQQPLNDYQPMHPEFPDEDIMALFEENHWT

SEQ ID NO: 118141 - protein, 299 aa, Glycine max
  Coding DNA Sequence Number=SeqID_26456
  Subcellular localization annotation: CTP_CleavageSite=32; ConfidenceScore=5.34e-01
GSSSTAATAAHRRHGPSEAPTTPIHPSLSSPRSSTLFSSDDQRLRYLSQFSSRIILDPKYLDVEFFNDETFDCYQVFQNSGLVDFMSLKLPYYPELVKVFYCNLKIQDGIITSEVHGIPMVIDQSLFFSLTHLPSQGAPFEGTIVDDWKFDYSSHDARRMALWANAPLPYPQLITLFLRHFQILLDDEPFVQVKRSFAIGAGAVTSFGYRKDRNGQWLKKDALPPQDEHTPSPPPQREDSTLLNEVLTELRGLRSYVGERFDSLDTRFAGIDIRLTQVEEDVSFIHTCFDPPPSPPSSS

SEQ ID NO: 118142 - protein, 74 aa, Glycine max
  Coding DNA Sequence Number=SeqID_26457
MEVWYLLEAPNKLPMKDLFVTKLESNEALKVVGPFFLTQILQGMAPILLPIPYMATHKQGNKETSNNQRPKKMK

SEQ ID NO: 118143 - protein, 136 aa, Glycine max
  Coding DNA Sequence Number=SeqID_26458
  Subcellular localization annotation: CTP_CleavageSite=58; ConfidenceScore=5.74e-01
MVKVGTSYVPINVSFSPKSWARASRCSSGFCFYQLSPPVQLLTGVVRNGKKPRRTSALASVAVPLRVTTTPAALNAPLQGASHSPFRLRNCWEGRSVRASSLLRQLAKGGCAARRLSWVTPGFSQSRRCKTTASEL

SEQ ID NO: 118144 - protein, 181 aa, Glycine max
  Coding DNA Sequence Number=SeqID_26459
  Homolog annotation: Hit_ID=A5BKB8; Match level="QueryCoverage=66%, HitCoverage=27%, E-value=1e-14, Identity=47%"; Hit description =Putative uncharacterized protein
MGGGAWPFLVGGAICLVNSVNERDLSLLNSYVEMFWGRNARYTDVFNESIALADRSLQLLVFNEEFLVSASHQLALTTSLPLCTHPPVAPTELNGPVKCSDCGDVSGFAARDVVNLRKDHCRCLTIRLTRELVYSSTVGREGMITAPRAPGLLVLATNTNPGASCAKELKSVKCDSRGPGD

SEQ ID NO: 118145 - protein, 52 aa, Glycine max
  Coding DNA Sequence Number=SeqID_26460
  Subcellular localization annotation: CTP_CleavageSite=11; ConfidenceScore=5.05e-01
MKYVQFQWAKRASTAKRNFSVLNVTEESGRASISRPRAKSKISALSAAGVFS

SEQ ID NO: 118146 - protein, 147 aa, Glycine max
  Coding DNA Sequence Number=SeqID_26461
MHPQLELIHKRCTLSCSQSTTQVDVPSTCTTKDVPSNVLRQRSQAVKPLILCEWGYKRILRREKGDTKEFRRLVLRSFRKGRRETQKEFRRLVLGEFFLAKGEEMKKMNNTSFQGLENQKTLESFWNKEDEEEVQRDSEINVEKLLV

SEQ ID NO: 118147 - protein, 83 aa, Glycine max
  Coding DNA Sequence Number=SeqID_26462
MMLMFEKCSTFNLSLPFVEVFVIICDNNNPPSHQYDSTSNLEDLSDEYQTCWIKNHDSDTDSSSEPEGSNLSPSHETIFKQDW

SEQ ID NO: 118148 - protein, 234 aa, Glycine max
  Coding DNA Sequence Number=SeqID_26463
  Homolog annotation: Hit_ID=A6TG49; Match level="QueryCoverage=91%, HitCoverage=44%, E-value=1e-111, Identity=93%"; Hit description =Putative uncharacterized protein yieM
ILGKLHKLQSPFAAQAQQLVDDNATFTPALHTLFLQRWRLSLVVQTTTLNQHLLDDERDQLLSEVQERMTLSGQLEPVLVENDNAAGRLWDMSAGELKRGDYQLIVRYGDFLSQQPELMQLAEQLGRSREAKLVPKKDAPMETFRAMVREPATVPEQVDGLQQSDDILRLLPPELATLGITELEFEFYRKLVEKQLLTYRLHGDAWREKITERPIPQVRWAALTSNALKPFVWR

SEQ ID NO: 118149 - protein, 268 aa, Glycine max
  Coding DNA Sequence Number=SeqID_26464
  Homolog annotation: Hit_ID=A5ZYK7; Match level="QueryCoverage=24%, HitCoverage=97%, E-value=2e-22, Identity=78%"; Hit description =Putative uncharacterized protein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISFLGPDGDWPSSAKAEGSLTARPTRRAGTKVGLSDPTVRVKGRRSTDKSYSRDNRLIFPKSSHRREGLAPRCRLFATWGCSMFQGLGCSPIKAVRELGSERRETVRSISGVGVRALRGPFPSTRGPGRTHLWCASYRAHEPPVAQPRQRWVLCPSGDGAKEVLRIQEK

SEQ ID NO: 118150 - protein, 70 aa, Glycine max
  Coding DNA Sequence Number=SeqID_26465
MHLAYQLSRNVVQAIGLFAQATCAPEFGLPRPFNQRLLVLHVGGGAVKQRGQPFPCVQQEAHGLLIPFHK

SEQ ID NO: 118151 - protein, 90 aa, Glycine max
  Coding DNA Sequence Number=SeqID_26466
MAANPSSRELDVGISGMTLRIGMAGRGRDQNRDVLVDVNLYGADHLIQAVSFWMTPLPTKEDANQGRRHSRKEDKSVAPREMAISGGSSS

SEQ ID NO: 118152 - protein, 98 aa, Glycine max
  Coding DNA Sequence Number=SeqID_26467
MSLPVLYLYAFSRFPPRGFPGQDHLGLPSGVETKHERQKPIKVLKDERKRGWGHDRPIVALLCANKQGMSLQGSPVSFPFCSFLLLFVCFKRKRVIIR

SEQ ID NO: 118153 - protein, 43 aa, Glycine max
  Coding DNA Sequence Number=SeqID_26468
MKKILGLQAPMELTSVVMVTLTIKDRWPMDGLSPQETENLRRP

SEQ ID NO: 118154 - protein, 331 aa, Glycine max
  Coding DNA Sequence Number=SeqID_26469
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q7HDI4; Match level="QueryCoverage=99%, HitCoverage=75%, E-value=1e-156, Identity=79%"; Hit description=ATP synthase subunit beta
  Pfam annotation: Domain name=ATP-synt_ab; Domain location=67-286; Score=285.3; E_value=1.2e-82; Accession=PF00006.16; Description=ATP synthase alphabeta family, nucleotide-binding domain
  Pfam annotation: Domain name=ATP-synt_ab_N; Domain location=1-56; Score=44.4; E_value=4.1e-10; Accession=PF02874.14; Description=ATP synthase alphabeta family, beta-barrel domain
  Pfam module annotation: Pfam domain module=ATP-synt_ab::ATP-synt_ab _N; Domain location=67-286::1-56
MPNIYNALIVKGRDTVGQQINVTCEVQQLLGNNRIRAVAMSATEGLMRGMEVIDTGAALSVPVGGATLGRIFNVLGEPIDNLGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLPTSNRWEEHYETAQRVKQTLHVTRTFRHYSYPWLDEYSEEIA

SEQ ID NO: 118155 - protein, 95 aa, Glycine max
  Coding DNA Sequence Number=SeqID_26470
MGYIESDHVQHDVPYQVEEMSHVNEVIEVESICALQDLVGGVEEVDPTNLLRNEEDSNNLNGESKNIEQDNEGELEDEFEVYNSEDEDYTLMLWS

SEQ ID NO: 118156 - protein, 220 aa, Glycine max
  Coding DNA Sequence Number=SeqID_26471
  Homolog annotation: Hit_ID=Q5NRP4; Match level="QueryCoverage=42%, HitCoverage=6%, E-value=7e-07, Identity=34%"; Hit description =Putative gag-pol polyprotein, identical
  Pfam annotation: Domain name=zf-CCHC; Domain location=147-164; Score =15.1; E_value=0.0078; Accession=PF00098.14; Description=Zinc knuckle
MSLHSSSSVNGEGSTPKDPLYKILDELRSLKLWKEKQERKEKGRHRSHLRPHSHRREKERKPQEANINLPYFHGKDNVEVNLVWEIRVEQKLKKKSTSKSYGSHSYPKKDQGQGILGVTPSKPKDDKGKTIQKQAPKASMQEKTSSIKCFKCLGRRHITFQCPTIKTMIMRGQDIYSSQDKATTSPSSSESEKAKGEESSEEIYPQEEGQPLVVKEKCKE

SEQ ID NO: 118157 - protein, 54 aa, Glycine max
  Coding DNA Sequence Number=SeqID_26472
MTHNSTMEELINKIQLSPKIMPTSSRQLGSSPESYSLHPATVILLPRTMFAIIT

SEQ ID NO: 118158 - protein, 78 aa, Glycine max
  Coding DNA Sequence Number=SeqID_26473
  Subcellular localization annotation: CTP_CleavageSite=51; ConfidenceScore=5.10e-01
MSCTGSLSAPLHLTKRTASVHPLSEKGALSQKSLMCAKRSINLQRPKLEARADLRARDEFVSDCEILEVKETSSPLVF

SEQ ID NO: 118159 - protein, 101 aa, Glycine max
  Coding DNA Sequence Number=SeqID_26474
MVFSKTITLPMRIQGTNRLRILCLNTLEGTSFVVQVEGTSTWVIILRTREGTSLVDQFKWRVHPLGFSKRTREGTGDGPRASTEDGDGVNAGTVDGPGAST

SEQ ID NO: 118160 - protein, 173 aa, Glycine max
  Coding DNA Sequence Number=SeqID_26475
MLWLASLNVDYWLEVVFRQVSGKGRRVVFKLKDLSQQLLSCTLWDDYCLQFLKFLDDYEGSYPASINNFFKASKLIINQPVMEIQEFNERYFLLAELGIDARLGFKSHGEGSTQLSGSMQLSSKESFFGKAEAKTIADINTISKEIVCVTVGTITRIVLDNHSWCYTACIQCH

SEQ ID NO: 118161 - protein, 134 aa, Glycine max
  Coding DNA Sequence Number=SeqID_26476
MGEAEEVQEKMKADMEAMKEQMATMMEAMMSMKKIMEANAVIVAATSAVAKGEPDAPIWPQANESSNLKYASFEPCLGYAAEGQAVGGIPLQNTLEGPQYHPQPQPSRSTAVKNPHDYGRNGKVGSSRGKAQGH

SEQ ID NO: 118162 - protein, 182 aa, Glycine max
  Coding DNA Sequence Number=SeqID_26477
  Pfam annotation: Domain name=zf-CCHC; Domain location=109-126; Score =11.6; E_value=0.027; Accession=PF00098.14; Description=Zinc knuckle
MSPIVVITLAKPSKELRDYYEGRHRSHLRPHSYRREKERKPQEANINLPYFHGKDNKSRSKSYGSHSYPKKDQGQGILGVTPSKPKVDKGKTIEKQAPKASMQEKTSSIKCFKCLGRGHITSQYPTIKTMIMRGQDIYSSQDKATTSPSSSESEEAKGEESSEEIYPKEEGQPLVVKKKCKE

SEQ ID NO: 118163 - protein, 102 aa, Glycine max
  Coding DNA Sequence Number=SeqID_26478
MTNPLNESISCFLIRVDPWVLEPIAFRGLHVLAIRGLHALTIRGLHVLAIRGLHALTFRGLHILAIKGLHVLAFRGLHVLAIRGLHALAIRGLHVLAFRGLH

SEQ ID NO: 118164 - protein, 137 aa, Glycine max
  Coding DNA Sequence Number=SeqID_26479
  Homolog annotation: Hit_ID=A0ST23; Match level="QueryCoverage=19%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLAIKLIDTVDLEGGPVGKPVVPAALMNRPTRGERRFAYWALAECILAYYVGTDEGVSEVLHVAGEKRLH

SEQ ID NO: 118165 - protein, 117 aa, Glycine max
  Coding DNA Sequence Number=SeqID_26480
MEELINKTKLSPKIIPMPSRRLDGSSTESHFLHPTAIILLPRTSFAIITGKVCGNYRGHPIVHHKGVPYQVTHPLVQSTYCHSLYYFPCHIRHETWAPSSTMTMDVLKILSHPLRDA

SEQ ID NO: 118166 - protein, 87 aa, Glycine max
  Coding DNA Sequence Number=SeqID_26481
MGGANSTQAHLGPPEDSSRRLLLLEEATLARLGELGGKHLPYFAINRGGTEALPKRFRNVFREEFRKGFNRSSTFFIRSSSFFDLQR

SEQ ID NO: 118167 - protein, 91 aa, Glycine max
  Coding DNA Sequence Number=SeqID_26482
  Subcellular localization annotation: CTP_CleavageSite=23; ConfidenceScore=5.01e-01
SEFLVGGYVGARASLMSTTPPFVAMTQELVTRGDTLQLSAPRHSVTPSVIDKQRPMWSEFLVGGYVGARALLLSEAGGAPRENCHTDPFEA

SEQ ID NO: 118168 - protein, 103 aa, Glycine max
  Coding DNA Sequence Number=SeqID_26483
MMTFKNEFKIESRTLQGSRGNLISRIKIQDSKIQESREDLIKINCNRLPVTYFRKMRVTFPKSLGKFDSSRIDRTSSSRFKFQESRSRFRLKILESERLNQKV

SEQ ID NO: 118169 - protein, 261 aa, Glycine max
  Coding DNA Sequence Number=SeqID_26484
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=48; ConfidenceScore=5.22e-01
MVKVGTSYVPINVSFSPKVGPRASPVLQWLLFLSAVPPVQLLTGWCVTAKAPAGHQRWQAAQLLGRAIGAGLFAITPAGERGMCCKAIKLGNARVFPSSEESPLPMYHGTVQSLWNSSMIHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 118170 - protein, 74 aa, Glycine max
  Coding DNA Sequence Number=SeqID_26485
MYCRKMGAYAKDEELLIHSFQRKSYWGSYYLDATTEHVQKGGRSFKRSPEGDMEDPKRANVFHNDEEEIIHDVA

SEQ ID NO: 118171 - protein, 239 aa, Glycine max
  Coding DNA Sequence Number=SeqID_26486
VDPWVLVPITFRGPYVLTIRGLHILACTGLHTLAVRGLRVLIFIPGLSPDIRGRPTVRAHLEREAITHLLCIPGQDFTRAAAKRRVWIMRTNMTTFTWIWMTLLFSNILPGDHNANLPLQMYRDRAHKTPSGPEEVQQGPRVFSSGYGPLSVLQGARTPRQGIAPARHPVDPKKSNRFYGVPVTSSKGIRPPTNRAFIKKYCVPRQAQGETPQQPRDGRQRAIDAPPSPLEFTSAHPQK

SEQ ID NO: 118172 - protein, 103 aa, Glycine max
  Coding DNA Sequence Number=SeqID_26487
MFYQQAAVSSAKPPESPDEEVDDPLYLMTLTIPQLFLKPLQVMWDATIFGVFNQNFPFHLTETSVRAENSDVYGFLEPQSIQRSGQSQFESESYIKSWIQSSK

SEQ ID NO: 118173 - protein, 17 aa, Glycine max
  Coding DNA Sequence Number=SeqID_26488
MAAGTLLVAMAAVATVE

SEQ ID NO: 118174 - protein, 184 aa, Glycine max
  Coding DNA Sequence Number=SeqID_26489
  Gene Ontology: Mol. function=oxidoreductase activity; Cellular component=endoplasmic reticulum; Biological process=electron transport
  Homolog annotation: Hit_ID=Q2MJ01; Match level="QueryCoverage=54%, HitCoverage=20%, E-value=5e-39, Identity=76%"; Hit description =Cytochrome P450 monooxygenase CYP704G7
MAFLSHPYFFAALSAPLTLLVVQILFRKLNKRHNRKKYHPVADTIFNQMLNFNRLHHYMTDLAAKHKAYRLLNPFRYEVYTTEPTNVEYILKTNFENYGKVGAGFGSKRKYMFRKVTIQLKLVEGDSAGTGPFLSQCIELFSSADNPICINELNITSLGIMEIPICLGGSISSTGSTLYVLMFS

SEQ ID NO: 118175 - protein, 129 aa, Glycine max
  Coding DNA Sequence Number=SeqID_26490
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-24, Identity=100%"; Hit description=LacZ protein
MRSKSEARDSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRLLLPYAPPRQ

SEQ ID NO: 118176 - protein, 217 aa, Glycine max
  Coding DNA Sequence Number=SeqID_26491
  Homolog annotation: Hit_ID=A5BU47; Match level="QueryCoverage=90%, HitCoverage=12%, E-value=2e-10, Identity=26%"; Hit description =Putative uncharacterized protein
PPGEERLVVHVDPAIGKVDGSHKKKLRTYLGIVARDKVDMTYKTWKEVPAAQKDLIWEDIQIVGERWRQFKSDLTRKWALAANKDSVDDIVCEKYDISKEKWAQFCQTHRDLSWEAIQKQNTAPHLLSRGGYEYLEQKLMAEKTKKKLEEAAQSGSIEGMIDPSSPIRQHMKCKMAHTKKTGQMTFEATKEIADKIDLLTAAIGRPEHPGRVRATGA

SEQ ID NO: 118177 - protein, 101 aa, Glycine max
  Coding DNA Sequence Number=SeqID_26492
  Subcellular localization annotation: CTP_CleavageSite=88; ConfidenceScore=5.39e-01
KHRRTSALASVAVTLRVTTTPAALNAPLQGASHSPFRLRNCWEGRSGFPSHDVVKRRPVNCNTTHYRANWSSTAVAAALELVDPPGCRNSMVGAFIPNGFK

SEQ ID NO: 118178 - protein, 108 aa, Glycine max
  Coding DNA Sequence Number=SeqID_26493
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=97%, HitCoverage=17%, E-value=2e-52, Identity=75%"; Hit description =Photosystem I P700 chlorophyll a apoprotein A1
RVTMYRTNWGIGHSIKDILEAHKGPFTGQGHKAHHMYSMPPYPYLATDYGTQLSLFTHHTWIGGFLIVGAAAHAAIFMVRDYDPTIRYNDLLDRVLRHRDAIISHLNW

SEQ ID NO: 118179 - protein, 195 aa, Glycine max
  Coding DNA Sequence Number=SeqID_26494
  Gene Ontology: Biological process=transposition, DNA-mediated
  Homolog annotation: Hit_ID=Q1J7G7; Match level="QueryCoverage=19%, HitCoverage=67%, E-value=1e-10, Identity=72%"; Hit description =Transposase
LARASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPEFDALDQTDSSDKESSASPIHIFSIQEEQSIRPVIPQPFGKPVVPAALMNRPTRGERRFAYWALAECILAYYVGTDEGVSEVLHVAGEKRLH

SEQ ID NO: 118180 - protein, 95 aa, Glycine max
  Coding DNA Sequence Number=SeqID_26495
  Homolog annotation: Hit_ID=A2Q1A3; Match level="QueryCoverage=60%, HitCoverage=14%, E-value=8e-08, Identity=47%"; Hit description=RNA -directed DNA polymerase
MCVCVCGCVWVWLCGCVCVCVCAGVGVWSYAARSQLQQGLKINYGKSSFGVLGQSEQWKLQAASYLNCRIMPLPFSYLGIPIGANPEEVPIGWWP

SEQ ID NO: 118181 - protein, 75 aa, Glycine max
  Coding DNA Sequence Number=SeqID_26496
MMTKVMNKKLKRSKNNSRESKNISSESRTSQEFKNQEEFKTQEKSLQTRIWIQDSRSRFKTQDSRIKKGLNQDKY

SEQ ID NO: 118182 - protein, 137 aa, Glycine max
  Coding DNA Sequence Number=SeqID_26497
  Gene Ontology: Mol. function=helicase activity; Biological process =viral genome replication
  Homolog annotation: Hit_ID=Q2R1R7; Match level="QueryCoverage=99%, HitCoverage=8%, E-value=7e-30, Identity=50%"; Hit description=AT hook motif-containing protein, putative
MMFVFTSAGIKFDKSINHSRGPPTIRIQGQPCHRICSMLPMLGKEPKFVQLYIFDTENEVHNRINAISPHNQIQGHIVSQLSEMLDEYNMHAKTFRMTRDRLQDGQVDNIKLKLIANREKDGHTYNVPTIPEVAVII

SEQ ID NO: 118183 - protein, 208 aa, Glycine max
  Coding DNA Sequence Number=SeqID_26498
MLDQFAPFIQGFIRDVVDVNADGNCGYRSFAALLGTGEDLWSLVHNELIKELGRWSHEYMNLFGGTERFEQLKLSLLVDGFSKFKSESFEVAPRIRKNLFLVRFIESTHGLPCAYQGLCETEVTIKEEIEVISKRFDELDVTGKVTLKSKLREIAYPDHNSMCPPPSKVNNKGAPKKPMKRSQTSTKRDPSYWEYVDAFHSVQSSNSQ

SEQ ID NO: 118184 - protein, 96 aa, Glycine max
  Coding DNA Sequence Number=SeqID_26499
MSLQSQKRNPVCDKDELRQKEKEEEHPGSLKANHNGLPKSIPTLSGTLSFPSFLRAAKGVPQSISGRDELHKHELHNVVAVTKAVTTRLVATVSTL

SEQ ID NO: 118185 - protein, 100 aa, Glycine max
  Coding DNA Sequence Number=SeqID_26500
DSTSDSPQISASPYQLDLAPYASEPYNAQWNAPGLLRDKHTLRSSRILRRNGGGVRHWKCGRQALWLILGMAFVDNWVVGKEEIHFDPFTGEDQIRKALR

SEQ ID NO: 118186 - protein, 134 aa, Glycine max
  Coding DNA Sequence Number=SeqID_26501
MVRYAPSSFADLVFADKRIEAGLKRGKFDHLALMNEKTGANEEDENEEGTHVEVAIPTWPNFPSAQQCHYSANINPSHYPPPSHPQRLSLKSTTKPARRTSDAKTSTKKEFCSKKPVGFTPNSGVICYLAPIST

SEQ ID NO: 118187 - protein, 36 aa, Glycine max
  Coding DNA Sequence Number=SeqID_26502
MATSGGLLVELTNQLEARSGNYDRVPTTNGGATTSS

SEQ ID NO: 118188 - protein, 164 aa, Glycine max
  Coding DNA Sequence Number=SeqID_26503
MGEVEKTQENMKADMEAIKEKMATMMEAMMSVKKIMEANAVAIAATSVVAKVNPTSPSGINQMNHPTSDMVGKDLGSTGGPHNVQIQNEHAFPPYGLPLNYTPPNVAYTPNEISITPLPYSLRANNLNLIMHMSLMEETHEIPHHNLADFEPWLGYATEGQAVG

SEQ ID NO: 118189 - protein, 278 aa, Glycine max
  Coding DNA Sequence Number=SeqID_26504
MVADGRLPSRLKRSLDAAKRPANSPSDRFRSSPEAAHGIAIMIVPLGKQRREIPDLIAAFTDVPRLRDELDLREHRTIFYRLKQRRLLAERRRAPHDGREVETKTVDVERVYPVFQAFIRKMRDRRMAEIEGVTAAGPVLIIAILPDPIIATVINSAHGERRAVEIAFRTVVQHHVQNDLNTRRMERLHRVAKLVPRLVRMDGITRLKREHRQGVVAPVVAQPQPLQARLAGEMGDGQQFQGGNAKGVSGRRPSSDAQAPYRCRASLWGSTVQVGSAL

SEQ ID NO: 118190 - protein, 33 aa, Glycine max
  Coding DNA Sequence Number=SeqID_26505
MELERLIKRLSDSGIDDADRRCSKSMETGGAKS

SEQ ID NO: 118191 - protein, 527 aa, Glycine max
  Coding DNA Sequence Number=SeqID_26506
  Gene Ontology: Mol. function=potassium ion transmembrane transporter activity; Cellular component=integral to membrane; Biological process=potassium ion transport
  Homolog annotation: Hit_ID=A7Q2E3; Match level="QueryCoverage=87%, HitCoverage=57%, E-value=0.0, Identity=70%"; Hit description =Chromosome chr1 scaffold_46, whole genome shotgun sequence
  Pfam annotation: Domain name=K_trans; Domain location=1-465; Score =430.8; E_value=2e-126; Accession=PF02705.7; Description=K+ potassium transporter
MGQAAYFSRHHDVEQEYHFGFYVSVPEKLRWPVLVIAILAAVVGSQSIITGTFSIIRQCSALSCFPRVKVVHTSSKIHGQVYIPEINWLLMLLCLAVTIGFRDTKLMGNASGLAVVSVMLVTSCLMSLVIVICWHKNVMLAIGFVLFFGTIEALFFSASVIKFFEGAWVPVALAFVFLSVMCVWHYGTLKKYEFDVQNKVSLSWLLSLGPTLGFARVRGIGLVHTELVSGIPAIFSHFVTNLPAFHQILVFLCIKHVPVPHVRPEERFLVGRVGPRDFRVYRCIVRYGYHDVHKDDDEFEKDLVCSIAKFIQAGSGGGCNNSSNDEPEKGGGKMTVVGTCSSTSHHPILVSENAHEINHVDKAETSSESHKVVKPKKKVRFIVPESPKIDTGAMEELKELMQAREVGVAYIIGQSYMRAKPGSSMLKKLAINLGYEFLRKNSREPSYELSAPHASSLEQGLAFRGHDESTNSANQDIVNAAALETTNAIITDLGDELFVIIVDEARDISNKEQMAIALCYVNKKGSI

SEQ ID NO: 118192 - protein, 184 aa, Glycine max
  Coding DNA Sequence Number=SeqID_26507
MAWLGDQPSPFEADVHMAQEKGTSTDQIPEPSPAPIPDDSMPSAPASELEQLISQDSPTAQSLEENEHAIGSMTENVSQFVKLIVKECINRIPAMFDCDSHLAKNLTTCLNDLSLAPREHHPQKLGSKQICPKFEGAIIKLNSWAKRASIAKHNFNVLSVAEESGRASISRSRVKREISALSAA

SEQ ID NO: 118193 - protein, 94 aa, Glycine max
  Coding DNA Sequence Number=SeqID_26508
MLCVIDYNDLGTSFVVQVEGTSTWVVVTENKRGYISCGSVQVEGTSTWLFKENKGGYIPCGSLLVKVFTRLKRNLKDRRSLRNWMLARVVAEPV

SEQ ID NO: 118194 - protein, 99 aa, Glycine max
  Coding DNA Sequence Number=SeqID_26509
MSDMPLRGLKSARKRTMFYAFFGKRDELAKRVHQYSLYMASRKRKSIGTRPIAQYDTKRFHSFEAWTRYTDNVLGRHILSKRKVEIYHTELDEFKGGIL

SEQ ID NO: 118195 - protein, 251 aa, Glycine max
  Coding DNA Sequence Number=SeqID_26510
  Gene Ontology: Mol. function=nucleic acid binding; Biological process= DNA integration
  Homolog annotation: Hit_ID=A5BW89; Match level="QueryCoverage=46%, HitCoverage=11%, E-value=2e-20, Identity=46%"; Hit description =Putative uncharacterized protein
AANVVVQVNSIPMLNRTNFKVWKEAIEIVLSCMDLDLALRMEQPISTTKTSNEAKIGKVKVKVQWNFLRKLNITLPKMERWRRVTFLAKLISMKYKGKGNIKEDIMEMFNLASKLMSLKPDWWFLVLLCGGDNNDDDGVSSNDGRDTSGVEFGKKENIKNIAFEKEFVIDNDPVLTPIIVQDTTPIIENNVQTIVDDTILEHDNNVVLPQIPIEKPQQQNEDGVGLIEEDQINFCQAMCNSNSQKWIDAMK

SEQ ID NO: 118196 - protein, 70 aa, Glycine max
  Coding DNA Sequence Number=SeqID_26511
MKKERRYLMYTAPPPNDEELMQAASRSVITSQLEFALCRKQVDDPFRLHLVDNHRRVAVALAGHGGAHSG

SEQ ID NO: 118197 - protein, 52 aa, Glycine max
  Coding DNA Sequence Number=SeqID_26512
MNEGSLWVMVRTTPIWICSQSRKGVREDGMAKPRPSPRVQLKTLKKHSKEAT

SEQ ID NO: 118198 - protein, 98 aa, Glycine max
  Coding DNA Sequence Number=SeqID_26513
MQKKLSNCAANFANYAEKWLCSASHAKAWRVDGDPVLRGTRRRLCMCTVVPGDMSRESGDLGDVRWGAIAQNQAWPIPTQPGHSQSVRTCDVPMQASS

SEQ ID NO: 118199 - protein, 143 aa, Glycine max
  Coding DNA Sequence Number=SeqID_26514
MANNEAESDDDDNYDQLLDVFNEMHQEAQKMYVLEVKVECLLKPLSKFTMWRNNLEALLAQQQYAIEKGTSFMVQVEGTSTWVIVTENKRGYISCGLVLVEGTSTRLFKENKGGYIPCGSLLVKDFTRLKRNLKDHRSLGDWM

SEQ ID NO: 118200 - protein, 639 aa, Glycine max
  Coding DNA Sequence Number=SeqID_26515
  Homolog annotation: Hit_ID=Q6WAY6; Match level="QueryCoverage=57%, HitCoverage=62%, E-value=4e-38, Identity=30%"; Hit description =Putative uncharacterized protein
MRCFTFRDFQLVLMLEEFEKIVKCPLRGTKPFFPLGHSPSMPRLSKVMGISVTELREKEVNRNGVRSFPKKFMEHKARECASKREWRYFMSILALLIYGVVLFPSMIDRIDLATVDTFLAYYYRCESPVVAILADVYYTLDLSWEKKSTRVICCLPTLYVWMVSHFVMHNGRPTSPLEDFCMAPDKSKINWEELLASMIGSTICWFLRWEEVPNVLCRCGAFPNIPLMGTKGCVNYNPMLGIKQLGYPINGPPSNGAIQPFIARGLNKEHLGLHQQIRKAWDSPNRRDKELRKKDEDVKVPKKKNDERVEIDVPIETEEALEQEMRRDKGEETNKKRYQGALSGNSNELKLRRAERDQAITKKVTLRDKLKDCWESKESLKEWLGMMEKNMLVIVDQYEGEREAREEVIELLHQERRKWMNRFVITLNESQELPKLLARAKARADIYSAPDEIHSLFYYYQHMEQMKADMETMKGKMTIMMEAVMDMRKIMEVSAVVVVAANTATERDPTHSPIVNQESHLVLDVKGQGGVTGNVTNPIPVCTENHQTQPDHTHAYNSNAREEAREAPIDHTVTSFRPHPGYTAKGKAFFGIPVLNAPGASQYCTLSQPLHFLRGEGPPLVFEKEKIEHIEERLHTIEG

SEQ ID NO: 118201 - protein, 44 aa, Glycine max
  Coding DNA Sequence Number=SeqID_26516
MTLLDSSACINLMPLSTLMRVGDVEGDSNSKCRMRMYLSMSLTL

SEQ ID NO: 118202 - protein, 48 aa, Glycine max
  Coding DNA Sequence Number=SeqID_26517
MLNENAEFKALALKEIRTASDGIRKKQLSYFVTEVGLLCVFQVKLDVP

SEQ ID NO: 118203 - protein, 160 aa, Glycine max
  Coding DNA Sequence Number=SeqID_26518
  Gene Ontology: Mol. function=iron-sulfur cluster binding
  Homolog annotation: Hit_ID=A7Q2C4; Match level="QueryCoverage=56%, HitCoverage=20%, E-value=1e-31, Identity=73%"; Hit description =Chromosome chr1 scaffold_46, whole genome shotgun sequence
  Subcellular localization annotation: CTP_CleavageSite=54; ConfidenceScore=5.23e-01
MVCWCEVPRHWCVVLVFSSHWSSSSSSSRWSSCGAAGRTGVCVLLFMLALLIPFCMRKSGLGRVGDEDVERLIELVKGISCKINLISFNPHSGSFFKPTKYERMIEFRNTLAGAGLIVFLRLSRGDDQLASCGQLGKPGTIQAPLLRVPEQFQMAIGSST

SEQ ID NO: 118204 - protein, 90 aa, Glycine max
  Coding DNA Sequence Number=SeqID_26519
MILDASTGGTMLSKSPKEAVVIIDSIATSDYQSHHDRAPVQRKGIVELDTQNAILAQNKLLTVEASFMMMNQVDSSSFDDDKDDEKKPKE

SEQ ID NO: 118205 - protein, 179 aa, Glycine max
  Coding DNA Sequence Number=SeqID_26520
MPKLLPVGTLTLDLAIALSLALTITHNSPWQRRGYKRLAFLLSKSFALYEKQSFSNALLGDTMKGGGGVRGNRDTTTYTTILDHNIQSTMQVMAQALRAGEHHRVISSNGCSLDWRDKDSALEDETKVEKLEQRNEITTTPPKDLTREWRTQKDLSLDNIIGEISKGVSTRSRLRNVMQ

SEQ ID NO: 118206 - protein, 80 aa, Glycine max
  Coding DNA Sequence Number=SeqID_26521
MGAKYLEVVKRGSHPNNGWSPDEIRVALRKWMMDIDTLVCNGKRGSEDLGKLVNGDCTTFGALIWCGKVHRPHFAIPDWL

SEQ ID NO: 118207 - protein, 83 aa, Glycine max
  Coding DNA Sequence Number=SeqID_26522
MGEIEEVQEKMKADMEAMKEKMATMMEAMLSMKKIMEVNVVVVTATSAVAEMDPTPPSGLNQINHPTSDMVNQGGKELGSVIP

SEQ ID NO: 118208 - protein, 31 aa, Glycine max
  Coding DNA Sequence Number=SeqID_26523
EVNLAIREVCVADGSLLVGASMEAGSLSFNG

SEQ ID NO: 118209 - protein, 61 aa, Glycine max
  Coding DNA Sequence Number=SeqID_26524
MALLWGISGGKSCEQDQETTSESQAPLSVKKKEKSFFICIENFVRKQVTPYHKITLDDEKN

SEQ ID NO: 118210 - protein, 122 aa, Glycine max
  Coding DNA Sequence Number=SeqID_26525
  Homolog annotation: Hit_ID=Q8VX37; Match level="QueryCoverage=27%, HitCoverage=3%, E-value=4e-07, Identity=81%"; Hit description =Putative potassium transporter
MVIGDGILTPAIAVMPAISGLQDQIDEFGTERVFTSASSAVTRISKSERTSWFTEDSTDRSGDTGTLRVLEDPVAGVRRLASGALRTLVQWIRSSVAIGIREEHGGGDDDGDGNGGEMESTI

SEQ ID NO: 118211 - protein, 136 aa, Glycine max
  Coding DNA Sequence Number=SeqID_26526
  Gene Ontology: Mol. function=potassium ion transmembrane transporter activity; Cellular component=membrane; Biological process=potassium ion transport
  Homolog annotation: Hit_ID=Q8VX37; Match level="QueryCoverage=96%, HitCoverage=17%, E-value=7e-52, Identity=71%"; Hit description =Putative potassium transporter
MKSSSGGSNKSRWVDGSEMDWDEVPIWSKHDDGREGIDSFDVEAMEIAGTRAHHSKDLSLWPTIALAFKTLGVVYGDMGTSPLYVFADVFSKVPIGSNDDILGALSLVMSTISLIPLAKYVFVVLKANDSGEGMQM

SEQ ID NO: 118212 - protein, 104 aa, Glycine max
  Coding DNA Sequence Number=SeqID_26527
MKEKPQLSSKFVFRRLGYHHHGNNNSPKGNTLPMRRHVIGQGKSPNERQVVKVNVKEELEDFELDVLLSDDALIPTTVFGILPMEFASQDWLKATLEDDVLVDE

SEQ ID NO: 118213 - protein, 311 aa, Glycine max
  Coding DNA Sequence Number=SeqID_26528
  Subcellular localization annotation: CTP_CleavageSite=61; ConfidenceScore=5.71e-01
MASRKKKATLLDLRNHMTLQDSSLRSHGNTSSRTFTPRTFFQRGTLLYMSRSTMNSDRSSRGAEDKSPRQVKVRGKLIKFDGESLNTFLETPVVLEPREHYSAFSRFCHTHPDPQELASKLYIPGHGFVLNAERAPWKLLRKDLTTLAQTWSVLSYSNLTPTSHTSDLNMDRERLVYRLGDLTLLLLLLLLPPAPVPPAPPVPVPSDTSAQSLDAMVPILQSLHQGLCLVMQSIHNLAQHQPIIIKEEFIAQVAWPGVQPSPVEEGEAPTAQGLQPKPKATPEATSEETPEITPAATPAEDTNYAVDMAVA

SEQ ID NO: 118214 - protein, 33 aa, Glycine max
  Coding DNA Sequence Number=SeqID_26529
MAKYPDWLPYIVPIKRTTRTMEVYIDDVVVKST

SEQ ID NO: 118215 - protein, 148 aa, Glycine max
  Coding DNA Sequence Number=SeqID_26530
  Gene Ontology: Mol. function=transcription regulator activity; Cellular component=nucleus; Biological process=regulation of transcription
  Homolog annotation: Hit_ID=A5CB73; Match level="QueryCoverage=74%, HitCoverage=29%, E-value=2e-20, Identity=48%"; Hit description =Putative uncharacterized protein
  Pfam annotation: Domain name=HLH; Domain location=40-87; Score=42.2; E_value=1.9e-09; Accession=PF00010.17; Description=Helix-loop-helix DNA-binding domain
MPKYNKTSGKRQRGLTSHCSNDDDDKSKSVKESQKEVYQAKNLVTERNRRNKIKKGLFTLRYLVPRITKMDRAAILADAVDHIKELQMQVRELKDEVRELEEQECEKNTPQLRITKAKKQEGTGSNPPLNQSSSGCTKKMQMEVQEFA

SEQ ID NO: 118216 - protein, 274 aa, Glycine max
  Coding DNA Sequence Number=SeqID_26531
MERTIIHINNEPSIHVEHFFDIQELEKDKAFYPKPIRVFLRNVVLRNNKVIVSMVVGVQVTLSNDSISKATRYLHEGNTYHEGWEKAYDSHITRALYKDNTEKTGASYPACRTREKIAPQRLKDLNETDDDEEDNVIKVVVDKLVKALDAFDAKILWIQIVWVDTLKASSSGYDGSDNFQHHDFIQVLNLVRTYHFDDAYACFTKDADSHSFYNVDGERKVNLMKTVQNEGFNLFSFSLTLGNPIRANQRKSLRNLRKLLEILLSLSEYTHEPT

SEQ ID NO: 118217 - protein, 40 aa, Glycine max
  Coding DNA Sequence Number=SeqID_26532
MARLLMEKTRGVATNIYLRKILEKPEMTKGVALAPTYPQV

SEQ ID NO: 118218 - protein, 259 aa, Glycine max
  Coding DNA Sequence Number=SeqID_26533
MILEDKLKACQRSKRILNEQLSRTEENMWAIIDQFAFTLNGSQELPKLLVKAKAMVDIYSLQVDTITKKDKHVLRHPYQTHAKTKIMSEIEEVQEQIKADMETMKDQMTSMMEAMLSMKGMMENNAAVVTTTSAVVEADPTHPSAINQVNQPILDMPVAEACEEPRDQALGDFEPYPMFATKGPACSGMPQPNTVGAPQHRPLQALHFSIGRLPPAVEGREKLDLIEERLRAIEGIGDYPFADMEELCLVPNVVIPSKF

SEQ ID NO: 118219 - protein, 25 aa, Glycine max
  Coding DNA Sequence Number=SeqID_26534
MGVSLAIIGNLLKEVSQGGELSYET

SEQ ID NO: 118220 - protein, 104 aa, Glycine max
  Coding DNA Sequence Number=SeqID_26535
MKALSTPVALSLFIVTAKILDFQMNAFTSQEAWERYTDIVVPRKLLPERNVVVYYTEFNEFKEELERRHWDEELTDFTDSNIDVAIVKEFYANLYDPEDKSPKR

SEQ ID NO: 118221 - protein, 119 aa, Glycine max
  Coding DNA Sequence Number=SeqID_26536
MDEFDAQVAWPGAQPSPSRGGGASATQGPEPEEPTTAAEGEDELTPPEPFYFDAGVHMAQEEETSTDQIPEPSLVSIPNDSMPSAPASELKQPIPQDSPAAQVLDLNEHAQEKPQEQDI

SEQ ID NO: 118222 - protein, 118 aa, Glycine max
  Coding DNA Sequence Number=SeqID_26537
MTQGSFVPHGWDDILNTAIGRPEHPGRVHVVGSVRNEIEEENKRSLEKLKQELKGAIKIEFSQMGLQYSSLIEVDLHALGARVNTKGSNDETIVNPSGEEHDGCVTPTDAILLRKGIG

SEQ ID NO: 118223 - protein, 121 aa, Glycine max
  Coding DNA Sequence Number=SeqID_26538
  Homolog annotation: Hit_ID=A7PBU6; Match level="QueryCoverage=39%, HitCoverage=35%, E-value=4e-07, Identity=58%"; Hit description =Chromosome chr16 scaffold_10, whole genome shotgun sequence
MAAMDLSLGNPLYRKSSWWWVQAACPADGAACQVPLCGSSWSIDVNLSGVYSPRIPQQLLGIKSFCLEEAVGVMALEEGNVKIENFDGRDFNFWKMQDYLYQKKLYQPLSGDKPNDMKQEE

SEQ ID NO: 118224 - protein, 47 aa, Glycine max
  Coding DNA Sequence Number=SeqID_26539
MKKQQWKRSERQRRRGEGRHHPLGNKPRKKELHHQELPWIRSLKRML

SEQ ID NO: 118225 - protein, 262 aa, Glycine max
  Coding DNA Sequence Number=SeqID_26540
  Gene Ontology: Cellular component=cytoplasm; Biological process =protein transport
  Homolog annotation: Hit_ID=A7PZJ4; Match level="QueryCoverage=24%, HitCoverage=13%, E-value=1e-14, Identity=46%"; Hit description =Chromosome chr15 scaffold_40, whole genome shotgun sequence
  Subcellular localization annotation: CTP_CleavageSite=96; ConfidenceScore=5.25e-01
MGIQIATRPTWAFQDVPPEGGCFWRNQPSSPGQAGKSKPRHFRNVSMGDFAKIFNRSSTFFVRSSSFFGLQPLTSRNRVKVGLEDLKKGVRERILRDDERWLSFFKGFGMEMQKGFSHALVKKEAYSQLNYPTKGIRDCPLRLEKMQDILLPSGTNGVKDLLISTSHSSSLALFASLGKKLSVLSLDSNNLVVNYDLQAVQASPSNVARGLSSLYKEIIDTVRKEATTITTVFPSPMAYEKTQELARDLQVVGCGDLDVDSV

SEQ ID NO: 118226 - protein, 102 aa, Glycine max
  Coding DNA Sequence Number=SeqID_26541
MKANETRNELKVSDSKTYRLKNEERMKNGEERRKTFMDLLTETSWKCYGSTSAWIFFTETIFSPKTAGMHSQGGLGIIWNSLPSPIYKKMGEEVAAQLAQAS

SEQ ID NO: 118227 - protein, 400 aa, Glycine max
  Coding DNA Sequence Number=SeqID_26542
  Homolog annotation: Hit_ID=Q00M75; Match level="QueryCoverage=12%, HitCoverage=7%, E-value=1e-09, Identity=72%"; Hit description=PPR -repeat containing protein
MKVKEEKLEMKPGFIATEVEDEETLVQKCESGDSDNGNSDSNNNGSNDSDDDDVKVVVTMVIMMMMLVIMITMVVVTTMKVAMTNIFVFWRASPGAAVKLCLGDLLVMGSNPETASLHMQGTPALTFLKHSSSHIFKTLKLSCQNPQTSLALVVVVQSSLSCSHHHRAAIDVEVVNPSTNVLSSLEGDRCRTGCHDITLQNMQIRCVRRKSTLNSVSSRSNSPCLQPSHLTTTLKDTPEINSEQKRSTLHTRDQLYTLEINSTHIGPTLDDIVSDIVDPAASLLHLTFILHCTATPVFSGRMSGHCIRHRGSCSFTSALVFYLALYSNSSILGQDDIDDIEVWGAAKGALGVCGYGPGHNKGALGFGVGVHGYALAVSFFLITFLVASLLTDPSEVQVGK

SEQ ID NO: 118228 - protein, 246 aa, Glycine max
  Coding DNA Sequence Number=SeqID_26543
MDQEVISIGGSSLEDTRCGAFDSESSSSERLTGKIDFVSLNNVSKKLFEFDSNIFRRFKDHFIKVLSIDVVDDGLPLMFNRDEEPHFPFYWQSDPTREGRKNYFGVAAVSLDVRTILSLPSVSDPLVALDGIMGGFAYRPLVKQVGHAGRDVPLSAIATVVGEGGQPISEVGPIAIVVEVTPNALSSILEKRKRDEVLGRLVATRLTPDTGRLSIVQEVPLTPSVVESFVATPATFVLSPPSVVAV

SEQ ID NO: 118229 - protein, 81 aa, Glycine max
  Coding DNA Sequence Number=SeqID_26544
MQSRHGKKIRTRGYPPESVPTLTGNTRVDRVWVRVRVFPDNQKSDTGTVSGMGHFAELSRSGRVKVDDDDGTGAIAEFILR

SEQ ID NO: 118230 - protein, 339 aa, Glycine max
  Coding DNA Sequence Number=SeqID_26545
MGAKYLEVVKRGSHPNNGWSLDEIRVGLVGDDVPHFAIEPPIGEEGQHVTRVGLNDGEVVEVTPNVPPFVLSKRNHDNGATTIVAPAPPTPPSLPAQEVFISLFTVVVAQVPLVAPIMALPSITVMPLLCASVATVITSVEALSKVASLETEVSKWRATAQTMWRVESEGSQGGGDTVAEKEELAIESAKEVSIELEEELLTFKKEAVERHEKGFYKDVRKLEFFTKGLELGLFDPFKDGYLLEGRRLTKDRPWVFRALKICQGLPKEDLGFVEPWRFVEAHQGRTLGLSSLGDLSRLTKDGPWPLKIQSRIVHHGFGETHQGKTLGLTSLGRVDTRKL

SEQ ID NO: 118231 - protein, 57 aa, Glycine max
  Coding DNA Sequence Number=SeqID_26546
MELSLKIEMLHFKVSDIIATRRVITIVEVMAGRNDRSIADVLQALAQAMGNQNRGET

SEQ ID NO: 118232 - protein, 278 aa, Glycine max
  Coding DNA Sequence Number=SeqID_26547
MCSLEIIEYLPRDKGIAIYSNNKVIRDNLSVESLIDKGRLPCVEALTNMRVTSISSPKHRQELFCAESGNLDKCKSCRRNQVCQVRDVPVSDDFVLFLIVGECIEDKSFVCLFVVDECSAPRCSCIHVTHGVGTYWRRGTWVFSSTLSSFISNFAIGIGDSDSGSLIQQPLVDQKVISINGSSKEEARHGASDSESPSLEWLTVSCRASGTSHPRGKAQPSATSPIEELVPITMILPSYIFGGARKSGGGGVRASPRARCSHSARSSSSLLPLLVLNR

SEQ ID NO: 118233 - protein, 166 aa, Glycine max
  Coding DNA Sequence Number=SeqID_26548
  Subcellular localization annotation: CTP_CleavageSite=74; ConfidenceScore=5.47e-01
MGAPEMSPPPSSAPPVPSTTVLTVKSPSSSFHPHVSLDHIYSSNNAYSLWGMRYKPEQKTLIGFVLAFDKNLIRSAGVQHAMNSAKRPNCKVEPPSVFQGEKGLGWPGGGHGGGERRACQGGGEPHVEAKLHGYIYLGLTENKRGYISCGSVLVEGTSTRFKENKG

SEQ ID NO: 118234 - protein, 106 aa, Glycine max
  Coding DNA Sequence Number=SeqID_26549
MLLTKGCQQTVCAIGQCMWERLRSSAMLPMGWGCDSPWMRLGKSVCVYHSCRTSMGVCEGGSRMRPDRVLTMDGCKKIDERPRDMFYHDPMVCTKCSLPKSGTMTR

SEQ ID NO: 118235 - protein, 154 aa, Glycine max
  Coding DNA Sequence Number=SeqID_26550
  Gene Ontology: Mol. function=phosphoprotein phosphatase activity
  Homolog annotation: Hit_ID=A5C1K9; Match level="QueryCoverage=36%, HitCoverage=4%, E-value=1e-11, Identity=53%"; Hit description =Putative uncharacterized protein
  Pfam annotation: Domain name=DUF1723; Domain location=74-123; Score =33.5; E_value=7.6e-07; Accession=PF08330.1; Description=Protein of unknown function (DUF1723)
FAQCLDRIPSCAQCWHDDPAGLLMCTMFTQCSSRILDVHNDPTGFLTRIVVAQCLGRIPDVHNVCIMSRVPDTHSDPVGFLMRTVFAQPKIHSFHLPVGECTITLEDVALQLGRRVDGRPVMGATYYDWEDMCQQYLGVVPSKGEALVDFAIKI

SEQ ID NO: 118236 - protein, 97 aa, Glycine max
  Coding DNA Sequence Number=SeqID_26551
MSHNGQVRSLSLSEIIGRLVRVVALPPIPFLAPPLAPLPPPTPVPPLTHAPFLGPALPRAPNPLPPYPLLRPEAHAAAILPRRGVEGTANFLDWRAI

SEQ ID NO: 118237 - protein, 72 aa, Glycine max
  Coding DNA Sequence Number=SeqID_26552
  Gene Ontology: Mol. function=catalytic activity
  Homolog annotation: Hit_ID=A7NWL1; Match level="QueryCoverage=66%, HitCoverage=15%, E-value=2e-14, Identity=78%"; Hit description =Chromosome chr5 scaffold_2, whole genome shotgun sequence
MYPLPHKGCTLQCVKTKFSGACFYTKSFDELIVKPRLKQGGIFVTQAGPAGIFSHTEVFSCIYNTLRHGKYY

SEQ ID NO: 118238 - protein, 109 aa, Glycine max
  Coding DNA Sequence Number=SeqID_26553
  Subcellular localization annotation: CTP_CleavageSite=47; ConfidenceScore=5.47e-01
MGQMATQLNQAQSQNSDKLPSQTVQNSKNVSAITLRSGKQIEVPPPVAAPAPEPVKLHSTPEKEDDLAAQKRKLPDHEGANKNFHAGGPSSSSSDMQQPPIPLPNKGLT

SEQ ID NO: 118239 - protein, 470 aa, Glycine max
  Coding DNA Sequence Number=SeqID_26554
  Subcellular localization annotation: CTP_CleavageSite=40; ConfidenceScore=5.04e-01
MVVSLFLKWHLQSPFLLLHSTAMIFKKQRTPLMKKIKGLQAPHGATSLNKSVLLKNLPFDLPHSIYTNILRNLKGLCGLDDIYYATVINKLLWDQGMYHVFNKMDDDSKDNLVVKDAINKRKQKKLAKAITDEDRVETSVPQRLKNLSKTNENDEGRIKTRATNANPKIGENEWIVSFIRNKEDYASSSSDIESTDETHIFHLNKRQATSTQPCPPPSFINLEKFSLAFINGNSLSESSFSKSISIEPLHKETIIVQALAWTRYDYEHTPSEAFKALPTDNIWKKLVRAPDAYNTKTFRNQIVWMGTLKASTSNYDGSDNTAHHDDACKMTEEQMITHVTQIHDAQKKKKAEKEEEALVVASMKEKDASVQAKDVDGTIVHGVINDLTNISIMDKTPKASNAAITIEVVHHVQELIVTRDHVQDMIGQAMESFVERQHQENEQFRLFVQNSITTEVSNLIDILMQNLQQA

SEQ ID NO: 118240 - protein, 460 aa, Glycine max
  Coding DNA Sequence Number=SeqID_26555
  Homolog annotation: Hit_ID=Q8H0U2; Match level="QueryCoverage=95%, HitCoverage=89%, E-value=1e-144, Identity=54%"; Hit description =Putative uncharacterized protein At2g12400
GIEGGGEGEHYHEVLPWKTRRSMAEEEATSNASLILAQKRTTRKDPLDNFNRYTGGWNISNRHYIASVVFTAVPFFVVAAVWFVVFGLSLSLICLCYCCCPREPYGYSRLAYALSLIFLILFTLAAIVGCVLLYTAQGKFHGSTTSTLKYVVSQADFTAENLRNVSHYLDAAQKIGVDAVFLPGDVQKNIDEVQTKINSSAAELSSKTKENSETIKDVIDAMRLALVIVAAVMLFLAFLGFYTCVAMDGWVQNPTAHTALDEILPCVDNATAQETLLRTRDVTHQLVNLVDNIVSNVTNRNLPPAAVPLYYNQSGPLMPRLCNPFNSDLTNRSCADGEVSLDNAAEVWKNYTCEVSSSGICKTPGRMTPTIYGQMEAAVNVSYGLYHYGPFLVDLQDCTFVRKTFTDISNDHCPGLQRNSQLIYIGLVLVSAAVMLSLIFWVIYARERRHRVYTKQFIEG

SEQ ID NO: 118241 - protein, 170 aa, Glycine max
  Coding DNA Sequence Number=SeqID_26556
  Homolog annotation: Hit_ID=UPI0000ECBAF8; Match level="QueryCoverage =24%, HitCoverage=48%, E-value=2e-16, Identity=100%"; Hit description= UPI0000ECBAF8 related cluster
VGTGERTRELPGGNAGIFIVLSGFATSDLSVDFCDARQGGGAYGKTPATRPFYADTARRSRTTERSESVSEEAEERPIRKPPLPARNSYDHDYEFELGTLTLQPMSSLKLQKMVFFFGMQAWHWPSFYNVVTGKTLALPNLIALQHIPLSPAGVIAKRPAPIALPNSCAA

SEQ ID NO: 118242 - protein, 254 aa, Glycine max
  Coding DNA Sequence Number=SeqID_26557
  Homolog annotation: Hit_ID=Q6WAY4; Match level="QueryCoverage=81%, HitCoverage=36%, E-value=4e-14, Identity=28%"; Hit description =Putative uncharacterized protein
MGLNQTPYFKKRFYHVKIKSLEVASLQELGQWMDQLQCKAFRKTYGKIWDLAMIEVSVEAIASLTQYYDQPLRCFTFGDFQLVPTVEEFEGILGCLLGGRKPYLFSGLYPSMARVAKVVKISAQELDRVKQNRNGVVGIPKKHLEEKAKALADQGEWTLFNDVLALLVFRVVLFLNVDGLVDLAAIDAFLAYHHSKESSAIAILVDAYDTFNRRCKKSSARIVCCTPALYGRSLIGSPYGRKEGSEYCPHVKGS

SEQ ID NO: 118243 - protein, 44 aa, Glycine max
  Coding DNA Sequence Number=SeqID_26558
MAVVNPGKIYQSPFPRWYNPNATCAYHVGVPGHSIEQCVAFKHK

SEQ ID NO: 118244 - protein, 193 aa, Glycine max
  Coding DNA Sequence Number=SeqID_26559
MDNEEGVQEQMKVDLSALKDQMASISEVMLKLQKTIEDKATATASSIVREAEPVLQPALNPGRDRNTEVFGRRYSPQAYPYGLLPDFTPRATPEDLSQAPTFEGQLPPYDDYPGQDDEEGDTHLGPLLHLKDPFPHELPQPNIVRHIPTSPTPVKESVPFMEDKGKIEALEERLRAVEGLGNYPFSDLVDLCL

SEQ ID NO: 118245 - protein, 158 aa, Glycine max
  Coding DNA Sequence Number=SeqID_26560
YCTPRQAQGDAHQAADAPPPPRQADPTGSLGMEHYLQHLVRQQAANHRGQVQIHKCLYRFSLSQQGQGSAPFACPTPEQFGAEVAWPGDWPEAQAGEEPAGSPGEAEEAHMDEDMTDLLGFLGGSGATVNAVYALTFIMSSHSTSLEPKSQLTINLDP

SEQ ID NO: 118246 - protein, 144 aa, Glycine max
  Coding DNA Sequence Number=SeqID_26561
MATVEALERETKKARKEELKVCLRSKRNLSQQLRETEGNMWAIIDKCKEKLNLAATHEQRLEDEYAKISAEREARERVIDSLHQEATMWTVRFALTLNRSQELPRLLAKAKAVADTYSAPEEIHGLLSYCQHMIDLMDHMIGNR

SEQ ID NO: 118247 - protein, 71 aa, Glycine max
  Coding DNA Sequence Number=SeqID_26562
MGGLGIRDLPSLNKALLFKWKWLMFHQPDQLWTRILISMYNGWRGLEYGPRKQYFSTWWADLRAIFQQQNV

SEQ ID NO: 118248 - protein, 180 aa, Glycine max
  Coding DNA Sequence Number=SeqID_26563
MGDQEEIQEQMKADMSALKEKLSSMMDAMLGMRQLMEKNVATAAAEHTGHTSNPHLGYNRVAYPYGLPPNYTFPDMHDDTGHVLSPILEGEPPRHPDEIHKDHREYAQGDVNFYPPVPVEGSVPNTLPQHNLTAQPIFLSTEGPRLAAEERRKLDLIEERLRAVEGFGDYPFTNMTDLCL

SEQ ID NO: 118249 - protein, 142 aa, Glycine max
  Coding DNA Sequence Number=SeqID_26564
  Gene Ontology: Mol. function=aspartic-type endopeptidase activity; Biological process=DNA integration
  Homolog annotation: Hit_ID=A5BPN8; Match level="QueryCoverage=84%, HitCoverage=17%, E-value=2e-31, Identity=44%"; Hit description =Putative uncharacterized protein
MQGCLSYRKLIDSERWIYGGYASYGESFNAKLRGTKRRIDNTNSGALWHKCLGHISKNKIKRLMSNRILDSIDFTSFDVCVECIKGEHRPRPFASYLEEYGIVPQYTMSGSLGMNSVTERRNITLKDMIRSMICHSNLPESL

SEQ ID NO: 118250 - protein, 159 aa, Glycine max
  Coding DNA Sequence Number=SeqID_26565
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAACKLGTGRRLQRRDWENPGVTNLIALQHIPLSPAGVIAKRPAPIALPNSCAA

SEQ ID NO: 118251 - protein, 107 aa, Glycine max
  Coding DNA Sequence Number=SeqID_26566
MVNRSQIPMMMNVAKVSSRFLPEWRYPDVSSIGACRPRIFFINGFHCFMEDEWQQNEERKRERRRHFKEKMSLEEAHHHRRPWIRAWRKKEMNDGRGREEHEILCSK

SEQ ID NO: 118252 - protein, 163 aa, Glycine max
  Coding DNA Sequence Number=SeqID_26567
  Homolog annotation: Hit_ID=A5BSF6; Match level="QueryCoverage=56%, HitCoverage=27%, E-value=2e-07, Identity=31%"; Hit description =Putative uncharacterized protein
MGTLELGPHIPTIVYVSTSTTTQKLRDQWTEEDRRKIQYDLKAKNIITSVLGIEEYFRVSNCTNAKDMWDTLQLTHERTTDEHEMELQRINQNEENDKKKRSIALKASSSMQEENEEEDSDDEEDFSFFVKKFQKFIKKRRIDRRQDFNNGRKSQDDSQVLRC

SEQ ID NO: 118253 - protein, 150 aa, Glycine max
  Coding DNA Sequence Number=SeqID_26568
MKRWWATHPQSFADLVFASERINVGPKRGKFDHPTRMTEKTGANEEGEKEGETHAVTAIPIQPSFPPTQQCHYSANNQPSPYPPPSYPQRPSLNQPQSLSTALPMTKTTFSTNQKTATKRNFAAKSPVGVHPKFRCPMLNLIPYPFDYSM

SEQ ID NO: 118254 - protein, 107 aa, Glycine max
  Coding DNA Sequence Number=SeqID_26569
EEEPRIGADCSSATFNKSEIYKEEAGNAAQKHKAKRVASVNVDAEAFGDHWESSVCSMHSEAEALEHMKKRDTGHQSESLENKTGDSTVLKIGDSTKVVIKQYMKGG

SEQ ID NO: 118255 - protein, 146 aa, Glycine max
  Coding DNA Sequence Number=SeqID_26570
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=34%, HitCoverage=55%, E-value=1e-17, Identity=78%"; Hit description=LacZ protein
MEKRQATRPFNGSWPFAGLLLTCSFLRYPLILWITVLPPLSELIPLAAAERPSAASQHASLALAVVLQRRDWENPGVTQLNRLAAHPPFASWRNSEEARTDRPSQQVAQAEWRMAPDAVFSPYASVRYFNTAYGALSVQSALMPHS

SEQ ID NO: 118256 - protein, 199 aa, Glycine max
  Coding DNA Sequence Number=SeqID_26571
MFDQQAVVSPSKTPQSPDLEVDDLLYLMTLTIPDLFLKPFQVNWDATVFEVFNPDFPLYIKHEDLSEITHGGQCLNIFVLQLWILHLTETSMRARNFDVYGFLKPQSIQRSGQSQFDTESYIKSWMQSSKRDVYLGAYLNGRHWQMVVILPKENLVVWFCSLHNRPDNYLKGITNSTLKGLDDTPQPKSKAAARWIVVK

SEQ ID NO: 118257 - protein, 99 aa, Glycine max
  Coding DNA Sequence Number=SeqID_26572
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=85%, HitCoverage=72%, E-value=3e-24, Identity=69%"; Hit description=LacZ protein
MLYIQNGRQKVSNSCSPGDPLVLERPPPRWSSNSPYSESYYNSLAVVLQRRDWENPGVTQLNRLAAHPPFASWRNSEEARTDRPSQQLRSLNGEWGRAL

SEQ ID NO: 118258 - protein, 137 aa, Glycine max
  Coding DNA Sequence Number=SeqID_26573
  Subcellular localization annotation: CTP_CleavageSite=43; ConfidenceScore=5.19e-01
MYALHVGNSRHNNLSNVKGRLGIVARSQGTTYELMTRFVVSVCLSGASAKTCASIGTLSFYVNCLVMDDRTKESATKHKTRVYLVKRGVQIATRPTWALQGFQQKAVHSGGSNPARLASWVATTSLFSPINRGKRTE

SEQ ID NO: 118259 - protein, 89 aa, Glycine max
  Coding DNA Sequence Number=SeqID_26574
MDNEEGVQEQMKADLSALKDQMASITEAMLKLQKTIEDNATAAASNTAREAEPVLQPAINLGRDRNVTGFNRSYSPKAYPYGLPPDFTP

SEQ ID NO: 118260 - protein, 80 aa, Glycine max
  Coding DNA Sequence Number=SeqID_26575
MKAQVEKDEDPEAETLSRQLITYQGNPCGVYPDLSSFTGSGVYPDLSSFTGSGVIQISVTCIKRSAPAQVHIIWYQSFGS

SEQ ID NO: 118261 - protein, 75 aa, Glycine max
  Coding DNA Sequence Number=SeqID_26576
MIHLVDAEWGIGFTLATVLVAATATALASIIFFTLIMASIIAAICSFMASMSASIYSCTSSALPITLALAQERMQ

SEQ ID NO: 118262 - protein, 100 aa, Glycine max
  Coding DNA Sequence Number=SeqID_26577
MGDQEETQEQMKADMSALKEQMASMLEAMLGMRQLMEKNVATAAAVSSAAEADPTLLATAHHPPPNAVGQGRSTLGQFSNPHLGYNRAAYPYGLPPYYTP

SEQ ID NO: 118263 - protein, 87 aa, Glycine max
  Coding DNA Sequence Number=SeqID_26578
APSEEGIAPFIARGFSDLNAKMLQRVRKAWNAVQRNDKELRGSNNGVIGGFQVRKRLKSLSNNKLKLRRAERDESRLESMILEDKLK

SEQ ID NO: 118264 - protein, 120 aa, Glycine max
  Coding DNA Sequence Number=SeqID_26579
MCMIILRLLALNEYRSGVIDILIGSVRHIGWRIVGRQAIWSPSAMELGAAITAALTSIISFMLIMAPIIGAICSFKASVLAFIYSCTSSTSPITLALARGKNAMSNATNEEHGCMRMMHS

SEQ ID NO: 118265 - protein, 143 aa, Glycine max
  Coding DNA Sequence Number=SeqID_26580
MTGLRCSKVRLSETTPLALHRAVIRAGNPSLEELDWAIEVIWPEMRAPTFMSMREARPKINPALSTIRSEVYDVGAKLEYERTLHDWAKAAKSFLRILLGWPSAFKMNPRPACSIWSIWAKSHLLPTPQCLQECVEAVSVDLH

SEQ ID NO: 118266 - protein, 59 aa, Glycine max
  Coding DNA Sequence Number=SeqID_26581
  Gene Ontology: Mol. function=aspartic-type endopeptidase activity; Biological process=DNA integration
  Homolog annotation: Hit_ID=A5BFR9; Match level="QueryCoverage=72%, HitCoverage=3%, E-value=1e-14, Identity=93%"; Hit description =Putative uncharacterized protein
MCVQEEERLIMEEGEKNEALDAFKVFKAEVEKQCGKQIKIVRSDRGGEYYGRFYTEDGL

SEQ ID NO: 118267 - protein, 92 aa, Glycine max
  Coding DNA Sequence Number=SeqID_26582
IILGTPQDEATTSPSFSESEEAKGEESSEEIYPQEEGQPLMVKEECKEILVSTATPLGLEVIPQVTELLDEGLVHKILNPCALCWIKWPRNN

SEQ ID NO: 118268 - protein, 136 aa, Glycine max
  Coding DNA Sequence Number=SeqID_26583
MAKFDPEVVLEFYANAWPIEEGVRDMHSLVRVLEEGQEFEFSQRRNRVDGFDEEAIAQLLCTPGQDFAQIAVGRRVRIKRTSMTTLTQTWMTLLLSNVLPRDHNSDFPLPKCQLVYAILTRMSVHVAQACHPPGTL

SEQ ID NO: 118269 - protein, 166 aa, Glycine max
  Coding DNA Sequence Number=SeqID_26584
SLRAIRLFVLQTSKKNVYTDNHSGISARQHDSNVSMTDLVSAEDDTSKKNVCTDNHSGISAGQRDSNVSMTDLVSAEDDVNLRVSTGLSAAIDEGAEDDTAKKNVYTDNHSGISACQRDSNVSMTDPVSTEDDISKKNVCTDNHSGISAGQRDSNVSMTDLVSTEE

SEQ ID NO: 118270 - protein, 23 aa, Glycine max
  Coding DNA Sequence Number=SeqID_26585
FLRVSPFWKSSVIGWLMIGSSSE

SEQ ID NO: 118271 - protein, 82 aa, Glycine max
  Coding DNA Sequence Number=SeqID_26586
MADFMEYQASSKGYYYSMQQQGTQFERDYSSADYQEGPELQPYYQNEAEREVEAQKESPVKEHESREKMRNMHNNNGRSTQQ

SEQ ID NO: 118272 - protein, 246 aa, Glycine max
  Coding DNA Sequence Number=SeqID_26587
  Gene Ontology: Mol. function=cellulose synthase activity; Cellular component=membrane; Biological process=UDP-glucose metabolic process
  Homolog annotation: Hit_ID=A9CEL4; Match level="QueryCoverage=99%, HitCoverage=37%, E-value=4e-95, Identity=71%"; Hit description=Beta 1,3 glucan synthase catalytic subunit
  Subcellular localization annotation: CTP_CleavageSite=58; ConfidenceScore=5.12e-01
MFMQLGLSSLALFWAYSTWISGKRTLPLFTEVTHALTAVPITITLFQAMRKPFGRPFKVTEKGGDRSQVRVHGPTALFFALVTLTSAISVLIAVYGWDAPVEFSARDCLNLIWSAVAMMIAFISLICCIELPRFDREEPISVNLGGQLRQGNAVTGVKIVALSTETVTLAGFTSSTEAQAIFVPEVGWLQIDATKDQLIPGKFCLAATAEQHRAILRLLFRTAPENVAEQGDLIKSMQMLLARAFS

SEQ ID NO: 118273 - protein, 107 aa, Glycine max
  Coding DNA Sequence Number=SeqID_26588
  Homolog annotation: Hit_ID=B0HC01; Match level="QueryCoverage=30%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTPKFKVPNFDKYKGTTYPQEPHEDVLSEYGGIHEG

SEQ ID NO: 118274 - protein, 98 aa, Glycine max
  Coding DNA Sequence Number=SeqID_26589
MRDGKRSSYIIRSGVNSGNGLGGKFLVVLELPAGRVVFGVGIWGASLWVGALGCTGVELEAFPGLTHAGVEETAWASPSFLFAPVAPILLAFAFVEET

SEQ ID NO: 118275 - protein, 90 aa, Glycine max
  Coding DNA Sequence Number=SeqID_26590
MGFRGFQDTQCFFEAGGSNPACLGELGSNLLPLFPINWLKGTVLRIPDAPDVKIQAEVLPERFREVSVSKSVKVFLRYSAFFIRSSFFNG

SEQ ID NO: 118276 - protein, 50 aa, Glycine max
  Coding DNA Sequence Number=SeqID_26591
MFAYSPFAKRKPRAKRISVHALSYKSQALSAQPLHLRLIWSAKLAKVELS

SEQ ID NO: 118277 - protein, 277 aa, Glycine max
  Coding DNA Sequence Number=SeqID_26592
  Gene Ontology: Mol. function=protein kinase C binding; Cellular component=cell projection
  Homolog annotation: Hit_ID=UPI00006A2D9E; Match level="QueryCoverage =71%, HitCoverage=100%, E-value=2e-09, Identity=20%"; Hit description= UPI00006A2D9E related cluster
TIPLNVLAFRGLHVLAFRGLHILAMRGLHVHAFRGLHALTFRGLQVLAFRGGYTPSPSDEYTPFSSEGYTPSPSEHYTSSPSEGYTPTPSQVYTSSPLEDYMSSPLKDLTSSPSEDYTGLHVLSFSGLHVLTFRGMHVLAFGGVHALAIRELHVLAFRGATRSRPQRTTHPNIQRTARLHLQRATSPRLQRATCPHLQRTTPPPLQRATCPNLQRATRPRLLRTRHPRLQRAAGPRLQRATCPRLQRASRPHLQRATCLRHQWATRHHLQRTICTHL

SEQ ID NO: 118278 - protein, 195 aa, Glycine max
  Coding DNA Sequence Number=SeqID_26593
  Gene Ontology: Mol. function=protein binding; Cellular component =extracellular region; Biological process=defense response to fungus
  Homolog annotation: Hit_ID=Q1SWI6; Match level="QueryCoverage=70%, HitCoverage=61%, E-value=2e-38, Identity=59%"; Hit description =Leucine-rich repeat, plant specific
  Pfam annotation: Domain name=LRRNT_2; Domain location=26-66; Score =47.6; E_value=4.5e-11; Accession=PF08263.3; Description=Leucine rich repeat N-terminal domain
  Pfam annotation: Domain name=LRR_1; Domain location=119-144; Score =10.3; E_value=3.8; Accession=PF00560.24; Description=Leucine Rich Repeat
  Pfam annotation: Domain name=LRR_1; Domain location=146-168; Score =17.3; E_value=0.06; Accession=PF00560.24; Description=Leucine Rich Repeat
  Pfam module annotation: Pfam domain module=LRRNT_2::LRR_1::LRR_1; Domain location=26-66::119-144::146-168
MNSSIYILVFVQLWLFSLPCRESVCIPSERETLLKIKNNLIDPSNRLWSWNHNNTNCCHWYGVLCHNVTSHVLQLHLNTSDSAFYHDHDGYLYSDFDEEAYEKSQFGGVISPCLADLKHLNYLDLSGNEFLGEGMSIPSFLGTMTSLTHLNLSYTGFTGKIPPQIGNLSNLVYLDLGGYLTDLGFLFAENVEWVS

SEQ ID NO: 118279 - protein, 161 aa, Glycine max
  Coding DNA Sequence Number=SeqID_26594
PGDGHSLSVSGCRERQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPTGLVFDKVQRCGWILVERGIWVEVSTINISR

SEQ ID NO: 118280 - protein, 360 aa, Glycine max
  Coding DNA Sequence Number=SeqID_26595
  Gene Ontology: Mol. function=structural constituent of ribosome; Cellular component=ribonucleoprotein complex; Biological process =translation
  Homolog annotation: Hit_ID=Q6AD01; Match level="QueryCoverage=48%, HitCoverage=68%, E-value=4e-79, Identity=86%"; Hit description=30S ribosomal protein S3
  Pfam annotation: Domain name=KH_2; Domain location=252-306; Score =84.9; E_value=2.6e-22; Accession=PF07650.8; Description=KH domain
  Pfam annotation: Domain name=Ribosomal_L22; Domain location=70-167; Score=61.4; E_value=3.1e-15; Accession=PF00237.10; Description =Ribosomal protein L22pL17e
  Pfam annotation: Domain name=Ribosomal_S3_C; Domain location=308-360; Score=29.6; E_value=1.2e-05; Accession=PF00189.11; Description =Ribosomal protein S3, C-terminal domain
  Pfam annotation: Domain name=Ribosomal_S3_N; Domain location=186-251; Score=95.3; E_value=1.9e-25; Accession=PF00417.10; Description =Ribosomal protein S3, N-terminal domain
  Pfam module annotation: Pfam domain module=KH_2::Ribosomal _L22::Ribosomal_S3_C::Ribosomal_S3_N; Domain location=252-306::70 -167::308-360::186-251
  Subcellular localization annotation: CTP_CleavageSite=42; ConfidenceScore=5.64e-01
MIYRPCWVTRSRSTTDVSTSLCSCPRPWSVTSWASSRPPAPSAAMRRTTRRAVAADAGTIEEREMVESIARVRHIRVTPQKARRVVALIKGKQAQEALAILKFAQQSASEPIYKLVASAMANAQVKADRDGEYLDEQDLYVKNAYVDEGTTLKHQEAHEPHHGRALDAGGGPGRCWRQQQEGEQVMGQKVNPYGFRLGITTDHVSRWFSDSTKPGQRYADYVAEDIKIRNLLKTQLDRAGVSNIEIERTRDRVRVDIHTARPGIVIGRRGAEAERIRGDLEKLSGKQIQLNILEVKNPEADAQLVAQGIAEQLSARVAFRRAMRKGLQGAQRAGAKGIRIQVSGRLGGAEMSRSEFYREG

SEQ ID NO: 118281 - protein, 87 aa, Glycine max
  Coding DNA Sequence Number=SeqID_26596
MASLSYFHEESGYGEHHQDNCYFYSINNFDRRQEPAMYNYYEKGRAPDLESVLADFMTYQDTSKGDCYSMQQQGTQFERDYSSTDYQ

SEQ ID NO: 118282 - protein, 80 aa, Glycine max
  Coding DNA Sequence Number=SeqID_26597
AFSGGALVLTNMDGEELPSPVNSDVGQDHLGLPSGVETKHERQKPIKVLKDGCKWGWGHDRPIDAPSLRETSRECRCKAA

SEQ ID NO: 118283 - protein, 92 aa, Glycine max
  Coding DNA Sequence Number=SeqID_26598
MESGDMQGYHMVICTIHQPGANEPVDVQRLTCRCNCLWCFDDDHDDMMQLMQMGFSRLNSRQYFKITSHNIKMITSILGREFLIELAKGLAK

SEQ ID NO: 118284 - protein, 180 aa, Glycine max
  Coding DNA Sequence Number=SeqID_26599
  Homolog annotation: Hit_ID=A7UQU7; Match level="QueryCoverage=55%, HitCoverage=17%, E-value=1e-13, Identity=41%"; Hit description=IMP dehydrogenase/GMP reductase, putative
  Pfam annotation: Domain name=DUF1723; Domain location=148-180; Score =14.6; E_value=0.0098; Accession=PF08330.1; Description=Protein of unknown function (DUF1723)
RDRAADEDAGDVPERRRPTASARRLRVHQMTTEGRDMAEDVADMTDDVPEQPTEAPEMRADAQGADSGEGSDGDDAAKGFPGGPRDPSVLTSFAEHVAHAVWSGQERPDLKLVSHGRKVTLIGRPVPEIEGLVAATGLSPLIDCSVITGDPGLISAFVERWHSETSTFHLPVGELTITFG

SEQ ID NO: 118285 - protein, 70 aa, Glycine max
  Coding DNA Sequence Number=SeqID_26600
MFYENAPTIWDQHKLKGELKPSDPKAYTLKSLSWPLPVDLVLLNLNNNIIISRQHIIPQFITYFIYKHCS

SEQ ID NO: 118286 - protein, 103 aa, Glycine max
  Coding DNA Sequence Number=SeqID_26601
MTYTKKTDQMMFEAAKEIANKIGKHPGRVRAAGANVTIKQYFGPTPRTSHTSSSIAPKDMEQLTQKIRDQLEESITEKVLALPPEPVDGRSATHVSTKAMSSS

SEQ ID NO: 118287 - protein, 72 aa, Glycine max
  Coding DNA Sequence Number=SeqID_26602
MLVSRVPKGANKVQGPTARIWCPIIPISGTCGSNAFQDYFDDAKKSRVKQVSRIKIQDSRIIKIKIQDSIFK

SEQ ID NO: 118288 - protein, 205 aa, Glycine max
  Coding DNA Sequence Number=SeqID_26603
  Homolog annotation: Hit_ID=A7QNA6; Match level="QueryCoverage=30%, HitCoverage=7%, E-value=4e-11, Identity=60%"; Hit description =Chromosome chr2 scaffold_132, whole genome shotgun sequence
MALCSVFLNLHLLLFVCLTIEALGVAKPSVATYLSQEILAEQEVDRVHGLPVQPPVKFKNMVVISLSMKLKEEHCSIGFSRPLTNQNKNPFSYGSMQLFHKLPSFFLPLPPSSFPPSPPPPPLPFLSSPFPSNECFFMSDSANKLRLVRFPKCQNLLLELADYSVYQCGGCGAVLRAKHKGYVSGSLSDEGKVGLGGDSGKLESS

SEQ ID NO: 118289 - protein, 115 aa, Glycine max
  Coding DNA Sequence Number=SeqID_26604
  Homolog annotation: Hit_ID=Q1SL03; Match level="QueryCoverage=71%, HitCoverage=25%, E-value=5e-07, Identity=31%"; Hit description =Ribosomal protein S2; Nucleic acid-binding, OB-fold
  Pfam annotation: Domain name=DUF223; Domain location=14-110; Score= -1.9; E_value=0.0046; Accession=PF02721.5; Description=Domain of unknown function DUF223
FYVRPTFFVRLLLFATVCKTEKGSKIGATLWQELFTELRDKLQCGSSYLIQNLRIVDNQSEYRVNPAPYLVYFLKTTSVKEIHRPEIPSNVYLITPFTDIISGLAPRHTLVGEFV

SEQ ID NO: 118290 - protein, 200 aa, Glycine max
  Coding DNA Sequence Number=SeqID_26605
  Homolog annotation: Hit_ID=UPI0000ECBAF8; Match level="QueryCoverage =18%, HitCoverage=42%, E-value=3e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLPQFVLLLQYALPPAMAIESTCRHASLALAVVYNVVTGKTLALPNLIALQHIPLSPAGVIAKRPAPIALPNSCAA

SEQ ID NO: 118291 - protein, 121 aa, Glycine max
  Coding DNA Sequence Number=SeqID_26606
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPEEVISASEADSIEDSGPGEMAISGGSSS

SEQ ID NO: 118292 - protein, 262 aa, Glycine max
  Coding DNA Sequence Number=SeqID_26607
  Homolog annotation: Hit_ID=Q6WAY6; Match level="QueryCoverage=95%, HitCoverage=51%, E-value=6e-28, Identity=31%"; Hit description =Putative uncharacterized protein
MGQLQRQAFRKAYGKIWDLAMVEVSTEAIASHAQYYDQPMRCFTFGDFQLSPMVEEFEEILGCPLGGRKPYLFSGFYPSLARISKIVQISAQELDHRKQVENGVVGILRKYLEEKATILAGKGEWAPFIDILALLIFRGVLFLNVDGLVDLAVIDAFLAYHNQKESTIVAMLADLYDAFDRRCEKRNTRIVCYTPALYEGRTGVLISCGGFPNVPLMGMRGCISYNPVLPIRQLGYPMRGAPLEDELVMQSYPARALGRRLQ

SEQ ID NO: 118293 - protein, 128 aa, Glycine max
  Coding DNA Sequence Number=SeqID_26608
GEMNIWTAHDQGWEQELSPYNQYEEERTPNLESGFVEFMAYHVPYPNFVRGPLFVGMFLSLDHLKIFNTHHCGIRKVPRCFEKKLVKNTKMRVYLAKWGGSNWAASSSTLLKNGFRGFRGFRKISENL

SEQ ID NO: 118294 - protein, 162 aa, Glycine max
  Coding DNA Sequence Number=SeqID_26609
  Subcellular localization annotation: CTP_CleavageSite=46; ConfidenceScore=5.05e-01
MPPTRHPLDPDKSNRALGFPALITSLCQSFGFPVTPRKVIRPPITRAFVEKYCTPRQAQGGDPQAPDAPPPPHQADPTGSFDTERYLRHLVCQQAANHRAHGFAPFPCPTPDQFRAKVAWPRDWPEAQVGEVPAEAPGDADEACMDEEMTDLLDFLGGSGAT

SEQ ID NO: 118295 - protein, 89 aa, Glycine max
  Coding DNA Sequence Number=SeqID_26610
MAMRDGKRSSYVIGIGTWGASLWVGALGCTGAELEAFPTAWPSPSFLFAPVALMEACLWGFYGGWIFELQWGPLMVIFHHGDAAEDKGK

SEQ ID NO: 118296 - protein, 218 aa, Glycine max
  Coding DNA Sequence Number=SeqID_26611
MTTLTWIWQTLLVSNILPSDHNANLPLQMYQLGSRPQDAQWTRRSPTGPWGFQLWLRASDSPTGYPFPQRGIAPTKTPSGPGEVQQGPGVSSSGYGPSVVLQGARSPRQEIVPARHPVDPKKSNRVLKFPSSNYGPLSVLRSACRPSKIIRSPTNQAFIKKYCVPKQAQGETPQQPRDGRQRATNVPPSPLEFTSAHPQKVRALLTTHGRPIGDQVQS

SEQ ID NO: 118297 - protein, 48 aa, Glycine max
  Coding DNA Sequence Number=SeqID_26612
MVIFHHGDAAEDKGEEDDSMEEKKEGEKERWGEHEIEGKKEGEKWNFE

SEQ ID NO: 118298 - protein, 256 aa, Glycine max
  Coding DNA Sequence Number=SeqID_26613
MALLVVNMNAESHTRGLDWLAKLKVVSEESFEAPEEDEEVQALKNELGKARLAKEKFKLAATDIRKECVGLREENATTARALEQETKRARKEEYGRNKFRGALWGSNSELKLRREERDQSRAHGMVLKEELVACSRSRRNLSQRLCKTETNMLAIIAKYQEELSLATAHEHRVADEYAQVYAEKEARGRVIDSLHQEATMWMDRFALTLNGSQELPRLLAKAKAMADTYSAPEEIHGLLGYCQHMIDLMTHIIRNR

SEQ ID NO: 118299 - protein, 41 aa, Glycine max
  Coding DNA Sequence Number=SeqID_26614
MGGGGVWLFGKTARKPHCKRNLKESWALSSKGTTPENLAFH

SEQ ID NO: 118300 - protein, 277 aa, Glycine max
  Coding DNA Sequence Number=SeqID_26615
  Gene Ontology: Mol. function=DNA binding; Biological process=DNA recombination
  Homolog annotation: Hit_ID=A4SRA4; Match level="QueryCoverage=59%, HitCoverage=37%, E-value=8e-48, Identity=58%"; Hit description=Phage integrase
  Pfam annotation: Domain name=Phage_integrase; Domain location=1-151; Score=-7.6; E_value=0.0038; Accession=PF00589.13; Description=Phage integrase family
MATFTGLRKSEIFGLAWSCVNLGGRYFWIDTTKNGDPLELPITRTLLALFRRRAAARREEHPLVFPGIKTTIKEYRHVTGRISRSTVPEPNPDNLQPIPFKWHDARRTYGTVAELAGVGSYILKRLMNHRTLRSADVTQGYLHFGADELQAPAAKIEHAILGYSGRADKPEGLDARLKEALEHLSDDEKRRLLFSLSEKVNETAGRISPKFQTRSGVWTSRKAAMTVPGWPCSNPICCFCLNSTTTQPFHFFCSESFDILDRPILHVYDVGMIAASV

SEQ ID NO: 118301 - protein, 122 aa, Glycine max
  Coding DNA Sequence Number=SeqID_26616
MSWQPAIGRMRLLTKFQVIWISFEGSNPSDLQPFDPEIDRTFHRLVRHHFIPFDHPEHSITGEYVHSVIGDFEHPDFEHSNFEHSENMAQPPPRERTLREMAAPDFTYEILCIQYPDEDVPY

SEQ ID NO: 118302 - protein, 127 aa, Glycine max
  Coding DNA Sequence Number=SeqID_26617
RQAQGDAPQVADVPPPHQAGPAGSFDTEQYLQHLVRQQAANHRAHVQTHDCLYKMSLSLQSQGFTSFPCLTPDQFRAEVAWPGDWPEARAGEAHAEAPAEAPDEADEAREDEEMTDLLDFLGGSGAT

SEQ ID NO: 118303 - protein, 160 aa, Glycine max
  Coding DNA Sequence Number=SeqID_26618
  Homolog annotation: Hit_ID=Q51617; Match level="QueryCoverage=25%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPNLMESSILAQDERWRHALHMQVGREVVFPVADG

SEQ ID NO: 118304 - protein, 100 aa, Glycine max
  Coding DNA Sequence Number=SeqID_26619
MVKHSFGIGAAIVAFFGYQNDMDGQWVWKHDLPPTVPDECTPSPPPQRDSSSSLLHDVLSELQDPRAFVGDRFDAMDSCITRLEDDMSFIHRCFDPPVDS

SEQ ID NO: 118305 - protein, 44 aa, Glycine max
  Coding DNA Sequence Number=SeqID_26620
MEENYPNFPLALRHMPSKGPPATDWSVQFVHQSEDGRSTSPKKI

SEQ ID NO: 118306 - protein, 216 aa, Glycine max
  Coding DNA Sequence Number=SeqID_26621
  Homolog annotation: Hit_ID=Q6WAY4; Match level="QueryCoverage=55%, HitCoverage=21%, E-value=2e-13, Identity=34%"; Hit description =Putative uncharacterized protein
MRYRSFDLHQLLSHFSKHGNKSNRQEVLPSQGQKPRYHQHQGIRAVDGTLSKCKAFRKTYGKIFRVDHSGGIHRSHCITHPNTTTSLLRCFTFGDFQLVPTIEEFEEILGCPLGGRKPYLSSGCLPSLSRIATMVKDSARGLDRMKQTRNGIAGLPRRYLEDKARGMANQGDWVPFMDVLALLIFGVVLFPNVDGLVDLAAIDAFLAYHHSKESPV

SEQ ID NO: 118307 - protein, 154 aa, Glycine max
  Coding DNA Sequence Number=SeqID_26622
MLTFRGLHALTFRGLHILTVGGLHALAFSGLHALAFRGLHVLTFKGLHTLIFRGLYVLPLRGLYVVPLIGLHVLAFRGLHILHFRGLHVLPFRGLHALAFIPGPPPDIGGGPTVRAQPEKEAITQLLCIPGQDLTHAAAKRQVRIMCTNMTTLT

SEQ ID NO: 118308 - protein, 199 aa, Glycine max
  Coding DNA Sequence Number=SeqID_26623
MAHEMVLRIESGCSGSRNGRYAAIRTVRDARQGGKLLALAYSATTTVTSTAATCFATLGFGTRPYAAGGGSGGEAESPESTGSTEATTHSGSATGRYEYRHRAGVDSLIADTLVIDMDETDLPNALHHHYTIDRNALRSASRLGSGITTTWSFIRGFYKVHAPSKARPSWCCYVKVRLEKVRDYGNGPLALVHQVDPEE

SEQ ID NO: 118309 - protein, 136 aa, Glycine max
  Coding DNA Sequence Number=SeqID_26624
MIMRGQDICSSQDQATTSPSSSESEEAKAEESSEEIYPQKEGQPLVVKEKCKEVSVSSKRLAKKETHFTIKTNIKETFPLRQPPHFLFCKKTLASIATPLGFEFIPQVKKLLDEGLDIEASKQAPQASFHHVVYEL

SEQ ID NO: 118310 - protein, 162 aa, Glycine max
  Coding DNA Sequence Number=SeqID_26625
  Gene Ontology: Biological process=transposition, DNA-mediated
  Homolog annotation: Hit_ID=Q1J7G7; Match level="QueryCoverage=18%, HitCoverage=42%, E-value=2e-10, Identity=100%"; Hit description =Transposase
  Subcellular localization annotation: CTP_CleavageSite=36; ConfidenceScore=5.20e-01
MVKVGPLTCRSTSHFRQKLAQGFPVSTGTPGFIYLRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSISTFEFGAMFHDCLIADPQGNPPFSPFFGAP

SEQ ID NO: 118311 - protein, 72 aa, Glycine max
  Coding DNA Sequence Number=SeqID_26626
IAPTRHPVDPKKSNRALGFPALVTGLCQSYRMPIPPTRSCHRDIGIAPTKTPSGLRELQQGPGVSSSGYGPL

SEQ ID NO: 118312 - protein, 74 aa, Glycine max
  Coding DNA Sequence Number=SeqID_26627
MVIALDGAHVRYVGCCVCSWGAKCIDLVGWPIHGGQVWLKNLSISEGMLRRFNWSMVIGTCLWPRSYVVYSVCS

SEQ ID NO: 118313 - protein, 181 aa, Glycine max
  Coding DNA Sequence Number=SeqID_26628
GSHPQRHPVDLKKSNRALGFPALVTGLYRPYRALVPPASSCHHDIGKDCARKTPSGPEEGQQCLGVASSKYGSLSVQGSACCPQQGHQAPYQSSFHLEVLRPQAGAGRDTTAALGWPVAGNRHTATTSRVNLSSSTKRLERCLRHMADQQATKSKAKGKQSTRSVTYKPSCVQLKTLKKRY

SEQ ID NO: 118314 - protein, 105 aa, Glycine max
  Coding DNA Sequence Number=SeqID_26629
MKANIEAMKWNKWPSMMEAMSSMKKIMELMRCSCHCHHSFSGVDPTPIPSRPHLNHPRKRNSSPILIESQQLQYDHAHVSQPMGETHEMPHHNLADFKALPRICH

SEQ ID NO: 118315 - protein, 168 aa, Glycine max
  Coding DNA Sequence Number=SeqID_26630
AVAEVDPTPPSGLNQISHPISDMVGKRGKELGSTGGPHFVQVQNKHAFLPYGLPTNYMPPNVVHTLDENVNNSTPILVEGQQPQFDHSHGQEIGGVPLPNTLKGPQFCPQPQPLHFAVGRALLAMAEKEKLDQIEERLRVIEGGGDHAFADMEDLCLVPNVVIPPKFK

SEQ ID NO: 118316 - protein, 103 aa, Glycine max
  Coding DNA Sequence Number=SeqID_26631
MRSHERLYFYLKTQSIKCLFDRCFDGLVGGNLLGENFNLPLGSLEGLEVLKCCLVFTTSVRKMKEAVDLAKRIFQGREIVEGFQLRIKSNDSYVEARFLSLDD

SEQ ID NO: 118317 - protein, 38 aa, Glycine max
  Coding DNA Sequence Number=SeqID_26632
MDINASTIFTAKHPRLKQGKHLKGKTETEHTLNKIPRH

SEQ ID NO: 118318 - protein, 26 aa, Glycine max
  Coding DNA Sequence Number=SeqID_26633
MAPPERNPVLPLRDAAHEAGRGQFHM

SEQ ID NO: 118319 - protein, 155 aa, Glycine max
  Coding DNA Sequence Number=SeqID_26634
MGPLQRKAFRKVYRKILDLTAAEVLHVWDFQMVPTIEEFEEILGCPLGGRKPYLFSGFLPSLSKIAAVVGDSAKEMDPMKQTQKYLEGKARDMASQEKWGPFAPTPLTGGVTTTVHGLSVVYTYSNKTQDTRVRIKVIAHAPKKEESIGTNIWLG

SEQ ID NO: 118320 - protein, 64 aa, Glycine max
  Coding DNA Sequence Number=SeqID_26635
MYPLLVPQRTLQCVGTKNSQAVSPLNLCKGKQKISQAGEERHKRIQAVSHSVLLAKGEENEKDE

SEQ ID NO: 118321 - protein, 21 aa, Glycine max
  Coding DNA Sequence Number=SeqID_26636
LGFVQDYSVMLFIIQSFVEVL

SEQ ID NO: 118322 - protein, 231 aa, Glycine max
  Coding DNA Sequence Number=SeqID_26637
MAEKNFEAPEEDEEVWALKTELGKARLAKEKFKLVATDVRKECVELREENAATAKSLEQETKRARKEEHGHDKFRGALWGSNSELKLRREERDRSRAHSIVLKEELAACSRSKRNLTQHLCEIETNMLAIITKYQEELSLATTHEHRVADEYAQVYAEKEARGRVINSLHQGATMWMDRFALTLNGSQELPRLLAKAKAMADTYSAPEEIHGLLDYCQHMIDLMAHIIRNR

SEQ ID NO: 118323 - protein, 254 aa, Glycine max
  Coding DNA Sequence Number=SeqID_26638
MAKFDPDIVLEFYANAWPTEEDVRDMRSWVRGQWILFDADAIGQLLGYPLVLEEGQECEYGQRRNRADGFDEEAIAQLLCIPGQDFARTAAGRRVRIMRTNMTTLTQIWMTLLLSNILPSNHNSNLPLPKCQLVYADAIYLFAGMAPTRHPLDPDKSNRALGFPALITGLCQSFGVPVAPTKVIRPPSPGLLLRSTAPRDRLRVMLHRPQARRHHLIRLARLGRLTWSSIYGMWFARRRPTTGPMCGPMRPFTS

SEQ ID NO: 118324 - protein, 79 aa, Glycine max
  Coding DNA Sequence Number=SeqID_26639
MDRHRHRPYFLLLPRPGKRCSIFPDRHCKGPTNKGISIRFKVFSRIELHSILVGKAAKVPFIRDYNLHQPMQKVSKTGM

SEQ ID NO: 118325 - protein, 144 aa, Glycine max
  Coding DNA Sequence Number=SeqID_26640
MGEVEEVQEKMKADMEAMKEKMATMMAMMSMRKIMEANAVTIAATSTVAKVNPMPPSGLNQMNHPTLDMAHEIPRHNLADFEPCLGCATEGKAVGGIPLQNPLEGPQYHPQLHLLHSTTSKNPHAMAEMGKLDHLEERLRAIEG

SEQ ID NO: 118326 - protein, 111 aa, Glycine max
  Coding DNA Sequence Number=SeqID_26641
MMTFNNEFKIESRTLQGSRGNLISRIKIQDSRIIKIKIQESREDLINISIKKFFKTLSSTRSFHKIITKEFYSLTENKRGYISCGSVLVEGTSTRLFKENKGGYIPCGSLL

SEQ ID NO: 118327 - protein, 94 aa, Glycine max
  Coding DNA Sequence Number=SeqID_26642
MAEASGNRLPASVIDYTEEWVTDEPARTLQRTVEWILPTPTPYRLVEPVPSDREGDEDPLLEVDSPEEVMSASEADSMEDSGPGEMAISGGSSS

SEQ ID NO: 118328 - protein, 88 aa, Glycine max
  Coding DNA Sequence Number=SeqID_26643
MGQFCQTRRDPSWEDSLEEQASQGSFVPHGRQDLLTAAIGRPEHLGRVRATGAGVTIKQYFGSAPQSSCSSSSMPPEKLKQLTQQIRD

SEQ ID NO: 118329 - protein, 178 aa, Glycine max
  Coding DNA Sequence Number=SeqID_26644
MTSRDQIWSFCTLVSSRGGGPDDTRKYPSGYPYKHSFAISCLWHFSGENNETFSSLTSYPELRRSEFLIGGYVGARASLLSTAPLSVAMTQELVARGDTLRLSAPRHSVTPSVIDEQKPIWSSAPFPEMSAFSDGDFSSLTNYPELRRSEFLIGGYVEQEPCFCRPPHNLCHTDPEVM

SEQ ID NO: 118330 - protein, 77 aa, Glycine max
  Coding DNA Sequence Number=SeqID_26645
MSEYCNSFFLISFIYYSILHNVPPFSPCLPTTPTTARLHHPPELRQPCTTTTTHEGSTLALKDYWRREHVGRKVLAR

SEQ ID NO: 118331 - protein, 67 aa, Glycine max
  Coding DNA Sequence Number=SeqID_26646
MNRKEIVIETCHFPLASTPLNCDTLYENGHSTQARQGYDEEDMYLPDIRDVGLSPGGGGGEIDRDRL

SEQ ID NO: 118332 - protein, 73 aa, Glycine max
  Coding DNA Sequence Number=SeqID_26647
MVAPQNHSEALKPQDPSCRSNDAWEHLPNTGHRRKPSIFRKKIDLLQHQELAAQNRTRLYNHGGCTSSVPSPG

SEQ ID NO: 118333 - protein, 51 aa, Glycine max
  Coding DNA Sequence Number=SeqID_26648
MEVDEPWLGLWLPLNYQVDMGSSLASPNGIWDFVVDLGMAFVDNWVVGKEE

SEQ ID NO: 118334 - protein, 130 aa, Glycine max
  Coding DNA Sequence Number=SeqID_26649
MMTKLMTKSSKVNKRMSSRCSRRNQEEFKTQEEKLKNTSRFKKKDEFNGLQVVPSAVRLMKQANVLPLKKTLKKFIIWEINSDKGILDMNGSGMEKEEREETPLQGEDESRRSSPSQEAMDKSLEEEGDE

SEQ ID NO: 118335 - protein, 73 aa, Glycine max
  Coding DNA Sequence Number=SeqID_26650
  Gene Ontology: Mol. function=helicase activity; Biological process =viral genome replication
  Homolog annotation: Hit_ID=Q6AUR0; Match level="QueryCoverage=75%, HitCoverage=6%, E-value=1e-17, Identity=80%"; Hit description =Putative uncharacterized protein OSJNBa0077L08.8
  Subcellular localization annotation: CTP_CleavageSite=57; ConfidenceScore=5.16e-01
MSMSPSQSPWPFMLLRRQFPIMLSYAMTINKSQGQSLSSVRLYLPKPVFSHGQLYVALSREKKSSSQKFKMST

SEQ ID NO: 118336 - protein, 184 aa, Glycine max
  Coding DNA Sequence Number=SeqID_26651
LTFGAIIFGTNNVQAQNTTATTTVNITLNDVISIDAGSTAIGNTVDFNYVTAADYNSDQTITKANSLKVTSTKNFNVKVKAGGANFMNGTNLIPVNVLTIKAATAAGTMGGTKNAVVLSATDQNLVTNAPLGSALTLNLDYTIPAAKSSSSDILGFLRRPLILYVLYRYKYNSKSGNKYLSYVR

SEQ ID NO: 118337 - protein, 15 aa, Glycine max
  Coding DNA Sequence Number=SeqID_26652
RKKLPNVSIPHAWRQ

SEQ ID NO: 118338 - protein, 356 aa, Glycine max
  Coding DNA Sequence Number=SeqID_26653
  Gene Ontology: Mol. function=ligase activity; Cellular component =integral to membrane
  Homolog annotation: Hit_ID=A7PAX5; Match level="QueryCoverage=68%, HitCoverage=93%, E-value=2e-91, Identity=68%"; Hit description =Chromosome chr16 scaffold_10, whole genome shotgun sequence
MEKRYNKRTRWGGALHAVIGKRKECGYTEVIIYLRLSQYLTEGMHEVTWSSVGLLSMGEDTMANNNEEEEEAVTPMVKLGSYGAEVRLVVGGEESAAEETMLLWGIQQPTLSKPNAFVSQASLQLSLDSCGHSLSILQSPSSLGTPGVTGAVMWDSGVVLGKFLEHAVDSGMLVLQGKKIVELGSGCGLVGCIAALLGSEVIVTDLRDRLRLLRKNIETNMKRVSLRGSVTATELIWGEDPDPELIDPTPDFGYNSLPQLLQGAVVDLLETLMQLSGSDTTIFLAGELRNDAILEYFLEAAMDNFTIGRVEQTLWHPDYCSNLPNKSLPYCDILMGRNADLAGNWNSVHQDLAKLC

SEQ ID NO: 118339 - protein, 114 aa, Glycine max
  Coding DNA Sequence Number=SeqID_26654
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=50%, E-value=4e-23, Identity=98%"; Hit description=LacZ protein
MNSDRSVVPPGDPLVLERPPPRWSSNSPYSESYYNSLAVVLQRRDWENTGVTQLNRLAAHPPFASWRNSEEARTDRPSQQLRSLNGEWDAPCSGALSAAGCGGYAQRDRYTCQR

SEQ ID NO: 118340 - protein, 216 aa, Glycine max
  Coding DNA Sequence Number=SeqID_26655
MAEPSKQRKGSSSRSQRHSEVQDTPIPSSISSSSLFSLEEQRIRYTNLFSSCSIIDPKFIDMDFFSDESFKCIQAFQNSNLIPFMPLKLPVYSELVKAFYSNLEIQESTLISEVYGIKMVIDQSLFYDLTQLSNDGVPFEGALDDDWKFDFSVHDARRLVCTNQVDMIGRLLAGSLALETRILHYLIVCEILIPMPDVVPDVTTSCFRTCRLYLRV

SEQ ID NO: 118341 - protein, 123 aa, Glycine max
  Coding DNA Sequence Number=SeqID_26656
MSPIFKGRHALTFRGLHVLAIIGLHSLVFKRRHVLNFRGLHALAFRGLRVLIFRASSFLLSVPGAPPDIGGRPTVRAHPEREATTHLVCILRQDFTRAAAKRRVRILLRKHEHIFMDMDDVTI

SEQ ID NO: 118342 - protein, 194 aa, Glycine max
  Coding DNA Sequence Number=SeqID_26657
  Homolog annotation: Hit_ID=Q6UUU1; Match level="QueryCoverage=44%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAATGQVLVTALLQASYLGQRVGSSENLSKTALAR

SEQ ID NO: 118343 - protein, 51 aa, Glycine max
  Coding DNA Sequence Number=SeqID_26658
ACGCSGILCPDRSVEAVIKGVAKDAPAALSALISRLAHGFDADALPDSPLR

SEQ ID NO: 118344 - protein, 134 aa, Glycine max
  Coding DNA Sequence Number=SeqID_26659
MTLLLSNILPNDRNADLPLQKYQLGSRPQDTQWTRRRPIGPWGFQLWLRASISPTGCPYPLGKVMPSRHRDRARRTPSDPKKSNRVLGFPALITGLCQFYGVPVTPTRSLGPALNRAFIKKYCAPRRAQGETPQ

SEQ ID NO: 118345 - protein, 259 aa, Glycine max
  Coding DNA Sequence Number=SeqID_26660
  Homolog annotation: Hit_ID=Q6UUU1; Match level="QueryCoverage=27%, HitCoverage=46%, E-value=1e-18, Identity=71%"; Hit description =Putative uncharacterized protein
  Subcellular localization annotation: CTP_CleavageSite=43; ConfidenceScore=5.06e-01
LEPPYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIPRSYISSIVMRNQTYLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 118346 - protein, 54 aa, Glycine max
  Coding DNA Sequence Number=SeqID_26661
  Subcellular localization annotation: CTP_CleavageSite=31; ConfidenceScore=5.04e-01
MVTPPRSPPQSDGKTARKPHYKRNLKESWASSSKGNNTRKSSLPWIQTENANET

SEQ ID NO: 118347 - protein, 42 aa, Glycine max
  Coding DNA Sequence Number=SeqID_26662
ESFEGLHSELQPRMFGGATLETAQRVKQTFNVTKTSETLIAI

SEQ ID NO: 118348 - protein, 359 aa, Glycine max
  Coding DNA Sequence Number=SeqID_26663
MVVLWERRVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNVLPTDHNSDLPMPKCQLVYAILTRMSIHVAQLIADAIYIFAGMAPTKHPLDPDKSNRALGFPALITGLCQSFGVPVAPTKVIRPPITRAFIEKYCRRRTPPPHQAGQAGAFGIEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 118349 - protein, 197 aa, Glycine max
  Coding DNA Sequence Number=SeqID_26664
MPYYGVIKEIWEVDYGEFRVPLFKCKWVNGNTEDPCDSRWAVVLQGRTICIGHHVDGSTLDVTDMPSFSKDMPSSTIEQEEDDVYANRTDHDEGLWENIPTAMATPPPSPPKSENPPEVTLKRTRQSTRLRSLTSRCLDGPRPVVNVNPATCRGSGPHKEKFHSYLGVVAREKVPIVHANWNVVPDDLKSLIWKDIL

SEQ ID NO: 118350 - protein, 37 aa, Glycine max
  Coding DNA Sequence Number=SeqID_26665
MLATGGGEEGVRVWVGVGRGGEGENRVFHAEERIYNM

SEQ ID NO: 118351 - protein, 72 aa, Glycine max
  Coding DNA Sequence Number=SeqID_26666
GQDRLGLPFGVKTKHERQKPVKVLKDERNRGWGHDRPIVTLLCAKQAGNVAARQPRILCILQLSFTICLGKE

SEQ ID NO: 118352 - protein, 65 aa, Glycine max
  Coding DNA Sequence Number=SeqID_26667
MCPPLIKREASGDWETRSSVVFRIGSFAKYVYMEEKRRSRDESRHHGKGKTDEISVLSLLSSYLR

SEQ ID NO: 118353 - protein, 99 aa, Glycine max
  Coding DNA Sequence Number=SeqID_26668
  Gene Ontology: Mol. function=RNA-directed DNA polymerase activity; Biological process=regulation of transcription, DNA-dependent
  Homolog annotation: Hit_ID=A5AQL0; Match level="QueryCoverage=100%, HitCoverage=9%, E-value=1e-19, Identity=36%"; Hit description =Putative uncharacterized protein
MVATVYQTSHECSEETIIDILVTGFSGQLKGWWDNYLTNEEKSTELLSNLKCKTLADFTWYKDTFLTKVYTRKDSQQPFWKEKFLASLPRSLGRGVELR

SEQ ID NO: 118354 - protein, 76 aa, Glycine max
  Coding DNA Sequence Number=SeqID_26669
  Gene Ontology: Mol. function=DNA binding; Cellular component =cytoplasm; Biological process=regulation of transcription, DNA -dependent
  Homolog annotation: Hit_ID=Q8S8I2; Match level="QueryCoverage=73%, HitCoverage=25%, E-value=3e-12, Identity=54%"; Hit description =Protein ULTRAPETALA 2
YGKEKSRSMYNLSVQILGLLITCDDEEGSGLKASRGCSRSSTCQDCSTCYCEGCIKCHFEDCNCQECRDFMLYAKP

SEQ ID NO: 118355 - protein, 89 aa, Glycine max
  Coding DNA Sequence Number=SeqID_26670
  Subcellular localization annotation: CTP_CleavageSite=51; ConfidenceScore=5.39e-01
PLGPSGIFLQKAVASGGSNPARLGELSSPGRAGRQPPPLFCYNRGGRQEGRAEALPKRFRNVFREEFRKDFNRSSTFFIRSSSFFDLQR

SEQ ID NO: 118356 - protein, 116 aa, Glycine max
  Coding DNA Sequence Number=SeqID_26671
MPHSHTLLVVFPLSVATICGDEEFTKIVGIANKSPSDLRSLRFLFQPYKNPFTSKDPQGMYPPLFSLNLVDVPSTRTDPQDMYPLLFSVNNPSRCTLYLYHKGCTLQCVKTKISGG

SEQ ID NO: 118357 - protein, 47 aa, Glycine max
  Coding DNA Sequence Number=SeqID_26672
GGGDEYHQLEGVQRLLLDAMNAQMQRLLDRTNEEVYGRLEALENQAN

SEQ ID NO: 118358 - protein, 60 aa, Glycine max
  Coding DNA Sequence Number=SeqID_26673
DRRPQEVNISLPHFHGKDNVEAYLDWEMKVEQLFACHLSYPNFVRGPLLDDVRPFFGPRE

SEQ ID NO: 118359 - protein, 173 aa, Glycine max
  Coding DNA Sequence Number=SeqID_26674
MEMVGYTPSSFVDMVFAGKRIEVGLKGGKFGHLALMKTGASEEDENEGETHVVTAIPIQPSFPPTQQCHYSANNKLSPYPPPSYPQRSSLNQPQSLSTALPMTNTTFSANQNTNQEMSFAVSSTSIFPRIRLEPTCAHHGGALGHSIKHYMTLKHKVQSLIDAGRLKFEENRV

SEQ ID NO: 118360 - protein, 58 aa, Glycine max
  Coding DNA Sequence Number=SeqID_26675
  Subcellular localization annotation: CTP_CleavageSite=22; ConfidenceScore=5.24e-01
MINIAQIKWPNSLKTVPSGVANCRNYPSAGGRHVTRGQRGCFPCTYVFLNCEKEIRPT

SEQ ID NO: 118361 - protein, 112 aa, Glycine max
  Coding DNA Sequence Number=SeqID_26676
  Homolog annotation: Hit_ID=A5ATN6; Match level="QueryCoverage=78%, HitCoverage=66%, E-value=2e-09, Identity=43%"; Hit description =Putative uncharacterized protein
MPKISMFKHKDTQAKAEYVKKLHEQVKAQIEKNNASYARQANKSRKKVVLEPDGGTLDLRTNPFQERGSDEDTTKDKGHEALEGPMTRGRLKQTQHVIETRLVICIAAIDDD

SEQ ID NO: 118362 - protein, 108 aa, Glycine max
  Coding DNA Sequence Number=SeqID_26677
  Pfam annotation: Domain name=Ins_element1; Domain location=33-101; Score=-13.6; E_value=0.0026; Accession=PF03811.4; Description =Insertion element protein
LPGINRDTRIYLFCEVIFRHRYYSAQSASGAPVASVSISCPSCSATDGVVRNGQKHRRTSALASVAAAQLLGRAIGAGLFAITPAGERGMCCKAIKLGNARVFPVTTL

SEQ ID NO: 118363 - protein, 76 aa, Glycine max
  Coding DNA Sequence Number=SeqID_26678
MENHDHQSQEIMDNRLAQQNEQILNKMSKWQRILTPLHIVYHSRTPMSITYHSIGEQNKAMSEMKCSKVDRPWNGK

SEQ ID NO: 118364 - protein, 110 aa, Glycine max
  Coding DNA Sequence Number=SeqID_26679
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=64%, HitCoverage=10%, E-value=5e-14, Identity=53%"; Hit description =Chromosome chr9 scaffold_7, whole genome shotgun sequence
MERVGGDVVQWVETTFSEGRESEVLDPEIAGSRNWLGEMEQLLHIGAACTKSNPQQRLDMAKTVIRIMEIKFECGHESTSLANSHHAEQSQRRHGTNSFGSWDNIEYGSS

SEQ ID NO: 118365 - protein, 16 aa, Glycine max
  Coding DNA Sequence Number=SeqID_26680
MADQQATKSKAKVGRT

SEQ ID NO: 118366 - protein, 85 aa, Glycine max
  Coding DNA Sequence Number=SeqID_26681
DLVKGRTIGITKELGELYYLQHEDNKECTKQKVLTSNHQTSSEPWSSSQIWLQHRRLDVWEPAPISNTSGAKWFVSFNDDCTRVT

SEQ ID NO: 118367 - protein, 167 aa, Glycine max
  Coding DNA Sequence Number=SeqID_26682
  Homolog annotation: Hit_ID=A0ST23; Match level="QueryCoverage=15%, HitCoverage=53%, E-value=1e-07, Identity=100%"; Hit description =Putative reverse transcriptase
VLSGFCFYQLSLCSATDGVVRNGKSTAGHQRWQAAQLLGRAIGAGLFAITPAGERGMCCKAIKLGNARVFPVTTLYLAPFVAQYVKFRNMPSSLSIPSTSRGGPVPAFVPFSEVGKPVVPAALMNRPTRGERRFAYWALAECILAYYVGTDEGVSEVLHVAEKKAAP

SEQ ID NO: 118368 - protein, 72 aa, Glycine max
  Coding DNA Sequence Number=SeqID_26683
QKNVYTDNHSGISARQRDSKVSMTDLVSAEGDVNLRVSTGLSAAIDEGCRMTKFCLCVPSDTTVSEWQRGAE

SEQ ID NO: 118369 - protein, 85 aa, Glycine max
  Coding DNA Sequence Number=SeqID_26684
MAAQLIHDRVVMECLEEVSSFEEDLEEDPEELSPEPAMDAPDLPEDDEDPLPDVDSPEDIMPASEADSTEESGPRGTANSDDSSS

SEQ ID NO: 118370 - protein, 151 aa, Glycine max
  Coding DNA Sequence Number=SeqID_26685
MASRKRKSIGSRPTEQYDTRRFSSLNAWTRYTDNVLERNILPERKVEIYHSELDDFKAELERRNFHKRLTNLVDGSIDLALIDAGSLNTFLETPVVLGEGETLPTYSRYCRLPTDYREIEAALCIPSRGFILNLEGHPRKILRNDLTTLAQ

SEQ ID NO: 118371 - protein, 103 aa, Glycine max
  Coding DNA Sequence Number=SeqID_26686
MADCFRNDVAGSCIQIHKKDEWIWKIDPTGQYSENEAHVFLTCDRILPLWWESMTWVNIHGAFLQKPWQHFSQHAFCLPSRIRLNRWRSWWLALTWDSVAAPE

SEQ ID NO: 118372 - protein, 109 aa, Glycine max
  Coding DNA Sequence Number=SeqID_26687
MEANAVAIAATSVVAKVNPTSPSGINQMNHPTSDMETHEIPHHDLANFEPCLGYAAEGQAVGGIPLQNTLEGPQYHPQLHLLHSTAIKNPHDYGRNGKVGSSRGKAQGH

SEQ ID NO: 118373 - protein, 321 aa, Glycine max
  Coding DNA Sequence Number=SeqID_26688
  Homolog annotation: Hit_ID=A2Q500; Match level="QueryCoverage=31%, HitCoverage=11%, E-value=5e-09, Identity=35%"; Hit description =Endonuclease/exonuclease/phosphatase
MHSLSEVLVAGEFYYFRFNSNDGMHKVIEEGPWMFQGRPIILQGFSYVASAVGKPMYADSMTLKSKRLTYARICVEVDATRPLPDSFDLCVDDDFEDNAEKLLEIHVEYQWKPKMCSDCQVFGHQVNSCPKKVNMPTTKPQPTKAIWKATGVILPKDPSIMATEGVTGAATEQQQTNIPHLHEAETSIQKAHMRTANKEDACIESTVNHVEAIEALVAHGPDLNLGELDVLSPSARRGSGMVPTITNFSTSVATIYPNRFDVLQGEEGAEINPDLGLTDLLATINGGAKQKKKGKNKVNPQGGMTLRSQGKPNDSSCFLEY

SEQ ID NO: 118374 - protein, 170 aa, Glycine max
  Coding DNA Sequence Number=SeqID_26689
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=76%, HitCoverage=96%, E-value=9e-25, Identity=53%"; Hit description =Putative uncharacterized protein
  Subcellular localization annotation: CTP_CleavageSite=32; ConfidenceScore=5.38e-01
MTMITPSSKLTLTKGNKSWPIPSIVPRWCSSRRDLKTGNSKDQETTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 118375 - protein, 133 aa, Glycine max
  Coding DNA Sequence Number=SeqID_26690
MDSTAKSNEETDKRKRSIALKASSSMQEENEDEELEDEEDFSLFVKKFHKFVKNRISERRQNFNHGKRSHEGSLTLRCYNHEERKTKKAYIVWDDNDSFEESEKEDDRGRTRIKKTLKMQYLGSDPRSSPNEQ

SEQ ID NO: 118376 - protein, 117 aa, Glycine max
  Coding DNA Sequence Number=SeqID_26691
  Homolog annotation: Hit_ID=Q5QJQ3; Match level="QueryCoverage=60%, HitCoverage=77%, E-value=2e-16, Identity=48%"; Hit description =Putative uncharacterized protein
LRPLTSITKSDAQISGGETRQDYKDTRRFPLAAPSCALLFLPFGLPFAPSWTVCTNPPFSPTAAPYPELVLKSCAGLKAKLKGQVLGDCAPPSQLPSEGKKIIAQNPKTESQGKINP

SEQ ID NO: 118377 - protein, 164 aa, Glycine max
  Coding DNA Sequence Number=SeqID_26692
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=75%, E-value=4e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPTPSVAEQEGQLIETEATGAPQKHHYTLNQ

SEQ ID NO: 118378 - protein, 81 aa, Glycine max
  Coding DNA Sequence Number=SeqID_26693
MGGMMNVLSGATLFCKISRHLTSSCDQGVPMNPKRIKVIPEWPTPPSVEGRSPEYEEPRDLRSNPFQGGGNDAILPHKGIG

SEQ ID NO: 118379 - protein, 100 aa, Glycine max
  Coding DNA Sequence Number=SeqID_26694
  Subcellular localization annotation: CTP_CleavageSite=28; ConfidenceScore=5.42e-01
MFFSMKNTIFTLSSSPNATQTLTPPSPPLMTTSGCHEPSLLAVEPPHQEEHFNQSGILRILLKDSVEKIPPILHFKASMRTLFWTDERERERSLSDTKRN

SEQ ID NO: 118380 - protein, 158 aa, Glycine max
  Coding DNA Sequence Number=SeqID_26695
  Gene Ontology: Mol. function=RNA-directed DNA polymerase activity; Biological process=RNA-dependent DNA replication
  Homolog annotation: Hit_ID=Q2HRM6; Match level="QueryCoverage=37%, HitCoverage=16%, E-value=9e-09, Identity=46%"; Hit description=RNA -directed DNA polymerase
MARAGDNGGVYHQLDESQRLFLDAWTTQMQRLLNRNKEEPYRRIAKSSSFTLKPLSPRKEIPHGLPPSRSIEHQVDLLLEASLPNKPTYNCKPQETQHKDAQVKVEYEKRLYDQVKGMMRIMKLAKYKLKAQVDKDEGLSGEGQSPRVEKDEGPSGEG

SEQ ID NO: 118381 - protein, 80 aa, Glycine max
  Coding DNA Sequence Number=SeqID_26696
MLNPQEKTTLELLMRIMKLAKYRQKAQVEKDEGLSGEGQSPRVEKDEGLKWRRMKAQVEMDEGPEAETLSRQLIVAEGSN

SEQ ID NO: 118382 - protein, 196 aa, Glycine max
  Coding DNA Sequence Number=SeqID_26697
MKLEETLAQSMQVPMSNQKSTESAIKNLEVQVGQLAKQLAERPSSSFIANIEKNPKEECKVVMTRSKMVIQAEEKIVEEAEGYEEEETPIRGCQEKIKKKEEKEEEIKEEEEKEKKLKNEKQKEKVVEIEKKKGKSEANIEKKKEATPIECNELLAKPICRHSEPSPERTTLAVEREEESGRRMSWTHALSKGSSR

SEQ ID NO: 118383 - protein, 88 aa, Glycine max
  Coding DNA Sequence Number=SeqID_26698
MIQREWRKELAFPVTRNAIDSDSKCPFASSKVKGRVVIDYTNMVIDYQRATFPEITTCNRLHYYGNRLPEVILARKQKSKSFLGEKEF

SEQ ID NO: 118384 - protein, 76 aa, Glycine max
  Coding DNA Sequence Number=SeqID_26699
ENGGGACHPARPGELGCFLQKQPLSGGTSWKAQGEGRHKRIQAVSPSFFWKREKRDTKRIQAVSPWRILFGKGRRE

SEQ ID NO: 118385 - protein, 139 aa, Glycine max
  Coding DNA Sequence Number=SeqID_26700
MEKWAQFFQTRRDPSWEAQVIQKQNTAPHVLSRGGYEYLEQKLLAKKTKKKLEEAAQSESIDGVIDLSCPIRRHVKWKMAHTKKTEEMTTEAAKEIAEKIDSFEEQASQGSFIPYGRQDVLTAAIGRPEHPRRVCAVGA

SEQ ID NO: 118386 - protein, 97 aa, Glycine max
  Coding DNA Sequence Number=SeqID_26701
MKENNKGSPVESPTVATYPSAGGRRVTRGMRVPRKEYARSRHQRLFEENVGKTGKDAIYELFSERFGSCIYARGSGRQGCFPLLLRIPQLDEKIRPT

SEQ ID NO: 118387 - protein, 290 aa, Glycine max
  Coding DNA Sequence Number=SeqID_26702
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQILSTTNPTRISCMVAKAMSSMKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 118388 - protein, 109 aa, Glycine max
  Coding DNA Sequence Number=SeqID_26703
MKLMCWLSQPTLRREGDAKAHGCVFQGRKTRGVTTNIYSRKTSKKPRCGLRTLSVKGLGVVFMHGEGMVDKSGAFAPTYPRFVVRNSDLRSSYKAVKLCVDFMLLNTPC

SEQ ID NO: 118389 - protein, 30 aa, Glycine max
  Coding DNA Sequence Number=SeqID_26704
VFLGYKSFMESIANRRKCKEEVFYVTFMPP

SEQ ID NO: 118390 - protein, 66 aa, Glycine max
  Coding DNA Sequence Number=SeqID_26705
MNCFFGCLQMVRGGDGQQQRCWRMIPFASLMIMPFDEVLVNVNWSIKPSGNRLQAVVIDYRLSVLV

SEQ ID NO: 118391 - protein, 158 aa, Glycine max
  Coding DNA Sequence Number=SeqID_26706
MAPRKLFAKRSRKDAAAEGTCAAPEFDNHRFRSAEHQQRFEAIKGWSFHRERRVQLRDDEYTDFQEEIARRHWTSLVIPMAKFDPDVVLEFYANAWPTEEGMRSWVRGQWIPFDADALSQFLGDPLVLEECQECEYSQRRNRADGFDEEAIAQLLCIP

SEQ ID NO: 118392 - protein, 65 aa, Glycine max
  Coding DNA Sequence Number=SeqID_26707
LQRCEFEVEAVQRTLDEFVNDLRFPDYGKLNPLLDLPYRYLIRNWSDSEVLGSTRLSCCVITRDR

SEQ ID NO: 118393 - protein, 55 aa, Glycine max
  Coding DNA Sequence Number=SeqID_26708
  Subcellular localization annotation: CTP_CleavageSite=35; ConfidenceScore=5.09e-01
MDSRRFQISIPSDGCPKLHSRRPGRWLKNWSSSLSVSTTAQRDEPTWRSGLARMW

SEQ ID NO: 118394 - protein, 110 aa, Glycine max
  Coding DNA Sequence Number=SeqID_26709
MGWGSDSEPYVGRVSASYSSGRRPGEVLERWGDPAAAVSDKDRISKPSRVPSSSSTIVRPYLFARKYPQVKGKRKVCSTERASAILLEDLPHRTLSMLPVRSSCPVDQIQ

SEQ ID NO: 118395 - protein, 173 aa, Glycine max
  Coding DNA Sequence Number=SeqID_26710
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPGNYRLESNP

SEQ ID NO: 118396 - protein, 170 aa, Glycine max
  Coding DNA Sequence Number=SeqID_26711
  Gene Ontology: Mol. function=RNA-directed DNA polymerase activity; Biological process=RNA-dependent DNA replication
  Homolog annotation: Hit_ID=A5ANU0; Match level="QueryCoverage=39%, HitCoverage=9%, E-value=8e-10, Identity=41%"; Hit description =Putative uncharacterized protein
PIILGRPFMKIARTKIDVYADTLSMEFGDITIHFNILDAMKHPSEDLSVFRAEIIDHIVDEYMTDLHSNLHACHSSCIEFEFVTIQGDWVWLHLRKDRFPTKRKSKLSSRGDGPFQEEELTDLRSNPLQGEGDDAILPRKGPITRTMSKRLQEDWARAAEEGPRVLMNLR

SEQ ID NO: 118397 - protein, 117 aa, Glycine max
  Coding DNA Sequence Number=SeqID_26712
MTCRSWASTFAYLWLWTWSTAGRPQVIGNPPAFVDELRGFGGGGGASIARYQPSPGCYGVSPYACLGAQYFLMKAQVGNPMTLLDFSGSNGCLAGAIPANSRWHQRPVEPRAYLPMS

SEQ ID NO: 118398 - protein, 119 aa, Glycine max
  Coding DNA Sequence Number=SeqID_26713
MYDTLQSDSKKPLYLGCKKSLTLLSAVLSLVNVKDMLIEENTLPKSYYQVKKILCLTGIVATYPLAGGRGEIQGCTFKKQKHAGVASKFYLRKTLEKTKKGYANFKNKGLGVVYTWGRY

SEQ ID NO: 118399 - protein, 52 aa, Glycine max
  Coding DNA Sequence Number=SeqID_26714
MLQPCGIDTDLKEHLNRMTPKPYTLKSPSGPLTPNSDTANELCNTHDLTLVF

SEQ ID NO: 118400 - protein, 73 aa, Glycine max
  Coding DNA Sequence Number=SeqID_26715
MADGKLIEMKGRVNLGLKTKSGFSGNWSVAMCPSRASEGEAHGCTFQRRKDARSRHQRLFVENVGKTEGNWSK

SEQ ID NO: 118401 - protein, 148 aa, Glycine max
  Coding DNA Sequence Number=SeqID_26716
MVIQAEEKIIEEAEGDKEGETPIKDCQEKIKKKEEQEKEKEEEIKEKEKKEKKLKSEKQKEKVVETEKKKSKSETNIEKKKEATPIECKEVPYPLVPSRKDKERHLARFLDIFKKLGNYFAIWRSTLANALLCQIFEGYVNQEEPVHP

SEQ ID NO: 118402 - protein, 75 aa, Glycine max
  Coding DNA Sequence Number=SeqID_26717
  Homolog annotation: Hit_ID=B0HC01; Match level="QueryCoverage=46%, HitCoverage=74%, E-value=3e-12, Identity=100%"; Hit description =Putative uncharacterized protein
MRKRHASRREKAGQGGGAYGKTPATRPFYGSWPFAGLLLTCSFLRYPLILWITVLPPLSELIPLAAAERPSAASQ

SEQ ID NO: 118403 - protein, 308 aa, Glycine max
  Coding DNA Sequence Number=SeqID_26718
  Gene Ontology: Mol. function=nucleotide binding; Cellular component =intrinsic to membrane; Biological process=defense response
  Homolog annotation: Hit_ID=Q2HVE0; Match level="QueryCoverage=83%, HitCoverage=25%, E-value=2e-61, Identity=49%"; Hit description =Leucine-rich repeat; Leucine-rich
  Pfam annotation: Domain name=NACHT; Domain location=103-253; Score= -24.6; E_value=0.0049; Accession=PF05729.3; Description=NACHT domain
  Pfam annotation: Domain name=NB-ARC; Domain location=65-308; Score= -21.2; E_value=6.5e-09; Accession=PF00931.13; Description=NB-ARC domain
  Pfam module annotation: Pfam domain module=NACHT::NB-ARC; Domain location=103-253::65-308
MGFPLRRKGKGKGKGKGNSMRVEPLTINFQLREQIVILPLIFIHFLSHSLLYRNDAELLEDIIDHVLKRLNKKPINNSKGLLGIDKPIADLESLLRQESKDVRVIGIWGMHGIGKTTIVEELFNKQCFEYESCCFLAKVNEELERHGVICVKEKLLSTLLTEDVKINTTNGLPNDILRRIGRMKIFIVLDDVNDYDQVEKLVGTLDWLGSGSRIIITARDRQILHNKVDDIYEIGSLSIDEAGELFCLNAFNQSPLGEEYWDYLLLSYWMVDYAKGVPLVLKVLGQLLRGKDKEVWKSQLDKLQKMPN

SEQ ID NO: 118404 - protein, 398 aa, Glycine max
  Coding DNA Sequence Number=SeqID_26719
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=83%, HitCoverage=52%, E-value=4e-94, Identity=44%"; Hit description=DNA polymerase
  Pfam annotation: Domain name=DNA_pol_B_2; Domain location=159-398; Score=-105.6; E_value=0.0065; Accession=PF03175.4; Description=DNA polymerase type B, organellar and viral
DIAEPLNKQSIPLTFDDGSPISKSEIYATIRAHFEENIPGPLQPLKEELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRVFPTFEERSCQMLKSFIFRVAAITRPNRSAKTIYFHNLDSLHLLPGKLDDLAKNLCPELGSKGSISYEDVRLESLSIMKESLLEYMEQDILLLGGIMQSFQDIYYKAYQADIVNKLTIASLALSLFREKYYDYNKHRIHIPNQNEDTFIRHGYYGGHTDAYLPYGTNLYYYDVNSLYPFVIKEFSMPGGTPVWHSDLEYMTLDNMFGFIEAYVECPKSINKPFLPYGDNKDGTLIFPTGTFVGVYYSEEL

SEQ ID NO: 118405 - protein, 91 aa, Glycine max
  Coding DNA Sequence Number=SeqID_26720
MAVPKSEKMQRQDETNKKQGFVLYRNHKPSWKIPLRLKGSSRCGVSMENNDGLWWLMVAASDEESAWNFRNGFGRKKRRNDVFLKLHQKQG

SEQ ID NO: 118406 - protein, 225 aa, Glycine max
  Coding DNA Sequence Number=SeqID_26721
PLRKDKELMGIRNGIIGGYHEWLRVHTRGLDWLSKLKVINEENFKALEEDEEVQALKLELGKARLAKEKFKSATTTSGESAPSYERKMRPLQEPLNKKPKGPARRNMAEINSEELCGAATMSSSSGERKGTSHGSKRSLAQHLEATEQSMLAIIGQYKEELNQSLTHEQKLVEDFAQAYAEKEARGRVIDALHQEATMWMDRFALTLNGSQDLPRLLAKANAIVE

SEQ ID NO: 118407 - protein, 177 aa, Glycine max
  Coding DNA Sequence Number=SeqID_26722
  Homolog annotation: Hit_ID=A0A8Y3; Match level="QueryCoverage=92%, HitCoverage=36%, E-value=4e-08, Identity=29%"; Hit description =Putative uncharacterized protein
MIHVIAQTPYTLPTAQDPTKSLLRESIPTTPVRDASLSAPDDSFTPEYPTNPNYEHIVDERPFIRAYKGEFQPTYGCCNIISNVIRAKFDEPAPSWLNVLVDLRDRWFGEFKYRWHPQEERAIRAVFETKGSCILKSAMNKIRNGQDKGKWITSNVRAALDEHWGSTDFLNKSSTAK

SEQ ID NO: 118408 - protein, 90 aa, Glycine max
  Coding DNA Sequence Number=SeqID_26723
MENHRFISNSDSAKTRSNKKRIRQQKVHVNAQDSVHASVNPASSNTEDHYNQPKTPPHSVHATVNRASHDAEDHFNVSGSSENENSGSTE

SEQ ID NO: 118409 - protein, 91 aa, Glycine max
  Coding DNA Sequence Number=SeqID_26724
MRCYYYDGRAGSRYRLVAEIEQLVSSGFIHQQPTKTPETSKACFVVYSSLATPPDYDSNKSKEDSTQTPAIETGAAMMYGLYYLCCRPLII

SEQ ID NO: 118410 - protein, 65 aa, Glycine max
  Coding DNA Sequence Number=SeqID_26725
  Subcellular localization annotation: CTP_CleavageSite=11; ConfidenceScore=5.17e-01
RTTPVIKRTASAHPLSETRALSQNPLMLAKRSRSALSERVQVLESFERFCCVKICKDVSLKRKLF

SEQ ID NO: 118411 - protein, 69 aa, Glycine max
  Coding DNA Sequence Number=SeqID_26726
MPLSPVILVTLADRELMSVAHSFLSLGGAYLHGTAWLFLYGNGIGLTTEGCWVVWGAASLVKCITKGIL

SEQ ID NO: 118412 - protein, 443 aa, Glycine max
  Coding DNA Sequence Number=SeqID_26727
  Gene Ontology: Mol. function=transferase activity; Biological process= lipopolysaccharide biosynthetic process
  Homolog annotation: Hit_ID=P71238; Match level="QueryCoverage=72%, HitCoverage=79%, E-value=1e-158, Identity=88%"; Hit description =Putative colanic acid polymerase
MALGDKIELHTFGKFSPFEGANVVNHGFETDKRKLMSALNEMDALVFSSRVDNYPLILCEALSIGVPVLATHSDAAREVLEKSGGKTFAEQEILPLVQLPKAQIARTVFGTDLESFRNRSRKAICSYLLLPLIYLLVNVKIAQLGESFPITIVTFLPVLLLLYVDKINLKKLMIALGLGTGLTLFNYIFGQSLDASKYVTSTMLFVYIVIIIGMVWSIRFKTISPHNYRKILRFFYIAVALIVMLAAMEMAQIILTGGSSLMEIISKYLIYSNSYVLNFIKFGGKRTTALYFEPAFFALALISIWLSIKQFGIKTPKTDAMILAGIVLSGSFSGVMTFILFYLLEWAFQYLNKEAIKKKLPLAIISLTVFLVGVIFAFPYISERLGDLGTEGSSSYYRIIGPLVMVGYSLTHIDGVVRFGSLYEYVASFGIFNGADVGKTIDN

SEQ ID NO: 118413 - protein, 108 aa, Glycine max
  Coding DNA Sequence Number=SeqID_26728
  Subcellular localization annotation: CTP_CleavageSite=76; ConfidenceScore=5.92e-01
MGWLRSSSDSVSSAASPLLSSLSLFSCSPSSSAASSSSMPLSESLLISSSSSIFFSVVALMVASSTLHVSLSSAIRASLDTAPEAAAFPDVETDVETMSGTCVPSNSL

SEQ ID NO: 118414 - protein, 63 aa, Glycine max
  Coding DNA Sequence Number=SeqID_26729
  Homolog annotation: Hit_ID=UPI0000ECBAF8; Match level="QueryCoverage =65%, HitCoverage=48%, E-value=1e-16, Identity=100%"; Hit description= UPI0000ECBAF8 related cluster
MGKTTIRSSKRMQAWHWPSFYNVVTGKTLALPNLIALQHIPLSPAGVIAKRPAPIALPNSCAA

SEQ ID NO: 118415 - protein, 125 aa, Glycine max
  Coding DNA Sequence Number=SeqID_26730
  Subcellular localization annotation: CTP_CleavageSite=9; ConfidenceScore=5.53e-01
MRRTRLPPLAILLSCHNHPFFSGRPFTGISSFGVGIILSFCSSAIFAFPLTFTGCVGRSRGANMRLLRVTPLRSLDIGYLGRQRMMSEALPSFRLEVHTSMELRGCFGMETERFNYRGVSGRVGS

SEQ ID NO: 118416 - protein, 105 aa, Glycine max
  Coding DNA Sequence Number=SeqID_26731
  Subcellular localization annotation: CTP_CleavageSite=42; ConfidenceScore=5.09e-01
MLTTSKDWKAVSYDSSAASTYGIEDGQLTKMSSSPDTMTKCPSTMNFSFWWSVEGTTPTEWIHGRPKRQLYGGLSVQGGRSLPSPLSGCRRRHGPTWNLALDGKR

SEQ ID NO: 118417 - protein, 88 aa, Glycine max
  Coding DNA Sequence Number=SeqID_26732
MCLSGKENMPMKFSHNRNTGSNKDRRESLKVYQSHTGLTFSPWVKVYDKLGFWLKACRTAGHDICQGLASGSGIKGMSYIISMIHMQQ

SEQ ID NO: 118418 - protein, 138 aa, Glycine max
  Coding DNA Sequence Number=SeqID_26733
MGDQEETQEQMKADMSALKEQMASMIEAMLGMRQIMEKNVATATTVSSAAEADPTLLATAHHPPPNTGSILDSPTRSTKIIESMPKGMSISTPRSPSWGRHLTHCLSTTSQNNQYSCPQKNQPRRRKKTGNSISSRRD

SEQ ID NO: 118419 - protein, 134 aa, Glycine max
  Coding DNA Sequence Number=SeqID_26734
  Gene Ontology: Cellular component=integral to membrane; Biological process=pathogenesis
  Homolog annotation: Hit_ID=P37169; Match level="QueryCoverage=36%, HitCoverage=9%, E-value=1e-18, Identity=89%"; Hit description =Virulence factor mviN
MTQLMNLAYIGPLKHACRSLSIGLAACLNAGLLYWQLRKQDIFTPQPGWASILGASDRCGTGDVCCVTGHDVHHAGVVPGHHALPSDAADGRGWRWVVGLLCHARRVGFQSERVCPPYGINAKRGVHLRVLPIA

SEQ ID NO: 118420 - protein, 68 aa, Glycine max
  Coding DNA Sequence Number=SeqID_26735
  Subcellular localization annotation: CTP_CleavageSite=37; ConfidenceScore=5.24e-01
MATPLGITLLSGLNLSCFSSSLCFVIIRNCKYVLKCLSFTVFPRVSFGCGTCDNPAQWRDLGSITMLA

SEQ ID NO: 118421 - protein, 172 aa, Glycine max
  Coding DNA Sequence Number=SeqID_26736
  Homolog annotation: Hit_ID=A5BU47; Match level="QueryCoverage=56%, HitCoverage=5%, E-value=6e-08, Identity=32%"; Hit description =Putative uncharacterized protein
  Subcellular localization annotation: CTP_CleavageSite=48; ConfidenceScore=5.79e-01
MGSPPASTPPPPPPPPPSPPSDASASLSAVKRTRKASRLRSLSTRPPSAERPVVHVDPTTGKADGPHKKKLRTYLGIVARDKVDVTYENWKEVPTAQKDLIWEDIQASDSRTKRKLLQTVGERWRQFKSDLTRKWALAADQDGVEDTVCEKYGISKEKWAQFCQTHRDPSWE

SEQ ID NO: 118422 - protein, 394 aa, Glycine max
  Coding DNA Sequence Number=SeqID_26737
  Gene Ontology: Mol. function=protein-glutamate methylesterase activity; Cellular component=cytoplasm; Biological process=two -component signal transduction system (phosphorelay)
  Homolog annotation: Hit_ID=Q6D6I7; Match level="QueryCoverage=42%, HitCoverage=48%, E-value=8e-77, Identity=84%"; Hit description =Chemotaxis response regulator protein-glutamate methylesterase
  Pfam annotation: Domain name=CheB_methylest; Domain location=3-185; Score=382.0; E_value=9.6e-112; Accession=PF01339.8; Description=CheB methylesterase
  Pfam annotation: Domain name=CheZ; Domain location=266-390; Score= -10.0; E_value=5.6e-07; Accession=PF04344.4; Description=Chemotaxis phosphatase, CheZ
  Pfam annotation: Domain name=Response_reg; Domain location=187-302; Score=151.5; E_value=2.4e-42; Accession=PF00072.15; Description =Response regulator receiver domain
  Pfam module annotation: Pfam domain module=CheB_methylest::CheZ::Respo nse_reg; Domain location=3-185::266-390::187-302
EKLIAIGSSTGGTEAIRHVLQPLPATSPALLITQHMPPGFTRSFAERLNKLCQITVKEAEDGERILPGHAYIAPGAMHMELARSGANYVVKLNDGPPVNRHKPSVDVLFRSVAVNAGRNAVGVILTGMGNDGAAGMLEMHRAGAWTIAQDEASCVVFGMPREAIAMGGTTGPAGQDNTGVDMADKNMRFLVVDDFNTMRRIVRNLLKELGFNNVEEAEDGVDALTKLRAGGFDFVISDWNMPNMDGLELLQTIRADATLGKLPVLMVTAEAKKENIIAAAQAGASGYVVKPFTAATLEEKLGKIFEKLGILRELGLDQAIAEAAEAIPDARDRLDYVVQMTAQAAERALNCVEAAQPHQDQMEAGATQLKGRWDAWFENPIELADARELFRIRA

SEQ ID NO: 118423 - protein, 161 aa, Glycine max
  Coding DNA Sequence Number=SeqID_26738
MGIAPQETPSGPGKVQQGPGVSSSGYGPLSVLQGARTPPASSCHHDIGKDCARKTPSGPEEVQQGLGVVKALITGLCQFYGVPVTSSKGIRPPTNRAFIKKYCAPDRRRAKHHSSIGMAAAGNRRTAITSAHPQKGLSIAYTTWPTNRRPSPKPNDAPSCS

SEQ ID NO: 118424 - protein, 30 aa, Glycine max
  Coding DNA Sequence Number=SeqID_26739
MTEIVCAEDDVNLRVSMSLLAAIDKGCRRR

SEQ ID NO: 118425 - protein, 150 aa, Glycine max
  Coding DNA Sequence Number=SeqID_26740
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=5e-25, Identity=55%"; Hit description =Putative uncharacterized protein
  Subcellular localization annotation: CTP_CleavageSite=44; ConfidenceScore=5.37e-01
MTMITPSSKLTLTKGNKSWCWGLSSLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 118426 - protein, 159 aa, Glycine max
  Coding DNA Sequence Number=SeqID_26741
  Homolog annotation: Hit_ID=Q1VPT5; Match level="QueryCoverage=97%, HitCoverage=23%, E-value=5e-20, Identity=30%"; Hit description =Putative uncharacterized protein
  Subcellular localization annotation: CTP_CleavageSite=30; ConfidenceScore=5.03e-01
MLKQSQGSLNISQIGGDATFSFGKYHLNTRVQFQNALTNKDLYPMPGFIGRANFFYQTKAFKNAAEIQAGLKVYYFSKFASREYFPILNEYILPRADSFSIGGQPIADVYINMKVKKMFFFIEGQQIGTLISSNKAYAFPHYPVYDFRLNLGIVWYLFN

SEQ ID NO: 118427 - protein, 75 aa, Glycine max
  Coding DNA Sequence Number=SeqID_26742
MHTWARFHPAAARRRVWIMHTTTTPISLCQSGSRPQDTQWTQRSPTGPWGFQLWLWASVSPTGCPSPQQGHAIVT

SEQ ID NO: 118428 - protein, 126 aa, Glycine max
  Coding DNA Sequence Number=SeqID_26743
  Subcellular localization annotation: CTP_CleavageSite=82; ConfidenceScore=5.15e-01
MTLLLSNILPSDRNADLPLRKDRAHKTPSGPGKVQQGPRVSSSGYGPLSVLQGARTPPPPARDRARRTPGGPKEVQQGSGVSSSDYGPLSVQRSARCPNKVIRPRINWAFIKKYCAPRRAQGETPQ

SEQ ID NO: 118429 - protein, 53 aa, Glycine max
  Coding DNA Sequence Number=SeqID_26744
MYIVVVLKDERKRGWGHDRPIVALLCAKQAGSIAARQPRILSILQLSFTICLF

SEQ ID NO: 118430 - protein, 47 aa, Glycine max
  Coding DNA Sequence Number=SeqID_26745
GDSPVLIEYPFLCLSCIEEYGKDGKLRQLSHYTSTKEQAPAPVLSTK

SEQ ID NO: 118431 - protein, 158 aa, Glycine max
  Coding DNA Sequence Number=SeqID_26746
  Homolog annotation: Hit_ID=A5C0Y9; Match level="QueryCoverage=44%, HitCoverage=5%, E-value=4e-11, Identity=47%"; Hit description =Putative uncharacterized protein
  Pfam annotation: Domain name=Chromo; Domain location=10-58; Score =38.1; E_value=3.2e-08; Accession=PF00385.15; Description='chromo' (CHRromatin Organisation MOdi
MLSEDQELQAYPDSVLDIRELQPGNVEVLIQWQNLPPSENSWESVAKLQEVFPTYHLEGKVSLLGGNIDKHKHKPHITRKQRAREAITMDHQQQGAQHPRGANHPTVMTHPRGANHLIVMTHPKGVNHPIVRIHPKGARSEDVNQRDMTLGNSHNQLL

SEQ ID NO: 118432 - protein, 103 aa, Glycine max
  Coding DNA Sequence Number=SeqID_26747
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLPA

SEQ ID NO: 118433 - protein, 101 aa, Glycine max
  Coding DNA Sequence Number=SeqID_26748
MAGIGDGGGEYHQLGGSQHFLLDMITTQMQRLLNCNNEKLYERIEGLENQLNQNVGRHYGGNRGGNDGPKQNRMEGLDRIEGVKLNVPPFKGRSNPDAYLD

SEQ ID NO: 118434 - protein, 72 aa, Glycine max
  Coding DNA Sequence Number=SeqID_26749
MRASLAYDTGIGVNSTGFFAAKFISWLVFWFVLKVVFIIGWMAFVDNWVVGKEKGCYWLSNDIVGLVGNLAV

SEQ ID NO: 118435 - protein, 97 aa, Glycine max
  Coding DNA Sequence Number=SeqID_26750
  Homolog annotation: Hit_ID=Q1J7G7; Match level="QueryCoverage=27%, HitCoverage=38%, E-value=5e-08, Identity=100%"; Hit description =Transposase
APVALFLSAVPPVQLLTGWCVTAKAPPDISAGKCSGHAARRVPFAIQAAQLLGRAIGAGLFAITPAGERGMCCKAIKLGNARIRYDVEGETAAADDD

SEQ ID NO: 118436 - protein, 205 aa, Glycine max
  Coding DNA Sequence Number=SeqID_26751
MSFAFMLSKTTMSSVIYDFKNYNFFIYISKTSMSSVIYAFKDYNGFIYISKTSMSSVIYAFKDYNVFTYISKTSISSVIYAFKDYNVFTYISKTSMSSVIYAFKDYNVFIFISKTSMSSFIYAFKDYNVFIYISKTTNSLVIYISKTSMSSVLYTFKDFNDSMSLSQPTFRREGNARLMGASSKEGKRAESPPTFIRGKRQKNQN

SEQ ID NO: 118437 - protein, 100 aa, Glycine max
  Coding DNA Sequence Number=SeqID_26752
  Gene Ontology: Biological process=transposition, DNA-mediated
  Homolog annotation: Hit_ID=Q1J7G7; Match level="QueryCoverage=33%, HitCoverage=47%, E-value=1e-11, Identity=96%"; Hit description =Transposase
  Subcellular localization annotation: CTP_CleavageSite=23; ConfidenceScore=5.01e-01
MFFTMPLGYINGVGTSYVPINVSFSPKVGPGASRYQQGHQDLFILRSDLPSQVLQWLLFLSAVPPVQLLTGWCVTAKAPPDISAGKCSGHPARNHHTRRA

SEQ ID NO: 118438 - protein, 315 aa, Glycine max
  Coding DNA Sequence Number=SeqID_26753
  Homolog annotation: Hit_ID=Q6UUU1; Match level="QueryCoverage=23%, HitCoverage=51%, E-value=3e-18, Identity=65%"; Hit description =Putative uncharacterized protein
  Subcellular localization annotation: CTP_CleavageSite=54; ConfidenceScore=5.20e-01
MVKVGTSLRADQRLIFAQKLAQGFPVSTGTTRIYFSGSDLPSQSLLFLSAVPPCSATDGGGGVTGKKHRRTSALASVAVTLRVTTTPAALNAPLQGASHSPFQAAQLLGRAIGAGLFAITPAGERGMCCKAIKLGNARVFPVTTLANWSSTAVAAALELVDPPGCRNSIRGIKKDKLMLERGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFRLRRAEMAYERGGDFLEDARKILNREVR

SEQ ID NO: 118439 - protein, 36 aa, Glycine max
  Coding DNA Sequence Number=SeqID_26754
MASCNGEKVFIKGKTISEAQRIKYGNEGLNWGVAAM

SEQ ID NO: 118440 - protein, 184 aa, Glycine max
  Coding DNA Sequence Number=SeqID_26755
  Gene Ontology: Mol. function=thiamin pyrophosphate binding
  Homolog annotation: Hit_ID=A8GKW2; Match level="QueryCoverage=100%, HitCoverage=28%, E-value=5e-87, Identity=89%"; Hit description =Thiamine pyrophosphate protein central region
  Pfam annotation: Domain name=TPP_enzyme_N; Domain location=4-184; Score=-18.6; E_value=4.4e-07; Accession=PF02776.9; Description =Thiamine pyrophosphate enzyme, N-term
MAQALVRFLDNQYLLADGVETKFVAGIFAIFGHGNVLGLGQALEQDSGDLRVHQGRNEQGMAHAAIGFAKQKLRRQIYACTSSVGPGAANMITAAATATANRIPLLLLPGDVYASRQPDPVLQQIEQSYDLSISTNDAFRAVSKYWDRIVRPEQLMSACINAMRVLTDPAETGAVTLCLPQDVQ

SEQ ID NO: 118441 - protein, 107 aa, Glycine max
  Coding DNA Sequence Number=SeqID_26756
MRKMLLVEVLDTAFPTSMQWHSHFWDSGQIEKSFTSQVLQGKVTGGPQLFVVSGAIVVVVVARLVEERHNCSVVADFAAEVEEVYCRCLLHKLQDVQLLQIVAQKAK

SEQ ID NO: 118442 - protein, 278 aa, Glycine max
  Coding DNA Sequence Number=SeqID_26757
MANTDNTSCFSSGRARRQLYLYGEDAAVFLRQERGRQLDEQQRHAAEQQQINHHVAAAGVQNAPHAALIAFGVAVEHAVEPAEEAALAVMVPLGDRFEQRGAQGRGQDHRHQHRQHHGGNDGDGELAIDGAGGAAEERHRHEHRRQHQGDADQRALNLPHGFARGFTRRQAFFAHHAFDVFHYHDGVVHQQADRQHHGEHGKGIDAEAAGGKDGEGAQQHHRHGDGGDQRGAEVLQEQIHHQEHQQDGFQQRFHHVLDRGFDEGGGFIGHFGLQPVRE

SEQ ID NO: 118443 - protein, 69 aa, Glycine max
  Coding DNA Sequence Number=SeqID_26758
  Subcellular localization annotation: CTP_CleavageSite=40; ConfidenceScore=5.17e-01
MRGYRMVTRTFRQPRANKPVDTQRLTSSTAPFVVLTREVRDSELGGKRRYLMVIRTFRQPRGTNLMASG

SEQ ID NO: 118444 - protein, 124 aa, Glycine max
  Coding DNA Sequence Number=SeqID_26759
VPPCSATDGVVRNGKSTPDISAGKCSGHAARRVPFAIQAAQLLGRAIGAGLFAITPAGERGMCCKAIKLGRIGAPPAVAAALELVDPPGCRNSIACDMGYLNSVLSSSSQVHAAEDSPVSGGGL

SEQ ID NO: 118445 - protein, 157 aa, Glycine max
  Coding DNA Sequence Number=SeqID_26760
MTKFDPDIVLEFYANAWLTEEGVRDMRSWVRGQWIPFDADALSQFLGYPLVLEEGQECEYGQRRNRSDGFDEEAIAQLLCIPGQDFARTAAGRRVRIMRTNMTTLTQIWMTLLLSNIQPSDHNSDLPLPKCQLVYAILTRMSIHVAQLIADAIFLFA

SEQ ID NO: 118446 - protein, 92 aa, Glycine max
  Coding DNA Sequence Number=SeqID_26761
MAPITTYFLILMSSVFYVFWDARVALEEFTVHDHLGFPMECKAVFCCLDLLDCHEEQISTNMIASKQSKLLLLIHNQYSVVMTRIIELNLVA

SEQ ID NO: 118447 - protein, 373 aa, Glycine max
  Coding DNA Sequence Number=SeqID_26762
  Homolog annotation: Hit_ID=A7PI77; Match level="QueryCoverage=100%, HitCoverage=100%, E-value=1e-106, Identity=55%"; Hit description =Chromosome chr13 scaffold_17, whole genome shotgun sequence
MDFFTRDINEDSMLRCPFLRNINEPTNFSFFSPLALPMPDLMFQAHRLSVLLLILIEIGTLTKYLIVTQVRGAKGPIFEDGPNFDLAFRLFHGSDGVVPLSDRSFRPSEKKVQAEPPKSQFNPLAAKAATISLSSFGFGGAFGFDAFSEKWNNQKRKSKSSKNEPSSQDGSKHEANNDWLQNGNCPIAKSYRAVSNVLPLVAKVIQPPPGIKYKCPQAVVAARAAIARTAFAKNLRPQSLPTKVLVIGMLGMAANVPLGIWREHTKKFSPTWFAAVHAAVPFIAMLRKSVLMPKSAMAFTIAASVLGQVIGSRAERYRLKAVAAKKVSITETSGVGPLLLPVATTKDKHCGDAVDWKAVSLQLAATSPTDVFC

SEQ ID NO: 118448 - protein, 244 aa, Glycine max
  Coding DNA Sequence Number=SeqID_26763
  Gene Ontology: Mol. function=calmodulin binding; Cellular component =nucleus; Biological process=glucosinolate biosynthetic process
  Homolog annotation: Hit_ID=A7PSZ4; Match level="QueryCoverage=100%, HitCoverage=51%, E-value=8e-45, Identity=44%"; Hit description =Chromosome chr8 scaffold_29, whole genome shotgun sequence
  Pfam annotation: Domain name=IQ; Domain location=113-133; Score=21.8; E_value=0.0025; Accession=PF00612.18; Description=IQ calmodulin -binding motif
MGRKGGWFSAVKRVFVSYSKKEQKQHHHKSKLGCFGTHHYEDLEGAPIAAVPSLPPRKDPKPISEAENNEQSKQAFSLVLATAVAAGAAVAAAAAEVTRLTNTPRSNGKANQEMTAIKIQTAYRGYSARKSLRGLRGLSRLKTLVQGQSVQRQAATTLQCMQTLSRLQSQVRARKVRMSEENQSLQRQLQQKREKEFDKSQANQIGEKWDDSLKSKEQVEAKLLNRQVAAMRREKALAYASTHQ

SEQ ID NO: 118449 - protein, 785 aa, Glycine max
  Coding DNA Sequence Number=SeqID_26764
  Gene Ontology: Mol. function=calcium ion binding; Cellular component =mitochondrial inner membrane; Biological process=transport
  Homolog annotation: Hit_ID=A7PI87; Match level="QueryCoverage=99%, HitCoverage=98%, E-value=0.0, Identity=62%"; Hit description =Chromosome chr13 scaffold_17, whole genome shotgun sequence
  Pfam annotation: Domain name=Mito_carr; Domain location=537-684; Score=58.8; E_value=1.9e-14; Accession=PF00153.18; Description =Mitochondrial carrier protein
  Pfam annotation: Domain name=Mito_carr; Domain location=689-777; Score=97.3; E_value=4.9e-26; Accession=PF00153.18; Description =Mitochondrial carrier protein
  Pfam annotation: Domain name=efhand; Domain location=375-403; Score =28.2; E_value=3.1e-05; Accession=PF00036.23; Description=EF hand
  Pfam module annotation: Pfam domain module=Mito_carr::Mito _carr::efhand; Domain location=537-684::689-777::375-403
MVSGSDPVESFFNSVQVVKDSLSPLEVGIRKAAKDLEHCLAGSKNKVNNGVCLIAPVRESGAFQICDVKKKKGLSMKVPLKAFWGMFSQNSGNGNGNGSSNIRAQVGKEDGPSCTNCLQFAVTWSLLVNGFLQSLPLPFKSGKKKCQKVCDEDKLCSCMKPTVSSCEVKQNESKGGQFGRAVREKGVRKKDGKNVSLECLIGFIFDQLSQTLQSLDHHGVQDNNDDLDNGKTSLPQPSFSHFGHVNALAGFLEEHKVYVNSFLGNLRFAKVGGVPSSVPGEESPSTNGEGDISSDNGNGNNENKDETGGNSPQKVANNIFSIPLSNVERLKSTLSTVSLTELIELLPQLGRTSKDHPDKKKLISVQDFFRYTEAEGRRFFEELDRDGDGQVTLEDLEVAMRKRKLPRRYAKEFMSRARSHLFSRSFGWKQFLSLMEQKEPTILRAYTSLCLSKSGTLKKSEILESLKNAGLPANEDNAVAMMRFLKADTEESISYGHFRNFMLLLPSDRLQEDPRSIWFEAATVVAVPPAVEIPAGSVLRSALAGGLSCALSCALLHPVDTIKTRVQASTMSFPEIISKLPEIGRRGLYRGSIPAILGQFSSHGLRTGIFEASKLVLINVAPTLPELQAGLFDNVGEAFVATWEQDGLRGFFRGTGATLCREVPFYVAGMGLYAESKKVAERLLERELGPLETIAVGALSGGLAAVVTTPFDVMKTRMMTAQGRSVSMTLIAFSILKHEGPLGLFKGAVPRFFWIAPLGAMNFAGYELAKKAMNKNEEGKAGSSE

SEQ ID NO: 118450 - protein, 268 aa, Glycine max
  Coding DNA Sequence Number=SeqID_26765
NPQITTFKPDGSYSSVQLEIPTGEKKWNSDEWVGRLKKLRIFNRVEDEIPWDVGTNVVPKYLGDDMILLLGLTDTKAEELVNEETRHGLSPFHSLEKWNPTLRPGHGLVWVQCWGIPLVAWDIAQLRKIVAAIRDLVEVDDDGEELRRLDRARVLIRTPWRPILQHTFDIHMAGSALWSSDEIDSDDSDTGTLLSKMIRAFGTEYMPRSFTGDCIGRFTNQDNATIPNGPRDEEDPMSKDRGRKLVEHKNSNITGAEAQQSWYIGALK

SEQ ID NO: 118451 - protein, 44 aa, Glycine max
  Coding DNA Sequence Number=SeqID_26766
MKNIGDVGPPTLMLVLGKGHCGQFISKGKKRGGNLEDVERRALR

SEQ ID NO: 118452 - protein, 203 aa, Glycine max
  Coding DNA Sequence Number=SeqID_26767
  Homolog annotation: Hit_ID=A7P4G1; Match level="QueryCoverage=50%, HitCoverage=61%, E-value=2e-26, Identity=60%"; Hit description =Chromosome chr4 scaffold_6, whole genome shotgun sequence
  Subcellular localization annotation: CTP_CleavageSite=57; ConfidenceScore=5.71e-01
MSSKGLLRGASLTANAVWHRSSFFPKVTVSVHRKLVKFRSFSLTTTCSSLLPPDLPRLAKTAQISLTPNEVEEIAPKIQQVIEWFGQLQGVDLESVEPSIRAVDYSSCLTDCITFFQLRMRETENNLRDNDPETFDHRDALIASVPSYEEPYIKVPRVFPIQRKGAMGIEKAQINIVVVGYVDSKKLRNSISLLLRDKLLSLT

SEQ ID NO: 118453 - protein, 357 aa, Glycine max
  Coding DNA Sequence Number=SeqID_26768
  Homolog annotation: Hit_ID=A4GX19; Match level="QueryCoverage=100%, HitCoverage=100%, E-value=8e-83, Identity=83%"; Hit description =Putative ureidoglycolate hydrolase
MDATKVVTLKAIEATPSTFKDYGQVIEASPDGQEFGSHDAQLDLSQGTPRFYIMHIENRPLKFSSITHHASVTQCLGSIGGHVWYLGVAKSSIVDSNEIKDGTSKKIVQSPSGHSYVPPAIEDVQVFKVAGSKFLKLNRGTWHAGPLFKAAAIDFYNLELSNTNIVVSSIMEAPKLKVVTLKAIEATPSTFKEFGQVVEASRDGQEFGPHDAQLDLSQGTPRFYIIKLEKCPLKFSSITHHAIVTQCLGSIGGHVWYLGVAKSSVVDSNEIKDDTGKKIVQSRSGHSYVPPAIEDVQVFKISGSKFLKLNRGTWHAGPLFKAAAMDFYNLELSNTNETDHTTHYFKKDDGVMFVIDD

SEQ ID NO: 118454 - protein, 1171 aa, Glycine max
  Coding DNA Sequence Number=SeqID_26769
  Homolog annotation: Hit_ID=A7Q7D3; Match level="QueryCoverage=9%, HitCoverage=78%, E-value=2e-32, Identity=53%"; Hit description =Chromosome chr18 scaffold_59, whole genome shotgun sequence
  Pfam annotation: Domain name=FHA; Domain location=43-111; Score=69.1; E_value=1.5e-17; Accession=PF00498.17; Description=FHA domain
MAEKKNPEQEEQHRFPVLTVLKNNAILKNIFIVLDEHDEDQTVLIGRHPNCNIVLTHPSVSRFHLRIRSNPSSRTLSLVDLASVQGTWVRGRKLEPGVSVELKEGDTFTVGISTRIYRLSWAPLTQLGVVVPQQHQKEDEQENIIKDENLEHTAEQDIPMSEDIVSVCCDEERKIHSEDEALGVPNGTETSCFPTNSCVENIICDCQLSPPYIQSPPCAQPVDELDNTKKIEARLEVEMPGETNLLCTLREYLKHNICLPVVEAVQGTKMQQFQAPHDTFTGQPPSLEMHWSSFQINIDPSSFDEKHAAAVPVIPTESEFGCTHGDIDKVEGILTTAPRSFNSENTCLIVDEDIPDSEFHKMEVVEEVSVDSVPDGEKQDEMHGSSSPTNLDPAFLDEKHVAAVAIIPTESEFGCTYGDNDKVEDILTTGSRTFNSENTCLIVDKDIPDSEFHQMEVVEEISVDSVPDEKHVAAVAVIPTESEFGCTYGDNDKVEDILTTGSRTFNSENTCLIVDKDIPDSEFHQMEVVEEISVDSVPDEEKQDECDEENLNGKSCREEGYSLDEVVEDNGNKCIKNIDPASFDGKGLTAVTVIPTEFEFGCTLGDNERIEDILEMESRTINSENTSLLDEKAIAVTKFQLVNIVEEGGYSLDEVVEDNGNKCIKNIDPASFDGKGLAAVTVIPSESEFGCTLGDNERIEDILEMESRTINSENTSLLDENAIAVTKFQVVNIVEEVAMDSISDGNKCIKNIDPASFDGKGLAAVTVIPSESEFGCTLGDNERIEDILEMESRTINSENTSLLDENAIIAVTKFQVVNIVEEVAMDSISDGEKEDKCGKELESKLPASLNAKSCHEQGKSVAEIAEDTGKKCASSISSTSFQVESPNSSMPREQTPQSLTAVTRCSGGEFLENHVKPTEKSSAFGSIWSRCKPASAPLVQARKSRFMSTAKVGTEVKRSNEKNVVINKLMPKDLSAVFDEEKEAFILNKENLSPNTYHLQFMRKKDKPEEIKHSISQRSPNLSYFSPRIYLDKRISSVSNKVNQTPKVAQEWKSQRKPLQCHINLVHEQDMMELKKNRVEKVASFPSLMNSGGNHKSVTVSAAKSIDDVPICGQISNKCTKTSHTSREQKRSWDMVVDTASLLNKESRKALQLLQGLKGTRLIIPSLGNEF

SEQ ID NO: 118455 - protein, 90 aa, Glycine max
  Coding DNA Sequence Number=SeqID_26770
MAISKSTVVVVILCFILIQEIAVASAIPGAVRLGGKKCALGHAIVAARSAGACHPALLGTEICALAMLDSPHMEESSSAHEMMTRSETSS

SEQ ID NO: 118456 - protein, 510 aa, Glycine max
  Coding DNA Sequence Number=SeqID_26771
  Gene Ontology: Mol. function=protein serine/threonine kinase activity; Cellular component=cytoplasm; Biological process=protein amino acid phosphorylation
  Homolog annotation: Hit_ID=O24430; Match level="QueryCoverage=96%, HitCoverage=98%, E-value=0.0, Identity=71%"; Hit description =Calmodulin-like domain protein kinase isoenzyme beta
  Pfam annotation: Domain name=Pkinase; Domain location=37-307; Score =328.4; E_value=1.3e-95; Accession=PF00069.16; Description=Protein kinase domain
  Pfam annotation: Domain name=Pkinase_Tyr; Domain location=38-300; Score=-62.5; E_value=1.4e-08; Accession=PF07714.8; Description =Protein tyrosine kinase
  Pfam annotation: Domain name=efhand; Domain location=354-382; Score =36.3; E_value=1.1e-07; Accession=PF00036.23; Description=EF hand
  Pfam annotation: Domain name=efhand; Domain location=390-418; Score =28.0; E_value=3.4e-05; Accession=PF00036.23; Description=EF hand
  Pfam annotation: Domain name=efhand; Domain location=426-454; Score =32.6; E_value=1.4e-06; Accession=PF00036.23; Description=EF hand
  Pfam annotation: Domain name=efhand; Domain location=460-488; Score =38.9; E_value=1.8e-08; Accession=PF00036.23; Description=EF hand
  Pfam module annotation: Pfam domain module=Pkinase::Pkinase _Tyr::efhand::efhand::efhand::efhand; Domain location=37-307::38 -300::354-382::390-418::426-454::460-488
MYTSLEILAVGGNRKKRMSSKCKNVMPHETPNVKEHYVIGNKVLGKGHVATTYVCTHKETKKRYACKTIPKAKLLKQEDYDEVWREIQVMHHLSEHPNVARVQGSYEDKFAVHLVMEMCRGGELFYRITQKGHYSEKEAAKLMKTIVGVVEACHSLGVIHRDLKPENFLFDSHSETATIKVIDFGFSVFYKPGQTFSDIVGTCYYMAPEVLRKQTGPEVDVWSAGVILYILLRGHPPFWAKSESAIFQEILHGEIDFVSDPWPSISESAKDLIKKMLDKDPEKRISAHEVLYLTPAESYIKSGHPWIVDDSVAPDKPLDPAVLTRLKHFSTMNKLQKMALRIIAERLSEEEIGGLKELFKMIDEDNSGTITFEELKDSLKSVGCDLMESEIKSLMEAADIDNNGTIDYGEFLAATLHLNKMEREENLVAAFAYFDKDGSGYITIEEIQQACKDFGLGNMHLDEIINEIDQDNDGRINYSEFAAMMRKGGPDVGRSRKGNYTASILDVLVE

SEQ ID NO: 118457 - protein, 417 aa, Glycine max
  Coding DNA Sequence Number=SeqID_26772
  Gene Ontology: Mol. function=Ral GTPase binding; Cellular component =clathrin-coated vesicle; Biological process=protein transport
  Homolog annotation: Hit_ID=A7Q7C3; Match level="QueryCoverage=97%, HitCoverage=37%, E-value=1e-146, Identity=68%"; Hit description =Chromosome chr18 scaffold_59, whole genome shotgun sequence
MSSDSDEDELLQMALKEQAQRDVNYGGKSSSNSRKPVANYVQPLKKPAPPPKQSQGKGRVADDDDDSEIEMLSISSGDEDNVQDPVAASRTKAAAAGRPVREDDRTWDGEEPSRWKHVDEAELARRVREMRETRSAAAPQKFVASKFEKEGSAVGRKGLTYLQSFPRGMECVDPLGLGIIDNRTLRLITESAHSSPKTDKDIQDGNLREKLLYFSENFDAKMFLSRIHSNTSAADLEAGALALKTDFKSRTEQRKQLVKDNFDCFVSCKTTIDDIESKLRQIEDDPEGSGTSHLFNIIQDVSLQANRALKPLFERQAQAEKIRTVQGMLQRFRTLFNLPSTIRGSISKGEYDLAVREYKKAKSIVLPSHIQVGILKRVLEEVEKVMNDFKTMLFKSMEDPQIDPTNHIILGMPLVVG

SEQ ID NO: 118458 - protein, 95 aa, Glycine max
  Coding DNA Sequence Number=SeqID_26773
  Gene Ontology: Cellular component=mitochondrion
  Homolog annotation: Hit_ID=Q6YSL1; Match level="QueryCoverage=40%, HitCoverage=31%, E-value=7e-12, Identity=84%"; Hit description =Putative uncharacterized protein orf120
MVFKTIEMIKIKIIEIKVEKFEIEINAPNSLQGASKKQWNDVIFLSASTITNLFGCVGQRACGTCCPPFLLCFENRVNGEWAEGKEVLIQSRTLT

SEQ ID NO: 118459 - protein, 397 aa, Glycine max
  Coding DNA Sequence Number=SeqID_26774
  Gene Ontology: Mol. function=chorismate synthase activity; Cellular component=chloroplast; Biological process=aromatic amino acid family biosynthetic process
  Homolog annotation: Hit_ID=Q38RG6; Match level="QueryCoverage=90%, HitCoverage=82%, E-value=1e-175, Identity=87%"; Hit description =Chorismate synthase
  Pfam annotation: Domain name=Chorismate_synt; Domain location=59-383; Score=648.8; E_value=4.7e-192; Accession=PF01264.12; Description =Chorismate synthase
  Pfam annotation: Domain name=Hormone_4; Domain location=265-273; Score=14.1; E_value=0.062; Accession=PF00220.8; Description =Neurohypophysial hormones, N-terminal
  Pfam annotation: Domain name=Hormone_4; Domain location=74-82; Score =2.5; E_value=62; Accession=PF00220.8; Description=Neurohypophysial hormones, N-terminal
  Pfam module annotation: Pfam domain module=Chorismate_synt::Hormone _4::Hormone_4; Domain location=59-383::265-273::74-82
  Subcellular localization annotation: CTP_CleavageSite=60; ConfidenceScore=5.53e-01
MASSLSTKPFSSTDALSAFASLNPDLRSFSPGYLRLSLRPRLPKRLQIRAAGSIYGNHFRVSTYGESHGGGVGCIIDGCPPHLPLSEADMQLDLDRRRPGQSRITTPRKETDTCKIFSGVSEGLTTGTPIHVFVPNTDQRGHDYTEMAVAYRPSHADATYDMKYGVRSVQGGGRSSARETIGRVASGAVAKKILKDFSGTEILAYVSQVYNIVLPEDLIDHDTLTLDQIESNIVRCPDPEYAEKMISAIDAVRVRGDSVGGVVTCIVRNCPRGLGSPVFDKLEAELAKAAMSLPATKGFQFGSGFAGTFLTGSEHNDEFYIDEHGNTRTRTNRSGGIQGGISNGEIINMRIAFKPTSTIGVSLISSLSVFITISFTRHTDTSHPDMFTDIFHSAYSC

SEQ ID NO: 118460 - protein, 1659 aa, Glycine max
  Coding DNA Sequence Number=SeqID_26775
  Gene Ontology: Mol. function=phosphatidylinositol phosphate kinase activity; Cellular component=mitochondrion; Biological process =phosphatidylinositol metabolic process
  Homolog annotation: Hit_ID=A5B6P1; Match level="QueryCoverage=93%, HitCoverage=98%, E-value=0.0, Identity=53%"; Hit description =Putative uncharacterized protein
  Pfam annotation: Domain name=PIP5K; Domain location=1394-1628; Score =142.8; E_value=9.4e-40; Accession=PF01504.9; Description =Phosphatidylinositol-4-phosphate 5-Kinase
MCSMCRYCGVGLSESNFDNKKQGNESSLKLNGKVSIRPCKSCGEKLERANAKWHSTSPYATPLISPTTSLLSTDSCVSTCSEFSVDVNSCDRNSQEESSVEGVVEELDYKLNGSPKVMENNNNNEGYTVRDVEIAQGHNFQEVKADFSEEPTASSAAEEAEYSLPDDLDVQTWEPPEPENPQDDMENSVTCNDDDEDQGLGIANWGEPTSMSSSENELSGSYRFKEEKQRAMEEVMNGKFKALVGQLLKSVGVSSSDQCDKSWVDIVTSLSWEAASFLKPGAIGANAMNPDGYVKVKCIAAGSRSESQLIRGLVFKKHAAHKHMPTKYKNPRLLLISGVLGHSINGLSSFDSMDQEKDDLKSKMDRIEMCHPNVILVEKTVSRDIQESILAKGMTLVLDMKLHRLERVACCTGSPILSCDNLNGQKLRHCDFIYFEKFVEEHDAVGEGGKKPIKTLMFIEGCPTRLGCTHAMIMKHQYRCGYHTALTAQVSMSFLVIFLVNVGHLNTCLTSRIGHLEPQVLQILLKGTHSDELKRIKCVMRCAVVMAYHLILETSFLVDQKAMFSTIPAVSVADILPTDKKSCDLASTNSSIPSLEYSAENGIVSTDIPICNGLHENNINGLNLGSEEFSPFSCEPYNPAVFSGFSAISSSLKKVMGDSFPFASSAPYQSLSAYFGFNGRKPDGQVNESISVLNSLEADENTMMEAKSHSNEVKLLNGGQSLSSPVHLDSNGDISKYDENNRKELQRKDDINAVLDSQSILVLMSRWNALRGTVCQQSHFSHIMFYKNFDIPLGKFLEDNLLNQTRLCDACQELPDAHFYYYAHHSKQLTIQVKCLPQEKSLPGEAEGKIWMWSRCRKCKSGSTKRVLISTTARSLSFGKFLELSLSYYSSSRKLSCGHSLDRDFLYFFGLGHMVAMFRYSSVATYSVCMPPRKLEFCGAIRQEWLLKETQNVYMKGITLFTEVANCLKTIQFDGLGGSIRDLSEVEKMFKQEQEEFEANIKTAVAKKGDPDQAAFKLLSLNRLMWDLLLQSYVWVRRLYPLHSPDGLRLESDVSEKVMHEHDYSKVEGIASRETGSMGNFMEDGDANVKIMFGSSVQVNELPIKEIPISGPFLECNELADPSNAQNERIPIVDDLRSRRSSDQNLNLSLDVIPTHLEVGENSPVSTDIQTNHLVADLKVLNKISSFHSPISNMLDSNDWFWKPFADIRQIGIKEFQKRLLPKFEFVSSSIAEYIPTAHQLITEEGTRLHIPLKTDNHVVSDFEGEPSSIIACALALLKDAYEVSEIDDEDERNESGITSNSTECLHGLTNGAALTSSHSFSRSSSDSDSVHSAGSTSSEESRASRATENHSIEIAMGYAKSLGREKYSVICHYFKQFRELRNWCCLSELDFIASLSRCRNWDAKGGKSKSYFAKTLDDRFIIKEIKKTELDSFLGFSSLYFKHVRESFESGSQTCLAKVLGIYQVTKRHVKSGKEVKYDPLMVMENLTYNRNITRQYDLKGALYARYNSAADGAGDVLLDQNFVNDMNSSPLYVSLKAKRYLQRAVWNDTSFLNSINVMDYSLLVGVDSQKSELVCGIIDYLRQYTWDKHLETWMKSSLVVPKNVLPTVISPKEYKKRFRKFMSTYFLSVPDHWCSQKSSNPCKLCGSGEDDPSQQKP

SEQ ID NO: 118461 - protein, 79 aa, Glycine max
  Coding DNA Sequence Number=SeqID_26776
MRRNNIKVGYRWCPTMLVGVMATLLMAQSKKCLVEKSCVQSDLEVEAACNVGGGWQVVQRRWWSLMVMVSAWMLVGSIV

SEQ ID NO: 118462 - protein, 196 aa, Glycine max
  Coding DNA Sequence Number=SeqID_26777
  Gene Ontology: Mol. function=transcription factor activity; Cellular component=nucleus; Biological process=regulation of transcription, DNA-dependent
  Homolog annotation: Hit_ID=A2YRQ3; Match level="QueryCoverage=62%, HitCoverage=74%, E-value=8e-25, Identity=52%"; Hit description =Putative uncharacterized protein
  Pfam annotation: Domain name=AP2; Domain location=21-72; Score=60.5; E_value=5.6e-15; Accession=PF00847.11; Description=AP2 domain
MENLSPLIYKNPIRRTSRRSTMYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGGSAASGELLWVGEFVIGSSAEGVCGSELFSCLLACEHIVFSDSSIPTHFKRALSAC

SEQ ID NO: 118463 - protein, 489 aa, Glycine max
  Coding DNA Sequence Number=SeqID_26778
  Gene Ontology: Mol. function=DNA binding; Cellular component=nucleus; Biological process=regulation of transcription
  Homolog annotation: Hit_ID=A7QRN5; Match level="QueryCoverage=98%, HitCoverage=86%, E-value=1e-114, Identity=47%"; Hit description =Chromosome undetermined scaffold_151, whole genome shotgun sequence
  Pfam annotation: Domain name=NAM; Domain location=1-76; Score=95.8; E_ value=1.3e-25; Accession=PF02365.6; Description=No apical meristem (NAM) protein
MAYRQWFFFCHRDRKYPNGGRSNRATRRGYWKATGKDRNVICNSRSVGVKKTLVFYAGRAPSGERTDWVMHEYTLDEEELKRCLGVKDYYALYKVYKKSGPGPKNGEQYGAPFNEEQWADDDIVDFNINSADQEAPNDVDNGNVLQPLLDDEIDNIIRGILDDELVLDQQHVNGYPDFPQVVSEETQSTVVDQFSEAVMFPEPVRITQPSNQFFDAQPSFDFNQPVTSHLHVSEASEVTSASSIKAKELDFNEDGFLEINDLIDTEPILANMENPVEYQQFEDGLSELDLFQDAQMFLRDLGPIIHETDSHAYTNAFVSSNIESQSYQLLPNPEDANQTVGEFWMHGERNTPSASEGFVDSFSLSSPGVVYESVGFPTEGNNNQSSTVEDVATSSFSSALWAFVESIPTTPASAAESALVNRALNRMSSFSRLKIKHTNIAAAGKDTATMKRAGRKGLPFLFFPIIIALCAFCWVFVGNLRLLGRCVSP

SEQ ID NO: 118464 - protein, 175 aa, Glycine max
  Coding DNA Sequence Number=SeqID_26779
  Homolog annotation: Hit_ID=A7QPF7; Match level="QueryCoverage=88%, HitCoverage=18%, E-value=2e-49, Identity=63%"; Hit description =Chromosome chr18 scaffold_137, whole genome shotgun sequence
MNSNATSMHKVIQEVGDNRTVEGNEDASSEDGDSKVYLPDLGKGLGCVIQTRDGGYLASMNPLDVAMARKEAPKLAMQMSRPFVLASRQSLTGFKLFQKLAGIEFDELNSKVLPLMPIDEMIGKTAGHAAFEGIANAIIQGRNKEGSSSSAARIFSYLKSMGSAMSSGRRERITT

SEQ ID NO: 118465 - protein, 579 aa, Glycine max
  Coding DNA Sequence Number=SeqID_26780
  Homolog annotation: Hit_ID=Q2HS67; Match level="QueryCoverage=57%, HitCoverage=94%, E-value=5e-39, Identity=31%"; Hit description =Cyclin-like F-box; F-box protein interaction domain
  Pfam annotation: Domain name=F-box; Domain location=7-54; Score=46.0; E_value=1.3e-10; Accession=PF00646.24; Description=F-box domain
  Pfam annotation: Domain name=FBA_1; Domain location=199-353; Score= -32.2; E_value=0.0025; Accession=PF07734.4; Description=F-box associated
  Pfam module annotation: Pfam domain module=F-box::FBA_1; Domain location=7-54::199-353
MPCKLASPLWLLPEELISEILFRVPVRSLLQFRCVCKSWKTLISHPQFAMHRLRTSIAHPNIAHQQLTSSKLVSYSVHSLLQNSSIPEQGHYYSSTSHKYRILGSCNGLLCLSDINLTHVVLCNPSIRSQSKKFQIMVSPRSCFTYYCFGYDHVNDKYKLLVVVGSFQKSVTKLYTFGADCYCSKVIQNFPCHPTRKPGKFVSGTLNWIAKRDLNNDDQQRMILSFDLATETYGEVLLPDGDHDKICSPTLDVLRDCLCVCFSDCRKGHWIVWLMKEYGVPNSWTKLVTIPYIKLGICRWSHLFVPLCISENGVLLLKTTSSKLVIYNLNDGRMDYLRIVDELGFDIHVYHERTLLRKSAHSSLCSPLSPLSIPALTPLSIPALTPLSRSLLRGSKNSSLQYQRSLISLRGDQSGSRCFARMLQPYEISIGLKEHSNPVAPKAYTLKSPSGPLPPDSAIATSLAVPGNSFNYSSDCSDRIPKRKRDGEEIETSTCTVFHTIPFSPSTNIISQIPTVEASGFLRERKRLQCEGFFSQFRHDIEIPNGENARNCVVNMILKFHDDPTVNGFEIVIFLRLVW

SEQ ID NO: 118466 - protein, 100 aa, Glycine max
  Coding DNA Sequence Number=SeqID_26781
MSDTLNWIAKTGNQLRILSFDLGTETFGKVLLPECDDGDNVGSPELNAVWNCLCFFLFAISHLVVYNSDDRLCYVTIVGPDLLTYHEVCCHTHGYVASSS

SEQ ID NO: 118467 - protein, 328 aa, Glycine max
  Coding DNA Sequence Number=SeqID_26782
  Gene Ontology: Mol. function=heat shock protein binding; Biological process=protein folding
  Homolog annotation: Hit_ID=O82368; Match level="QueryCoverage=96%, HitCoverage=97%, E-value=3e-34, Identity=30%"; Hit description =Uncharacterized protein At2g29880
MGDSQENNKGKSRDKDNYVSWTMEDTNELLHLLVDAMNRGLRDANGSLSKQNVERIILPQLNAKTKFPKTYSHYLSRMKWFRNQYNMMSTLMRNNSGFGWDPIGKTFTAHEDSHPSHSKLRGKSMVDYEYLKIVVGGGVSSGNNSISVDPDDTDATTFEPENKTVGIEEFSYDPNSDTFITPNNYEPAYQPPSPNQPSPPSHPPLDSEVPIEKQNCHKRRRSEYGGSSSAVGINNQGNVLENLSVGIETIAVNFEKISNMMEKREKDRDRDRELEGIIWDVIKEIPNLDDITRFKTAELLNTKAKKDFFLKMSPEERSSWINFKLGNN

SEQ ID NO: 118468 - protein, 489 aa, Glycine max
  Coding DNA Sequence Number=SeqID_26783
  Gene Ontology: Mol. function=inositol or phosphatidylinositol phosphatase activity; Cellular component=intracellular; Biological process=abscisic acid mediated signaling
  Homolog annotation: Hit_ID=A2ZX87; Match level="QueryCoverage=88%, HitCoverage=77%, E-value=4e-99, Identity=42%"; Hit description =Putative uncharacterized protein
  Pfam annotation: Domain name=Exo_endo_phos; Domain location=52-450; Score=42.9; E_value=1.1e-09; Accession=PF03372.14; Description =EndonucleaseExonucleasephosphatase family
MASFCMPVRVGLFWARVVMRKWLNMASNEPDYTADPDDDNEDDPESDSDNEVCVGTWNVGGKLPSDDLDIDDWLGINEPADIYVLGLQEIVPLNPGNIFGAEDTRPVPKWENIIRDTLNRVRPKAPKMKSFSDPPSPSKFKPSDDAPDIEEEILLESDGDIGEEVHPLDEEHNVYDGGADKPTTYEEASNTNFQASDAADIANTEEPIGNDLKRQFSDGKRLSRLNCFRDENLPKKTETSSSQQASKLSRMISSSDRIGLSWPEPPLHLLSQGPLDRPTSFKSVRSFSASKSFRTCQTFKKTIDDIGLLAEIDLEALMKRKRRSSYVRIVSKQMVGIFITIWVRRSLRKHIQNLKVSTVGVGVMGYIGNKLSKELEKGVFGGWSEGKLNFPPTYKYENNSDKYYGEDPKVGRRTPSWCDRILSYGMGMRLLRYGRTELRFSDHRPVTATYMAEVEVFSPRKLQKALTFTDAEIENEEVMATLGSFNLAK

SEQ ID NO: 118469 - protein, 341 aa, Glycine max
  Coding DNA Sequence Number=SeqID_26784
  Gene Ontology: Mol. function=choline kinase activity; Cellular component=cytoplasm; Biological process=phosphatidylcholine biosynthetic process
  Homolog annotation: Hit_ID=Q42810; Match level="QueryCoverage=100%, HitCoverage=98%, E-value=0.0, Identity=90%"; Hit description=GmCK2p
  Pfam annotation: Domain name=APH; Domain location=35-285; Score=96.7; E_value=7.4e-26; Accession=PF01636.14; Description=Phosphotransferase enzyme family
  Pfam annotation: Domain name=Choline_kin_N; Domain location=1-34; Score=26.3; E_value=0.00011; Accession=PF04428.5; Description =Choline kinase N terminus
  Pfam annotation: Domain name=Choline_kinase; Domain location=59-262; Score=274.9; E_value=1.7e-79; Accession=PF01633.11; Description =Cholineethanolamine kinase
  Pfam module annotation: Pfam domain module=APH::Choline_kin _N::Choline_kinase; Domain location=35-285::1-34::59-262
MELLKGCGSQEEIMEVLSAVASDLGDVIDDVNTLQVIPLNGALTNEVFQINWPTKNDGEVRKVLIRLYGEGVEVFFDREEEIRTFECISKHGQGPRLLGRFTSGRVEEFIHARTLSAADLRDPEVSALIASKMREFHNLHMPGAKKAQIWHRVRKWLGQAKSLCSPKDAKKFGLDNLDEEINILEKKLSEGYQEIVFCHNDLQYGNIMMDEETRLITIIDYEYAGYNPIAYDLANHFCEMVADYHSDTPHVLDYKKYPGNKPSNAKVNQLVKAAEKYTLANHLFWGLWGLISSYVNKIDFDYKEYGRQRFQQYWIRKPTLLDSPSIVSLDETVNGLLSSFT

SEQ ID NO: 118470 - protein, 82 aa, Glycine max
  Coding DNA Sequence Number=SeqID_26785
  Gene Ontology: Mol. function=boron transporter activity; Cellular component=integral to membrane; Biological process=response to boron
  Homolog annotation: Hit_ID=A9YTW6; Match level="QueryCoverage=87%, HitCoverage=23%, E-value=8e-18, Identity=63%"; Hit description=Major intrinsic protein NIP5;1
MPESEIGTPTAASVPATPDTPGGPLFTSLRVDSLSHERESFSMAGCKCLPTKGHSCFTDFSVGVPLPNVSLTQKSYEIHAEG

SEQ ID NO: 118471 - protein, 893 aa, Glycine max
  Coding DNA Sequence Number=SeqID_26786
  Gene Ontology: Mol. function=protein binding; Cellular component =nucleus; Biological process=red or far red light signaling pathway
  Homolog annotation: Hit_ID=A5Y6J2; Match level="QueryCoverage=92%, HitCoverage=69%, E-value=0.0, Identity=83%"; Hit description=LATE BLOOMER 1
MVLESWNVNLLGEPLALNFVASMADSLAMELRQKECNEPVKLIKVIWSRPLSLPPLKLLDLSLHAGLPRNWMHLHFLRAIGTAMSMRAGIAADAAAALLFRILSQPALLFPPLRQVDGVEVQHEPLGGYISSYKKQILSVHLRSKTFVVDQIEVPAAEASIEATAQGIASMLCAHGPEVEWRICTIWEAAYGLIPTSSSAVDLPEIIVATPLQPPVLSWNLYIPLLKVLEYLPRGSPSEACLMKIFAATVEAILQRTFPPESTREQNRKSKYLAGIGFGSASKNLAVAELRTMVHSLFLESCASVELASRLLFVVLTVCVSHEAQFSGSKRPRGEDNYSSEDIIEDLQTSENQKESKNRKLKKQGPVAAFDSYVLAAVCALACELQLFPLISRGNNHLASNKVQDIAKPVRLNGSSHELRNGLDSAVRHTHRILAILEALFSLKPSSVGTPWSYSSNEIVAAAMVAAHVSELFRRSKACMHALSVLIRCKWDNEIHSRASSLYNLIDIHSKAVASIVNKAEPLEATLIHAPIRKDSLVCVGVKRQNQCESSSCFDAGRTSVVPSEDSFPSKLDHNSNKTPCPKGASDYTLGKGVTGFSLDASDLANFLTMDRHIGLNCNGQIFLRSTLAEKQELCFSVVSLLWHKLIASPETQPCAESTSAQQGWRQVVDALCNVVSASPTKAATAVVLQAERELQPWIAKDDDSGQKMWRINQRIVKLIVELMRNHETAESLVIVASSSDLLLRATDGMLVDGEACTLPQLELLEATARAVQPVLEFGESGLAVADGLSNLLKCRLSATIRCLSHPSAHVRALSISVLRDILHTGSIRCSPKPRRLNGTHNPSYQYFNLDAVDWQADIEKCLTWEAHSRLSNGLSINFLDIAAKELGCTISM

SEQ ID NO: 118472 - protein, 191 aa, Glycine max
  Coding DNA Sequence Number=SeqID_26787
MGLELRVQQDVAGFYVAVNDGLVKAVEVGKPMGHATDDVDTCGPGKWGEGEREIGLVEPLVEGFHLGGELAEALEGVRGEFFYCDGGAAGEAGLVDEAEAAVADDEVRGEVVGGAGELVPGDLDEVGVGGPAGVHGGEGGGGFAVGGGAGSDMGGAGPGLGGVAVVLAEEDGGGEKEGDHEEAGDRGDDGL

SEQ ID NO: 118473 - protein, 65 aa, Glycine max
  Coding DNA Sequence Number=SeqID_26788
MKAKDPVDMAEHGQVQPDHGHKFWQVYSRQGRKGIYPRLIVGYGEREPITLGGEYREIVRNQELK

SEQ ID NO: 118474 - protein, 65 aa, Glycine max
  Coding DNA Sequence Number=SeqID_26789
MGRKMKVELVEIGRGKRRERDIKRGGENCLEVEGDGERKDVGLWLHPEAKGSPPLNIDTNTRRAS

SEQ ID NO: 118475 - protein, 47 aa, Glycine max
  Coding DNA Sequence Number=SeqID_26790
MSLLLGAIYKKGGEQLRSIFTMEHNRNLQRFIVYRRQQKLIQPLLLF

SEQ ID NO: 118476 - protein, 98 aa, Glycine max
  Coding DNA Sequence Number=SeqID_26791
WSGGRLEYRTTPHGDLVGYRSRIDHMESHELQFGLQQDISIDPMNLDLLHQIDMRGNHYIDWMEYHAEWINIWKNKHSDVLAGQWIEGIVTHTLAYME

SEQ ID NO: 118477 - protein, 73 aa, Glycine max
  Coding DNA Sequence Number=SeqID_26792
  Subcellular localization annotation: CTP_CleavageSite=38; ConfidenceScore=5.08e-01
APVGFCFLSAVPPCSSYLTGVVRNGKKHRRTISAGKCSGAIGAGLFAITPAGERGMCCKAIKLGNARVFPVTT

SEQ ID NO: 118478 - protein, 116 aa, Glycine max
  Coding DNA Sequence Number=SeqID_26793
MVFHLRLVVSFKTRKGKQGSKGLSKELIKEASTRIKPRLLCKQSMGQNTPKIYDDGWLKFSQRCLAKISYKAPVESCMTKKRSHLSHARGAERHPPIGKSAEGAGECGFFPDPQEQ

SEQ ID NO: 118479 - protein, 80 aa, Glycine max
  Coding DNA Sequence Number=SeqID_26794
MAKPVVNISGKTMRRGRRSGYCQQRVEGGQIGEAVAPGRESCIQRGACCSEAQPDQSPYGVIRIGTKDRQRNGRHAHVLG

SEQ ID NO: 118480 - protein, 217 aa, Glycine max
  Coding DNA Sequence Number=SeqID_26795
  Gene Ontology: Mol. function=pyridoxal phosphate binding; Cellular component=mitochondrial matrix; Biological process=metabolic process
  Homolog annotation: Hit_ID=A8GAA2; Match level="QueryCoverage=73%, HitCoverage=38%, E-value=1e-81, Identity=92%"; Hit description =Aminotransferase class V
MLDISQFDQINPPARLLMGPGPINADPRVLRAMSSQLIGQYDPAMTGYMNQVMALYRALFRTENRWTMLVDGTSRAGIEALLVSAIRPGDKVLVPVFGRFGHLLCEIARRCRAEVHTIEAPWGEVFSADRIEDAIKRVHPRLLLTVQGDTSTTMLQPLHEDQAYRYRRPRGGARYQLLFPLVRVNFELGVIMVIAVSCVKLLSAHNSTQHTSRKHKV

SEQ ID NO: 118481 - protein, 196 aa, Glycine max
  Coding DNA Sequence Number=SeqID_26796
  Homolog annotation: Hit_ID=Q1J7G7; Match level="QueryCoverage=24%, HitCoverage=80%, E-value=2e-09, Identity=63%"; Hit description =Transposase
ASGDAANLLIAVYDGVFEGAPVASVFLSAVPPVQLLTGWCVTAKAPPDISAGKCSGRVPFAIQAAQLLGRAIGAGLFAITPAGERGMCCKAIKLGNARVFPNTLTHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 118482 - protein, 83 aa, Glycine max
  Coding DNA Sequence Number=SeqID_26797
PLGPSRIFLQKAVASGGSNLARLGELGGNHLPYFAINRGGSEEEKAEALPKRFRNVFREEFRKGFNRSSTFFIRSSSIFDLQR

SEQ ID NO: 118483 - protein, 280 aa, Glycine max
  Coding DNA Sequence Number=SeqID_26798
  Homolog annotation: Hit_ID=Q6WAY6; Match level="QueryCoverage=32%, HitCoverage=19%, E-value=5e-12, Identity=37%"; Hit description =Putative uncharacterized protein
VRHAYSLESHRSCTEKGEANWDRLLANKEGASVNWFPRWKEGRTRVLISCRGFPNVPLMGTRGCVSYNPVLAIRQIGYPMRGTSLEEELAHVHKAWEVVQKKDKELRGSNNGSIGGYRRWLKAHVQGLDWFPSLRTAKREEVEAPEEDEEVQALTAELEQAQTVKDRFKSAALKIRKENAELKDINIATTRPWNKRPKDSNNELKLRREEMDQSRVDSLILKDELKTNMLAIVSRYQEELNLATAHEHRVADEYAQVYAEKEARGRVIDSLHQEATMWMD

SEQ ID NO: 118484 - protein, 57 aa, Glycine max
  Coding DNA Sequence Number=SeqID_26799
MTGQPLLSLCVTSKIKHGAKPVRQAQRNDNPGDIIDVVKKEVDSDGLGCQIQLESTR

SEQ ID NO: 118485 - protein, 381 aa, Glycine max
  Coding DNA Sequence Number=SeqID_26800
MIWNSLALAGLVSMMRRPTDRRADLLGSDESRGRQLNCPCSGLGAWRSRQASVAGVARVGETLAECEQGRVGALPVYPLCPVLCGFVRFTGQAEAGVAPSEPVPGAQQRLAFALATGQQPGHPRQRQQCGHHEASDQLPGAQIVQPERLEQLLLAARIEGQHQIVPAAAQPVAHLAQLQPTLLQWCVRAGLQAIIQGVQDAFRCHGCGRVNPDPAALRQPYLGPGVGIHPPHHPVVADAVAGATSETGHHPRRDAGVAHQHHEGRAEVFTEAGLVAEQELVDRVAPCRRGIQRVREIGGDPLQRAAHDGLVIAASVLPPLLRQRGGARVEAGRQLQRRAAQIGRQRAVEAQWRGRMQSPAAERGQRAFAAQAHVRIQHAAR

SEQ ID NO: 118486 - protein, 199 aa, Glycine max
  Coding DNA Sequence Number=SeqID_26801
  Homolog annotation: Hit_ID=A5C7Z4; Match level="QueryCoverage=39%, HitCoverage=28%, E-value=3e-08, Identity=37%"; Hit description =Putative uncharacterized protein
MFLYPPDEVSLVGQTLHTFLAWPTHLVKSLSQQVVVSPAKPPPKPDDPLYLMTLTIPELFSRPYQVRWDATVFGVFNLDFPLYIKHEDLSEIAHGGQCLSISVLQLWIFGHWQMVVILPKEHLVVWFCSLHNRPDNYLKGIINSALKGLDDAPQPKSKAPARWIVVKCNRQKGSTECSYYVMHWMSTIILGTFRNNWEA

SEQ ID NO: 118487 - protein, 40 aa, Glycine max
  Coding DNA Sequence Number=SeqID_26802
MTEARQKGVRKPNRGGACHPARPGVPGCFLQKQPPSGGRI

SEQ ID NO: 118488 - protein, 90 aa, Glycine max
  Coding DNA Sequence Number=SeqID_26803
MLAIITKYQEELNLATAHKHRVADEYAQVYAEKEARGRVIDSLHQEVTMWMDRFALTLNGSQELPRLLAKAKAMADTCSAPEETHGLLDY

SEQ ID NO: 118489 - protein, 110 aa, Glycine max
  Coding DNA Sequence Number=SeqID_26804
VAGCVICGGAHDSGCCIPTEDTTHEVNYMGNQPRPNFNADRPLSSFGANTEKNPKEECKAVMTSSKMVSINEGEKRIGEEKQQLVTEPAIDPVVEPLSETEEKVEVEDDQ

SEQ ID NO: 118490 - protein, 76 aa, Glycine max
  Coding DNA Sequence Number=SeqID_26805
  Subcellular localization annotation: CTP_CleavageSite=63; ConfidenceScore=5.56e-01
MTMITPSSKLTLTKGNKSWYRAPPRGRNTTAALGWPVAGNRHTATTSRVHLSSSAKRLERCLRHMADQQATKSKAK

SEQ ID NO: 118491 - protein, 193 aa, Glycine max
  Coding DNA Sequence Number=SeqID_26806
MKEMKREKHASYSSHNSCKSLSEELCDYYEGRHRSYLRHHSHRREMERKPQEANINLPYFHGKDNVEANLDWEIKVEQQLKKKSTSKSVALTLSKERPRGHITSQCPTTKTMIMRGQDIYSSQDEATTSPSSSESEKEKGEESSEEIYPQEEGQPLVVKEKCKEALASIATPLGLEFIPQVKKLLDEGLIGTH

SEQ ID NO: 118492 - protein, 243 aa, Glycine max
  Coding DNA Sequence Number=SeqID_26807
MYNLHEKGRAPDLESVLADFMTYKASSKGNCYTTQQQRTQFGKDYSFEDYQWELEWQPCYHNEAKSLFNLDDLLMQFKGTVDSMQQAFKRAETQIEYAEIETHQESILQVNTIHHQLITKEEKDEVSIIPEYSCMATTGYVVGKDKGRLELSVEDKKIFFDLFEAMKHPDMSDACFEEEEVEQEIALSASTMVLQFPLEKELNYVTDCLACDEEHDDPKDNSIGHVVFEELKKIGQQKIPKQN

SEQ ID NO: 118493 - protein, 49 aa, Glycine max
  Coding DNA Sequence Number=SeqID_26808
MENAKHMATPMSTACYLDKDETDQSIDVKQYRDFNQIPNNHTLVSLKES

SEQ ID NO: 118494 - protein, 145 aa, Glycine max
  Coding DNA Sequence Number=SeqID_26809
  Gene Ontology: Cellular component=mitochondrion
  Homolog annotation: Hit_ID=Q6R9A5; Match level="QueryCoverage=39%, HitCoverage=51%, E-value=1e-27, Identity=96%"; Hit description =Putative uncharacterized protein orf111-b
FWPYLAGDDDVELAAEKDSAFSDILEEGGDDVKSAWPLWAGPHTCYNGNYNGKQGCKAERIRKDCLSSDCSLQLGNMKLESLVIADQHAAVNMYPGPVHTARHTLGIGFARSIGPMITHDFCVPLVPQRLLVVLLAHTTVGSSTG

SEQ ID NO: 118495 - protein, 117 aa, Glycine max
  Coding DNA Sequence Number=SeqID_26810
RVPFAIQAAQLLGRAIGAGLFAITPAGERGMCCKAIKLGNARVFPVTTLLDRTDSAVTHPPEVSSLTSGAVVSPTLKQAQPAVPPTCIPDSGLAKGQRPIPVEEFYQPSLRWRKGPD

SEQ ID NO: 118496 - protein, 184 aa, Glycine max
  Coding DNA Sequence Number=SeqID_26811
  Homolog annotation: Hit_ID=Q84VH5; Match level="QueryCoverage=97%, HitCoverage=23%, E-value=2e-62, Identity=73%"; Hit description =Envelope-like protein
MDKKIRGIVSSILKDASVPDAEKDVPTSSTPNVSVPDVEKDVPTSSTPNVSVPDVNKDVPTSSGPNDEVLSSPSKERSTEEDDQAAEETPAPRAPEPAPGDLIDLEEVESDEEPIANRLAPGIAERLQSRTGKTPIKRSGRIKTMAQKKSTPVTPATSRRSKAAIPSKKRKEISSSDSDEGCRN

SEQ ID NO: 118497 - protein, 113 aa, Glycine max
  Coding DNA Sequence Number=SeqID_26812
  Subcellular localization annotation: CTP_CleavageSite=56; ConfidenceScore=5.39e-01
MTDVWGANTFLVRKYNSRAFHLKVRRSRLFRFFRRFPQINVGGDSARIPFVEHASRESRVASRRRVGVADSDDEGSIDLRTNPFQDGGDDAILPRRGPITRVMARRFQEEGIL

SEQ ID NO: 118498 - protein, 131 aa, Glycine max
  Coding DNA Sequence Number=SeqID_26813
MVNVSAYLLYSCGFCKNLTETSMQAGNSNVYGFLEPKSIQRSGKSQFESESYIKSWMQSSKRDVYLGAYLNGPDNYLKGIINSALKGLDDTPQPKSKATSRWIVVRTKRKHLVRLLRHALDVYDNLRNFQE

SEQ ID NO: 118499 - protein, 154 aa, Glycine max
  Coding DNA Sequence Number=SeqID_26814
  Pfam annotation: Domain name=zf-CCHC; Domain location=92-109; Score =10.2; E_value=0.044; Accession=PF00098.14; Description=Zinc knuckle
MKEMKRDKHASYSSHNSCKSLSEELRDYYEGRHRAKLKRKSTSKSYGSHSYPKKDQGQGILGVRPSKPKDDKGKTIEKQPLKASMQEKTSSMKCFKCLGRGHITSQSPTKKTMIMRGQDIYSSQDEATTSPSSSKSEEAKGEESSEEIYPQEEG

SEQ ID NO: 118500 - protein, 119 aa, Glycine max
  Coding DNA Sequence Number=SeqID_26815
MVKEAMYTVFPLLMNANRNRNSIRGVFMMVHGLTTHTRFQEPIGQQPKIDGIRFQTVNLQQNNELLAPFMDEEIQKAIFKAAAKFFMKEGNSQKDCMDLMEIRTLKKQETQQSMFSGGI

SEQ ID NO: 118501 - protein, 121 aa, Glycine max
  Coding DNA Sequence Number=SeqID_26816
MQGERLKVRKTEEREEKRRKEEEKKKKKKNRGTVESNRGSFPTSFLLLALYRVQQSGKGAEFKGPAFFCNKLSLEISEEKKKGENSSRGASVTLPRRFRYRFRGCSSSFFTVVHCSLFSNH

SEQ ID NO: 118502 - protein, 122 aa, Glycine max
  Coding DNA Sequence Number=SeqID_26817
  Subcellular localization annotation: CTP_CleavageSite=36; ConfidenceScore=5.09e-01
MALLAASLVPACFLGKSGVSLKDSTLFGLLLSEPIKANFSSSALRIKLLISLFLAYLRCLDLLGFLLSLNFLAPTPTQLHTSLLLELLSQGFWITVVLDCVGCVGEVLYLMFLGMMIDVGGD

SEQ ID NO: 118503 - protein, 50 aa, Glycine max
  Coding DNA Sequence Number=SeqID_26818
MGGGVWLFGKTARKPHYKRNLKESWASSSKGNNTRKSSLPWIQTENANEA

SEQ ID NO: 118504 - protein, 106 aa, Glycine max
  Coding DNA Sequence Number=SeqID_26819
MSSIVYGDCARMTPSGPEEGQQVLGVASSKYGSLSVLGECLSPPARQAQGETPQQPGDGRQRATDAPPSPLEFTSAHPQKGLSIAYTTWPTNRRPSPKPKDAPSCS

SEQ ID NO: 118505 - protein, 343 aa, Glycine max
  Coding DNA Sequence Number=SeqID_26820
  Homolog annotation: Hit_ID=Q6WAY6; Match level="QueryCoverage=93%, HitCoverage=61%, E-value=3e-38, Identity=31%"; Hit description =Putative uncharacterized protein
MGTNQTGKRFYQVKVKSLDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQRYLEDKARGMANQGDWVLFMDVLALLIFGVVLFPNVDGLVDLAAIDAFLAYHHSKESLVVAVLADLFDTFDRKRRIDWDQLLAGIGGRTINWFPRWKEGKEGVLFSCGGYPNIPLIGTRGCINYNPALAIRQLGYPMRGAPTEESMSPFLVRDFGAQNFKAIQRIHKAWETPLRKDQELRGIRNGIIGGYHGWLKVHIRGLDWLA

SEQ ID NO: 118506 - protein, 99 aa, Glycine max
  Coding DNA Sequence Number=SeqID_26821
MRQTRPYSGMTPVNRKAGTGERTRERQGETPGIFIVLSGFATTDLSVRFRDACQGGGAYGKTALPRPSHFPVKYLPGIFQEISAPFVSHFRSPQSNDRA

SEQ ID NO: 118507 - protein, 258 aa, Glycine max
  Coding DNA Sequence Number=SeqID_26822
MAREGIGHILDLTPIEEKERKPQEANINLLYVHGKDNVEANLDWEIRVEQQLKRKSTSKSYGSHSYPKQDQGQGILGVTPSKPKDDKGKTIEKQPIKVSMQEKTRFIKFFKCLGRRHITSQCPSKKTMIMSGQDIYSSQDETTTFPSSSESEEAKREESSEEIYPQEEGQPLMVKEECKEEIVSSKRLAKRERHFEIKTNIKEITPLRQPPHFLLCKKTLVSISTPLRLKFIPQVKDLLDEGLVHKSLNPCALLVPKI

SEQ ID NO: 118508 - protein, 108 aa, Glycine max
  Coding DNA Sequence Number=SeqID_26823
MAEEGCTPSKMNVLLQPPPNGRFRTHEFEVLSELREFLRDTSVLCLNDFAIHFIRLKNFLGQFIGCNFKLFGAQSVENPSLSREDLFFFFFSFSKGLRDRESLVVKEF

SEQ ID NO: 118509 - protein, 135 aa, Glycine max
  Coding DNA Sequence Number=SeqID_26824
MAHLELSIPWRGSTEQPHRPTYLNYPEGNFGGNQLLDGIVHHLSGPDRYALTRTLHRRSGSVGGATHRGIPPISFLAPYGPTPGARRCRGTPRARAAIHNRDDDVSTSISTARAWATIAIRVGQCPESIGGPALT

SEQ ID NO: 118510 - protein, 168 aa, Glycine max
  Coding DNA Sequence Number=SeqID_26825
MAGRLPDETAGGDFLDAGDDAVAVEDHGVEEVRDDAGVVGDDEDFSRRSAARSGAGREVDHAMLFGKAGDLRLGIADHKAEIAETLQIRGQRLRTGINDGAIAVRPGDDGRDDIHGAVVFGAMAHADHLAVVVDIGPGPVFRCGFDEMGVEEARRAAIADDRAGDAFS

SEQ ID NO: 118511 - protein, 142 aa, Glycine max
  Coding DNA Sequence Number=SeqID_26826
QTQEHRLLEQMDQWLALNSASPHQLDLAPYASGPYNAQWNASGLLHDKHTLRSSRILGEMEVDEPWLGLWLPLNYQVDMGARMAFVDNWAVGKEKVGYWLSNDIVGLVGNLAVLEWQSQHGLLLHPHPLHLPQFSHSSKQDD

SEQ ID NO: 118512 - protein, 203 aa, Glycine max
  Coding DNA Sequence Number=SeqID_26827
  Homolog annotation: Hit_ID=A5B939; Match level="QueryCoverage=35%, HitCoverage=52%, E-value=1e-22, Identity=69%"; Hit description =Putative uncharacterized protein
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGLFGASFLGRRTVNSDWYGQGESDCLIKQALRWSLRMLTQCDFCPSALNVKVKKFNQARVNGGSNYDSLKVAKCLVI

SEQ ID NO: 118513 - protein, 54 aa, Glycine max
  Coding DNA Sequence Number=SeqID_26828
PFAKRKPRAKRIFVHALSRDSHALSDQPWHLRLIWSAKLAKAKLSVVYCLAKRD

SEQ ID NO: 118514 - protein, 31 aa, Glycine max
  Coding DNA Sequence Number=SeqID_26829
PKSTLRLKRTLGPSLASLAQSSWSLLSNTLG

SEQ ID NO: 118515 - protein, 202 aa, Glycine max
  Coding DNA Sequence Number=SeqID_26830
HHSLGRRLHLVRRDVLLHLYPHPAERRAGLRLAHAADAAVPDAVHGAVRRLAQSGRHAGLDRPTAAASAGPAAHLGAAGGTAVVIPVGAAARQGARRIARLFSAAADHGAGGPFDLPRSAVAAAKAGGGVRHGGAGADAAGGGLVRLRRRRRGGVADQCRAVLAHSAARRHQRRGAGVLHPRQPSAAFQPVRPAELCGTGAA

SEQ ID NO: 118516 - protein, 173 aa, Glycine max
  Coding DNA Sequence Number=SeqID_26831
SEFLIGGYVGARASLLSTTPPFVAMTQELVARGDTLRIRGDRAFGFAPHPSLSSRGGGPDDKQRQNLVMSAPLCHPEAAGPMIRGDTLRLSAPFCHPEAAGPMTSRDKIWSFCTLVSSRGGGLDDTRRYLTVIRTLLSSRGGGPDDKQRQNLVICTLVSSRGGRPDDTRKYPS

SEQ ID NO: 118517 - protein, 150 aa, Glycine max
  Coding DNA Sequence Number=SeqID_26832
MGDLEEVQEQMKADMSALKEQMTSMMNTILGMKQQMESNLATAAAVSSVAEGSTPGHINNPHPGYNRGTYPYSLLPNYTPLAIHEDVGHVPPLILEGEPPRHPDVVHENPREHAQGDIDSYSPFPAEGPPPNALPQPNITGEPRRHPTQP

SEQ ID NO: 118518 - protein, 149 aa, Glycine max
  Coding DNA Sequence Number=SeqID_26833
MGFLIKPIRPGSSSGHTRTPGPLYPALKGIPGLADSVEHLHERDPLTPNPGSSCHARPPLLAKHWHKTQGLFWIKLGHGSNQWCPPPAPYFLLEISILVVPELDASLPEKRPPLDGFEALLVYRAPKAVTIILRSGTSSFCCLVLPGPL

SEQ ID NO: 118519 - protein, 158 aa, Glycine max
  Coding DNA Sequence Number=SeqID_26834
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=O98568; Match level="QueryCoverage=67%, HitCoverage=22%, E-value=9e-52, Identity=98%"; Hit description=ATP synthase subunit beta
  Pfam annotation: Domain name=ATP-synt_DE; Domain location=106-154; Score=21.3; E_value=0.0037; Accession=PF00401.11; Description=ATP synthase, DeltaEpsilon chain, long alpha-helix domain
  Pfam annotation: Domain name=ATP-synt_ab_C; Domain location=12-119; Score=165.0; E_value=2e-46; Accession=PF00306.18; Description=ATP synthase alphabeta chain, C terminal domain
  Pfam module annotation: Pfam domain module=ATP-synt_DE::ATP-synt_ab _C; Domain location=106-154::12-119
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGSDIDPQEAQQTLEIAEANLNKAGRPRAKQLRPILALRRARTTSRGYQCDFITS

SEQ ID NO: 118520 - protein, 167 aa, Glycine max
  Coding DNA Sequence Number=SeqID_26835
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=72%, E-value=4e-24, Identity=67%"; Hit description=LacZ protein
MVCYNLCLYIGYIGDFYTLLYYLVLESSRLICHLPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRVLLPLRTTPSVAEQGGDS

SEQ ID NO: 118521 - protein, 120 aa, Glycine max
  Coding DNA Sequence Number=SeqID_26836
GYNSAVECHLDVVEVISSSLIIPKPNRTPVEYEAPGYKLCLGMEENSESALSTNKEAISNATRNLMESSILAQDERWRHALHMQVGREVVFPVADGWKRLLIPRRAEEQKEESARGGARV

SEQ ID NO: 118522 - protein, 150 aa, Glycine max
  Coding DNA Sequence Number=SeqID_26837
MGEVEEVQEQIKADMEALKEQMATMMEAMISIKEIMEVNAVAIAATSTIAKVDLTPPYGLNQINHPISDMVGLEGKELGGTCGPHLVRKTSMSSRHMACLRTIHHPMWRTLPVRMSITPLPYSLNVDNLKLIMHMSLNPWGRCMRYPIAI

SEQ ID NO: 118523 - protein, 32 aa, Glycine max
  Coding DNA Sequence Number=SeqID_26838
GQYVRDCAAADKSKALAPTYPPMRNSDLRSSG

SEQ ID NO: 118524 - protein, 51 aa, Glycine max
  Coding DNA Sequence Number=SeqID_26839
MYEKRVPHRLASQYGTMVISRISANPVMNPSLKSIKGNHYPKVEHIHYHKK

SEQ ID NO: 118525 - protein, 248 aa, Glycine max
  Coding DNA Sequence Number=SeqID_26840
MERSMIDAASGGALGDMTPAEARNLIEKMAFNSQQFSARNDAIVIRGVNEVATNSAASSETKKLEGKLDALVNLGNPAGLESEICSCRKDLCPSMQQPGAIEQPEAYAANIYNRPPQPQQQNQPQQNNYDLSSNRYNPGWRNHPNLRWSSPQQQQQQSAPSFQNVAGPSRPYIPPPIQQQQQPQKQPTIEAPPQPSLEELVRQMTMQNMQFQQETRASIQSLTNKMGQLATQLNQQQSQNSYKLPSQA

SEQ ID NO: 118526 - protein, 71 aa, Glycine max
  Coding DNA Sequence Number=SeqID_26841
MFVRMKILMTNTSTSYHRGELERPSLLTENALGIMVRLQSLPWCPMHAIKKAMQTFWLPVTKTMKTNAMHE

SEQ ID NO: 118527 - protein, 170 aa, Glycine max
  Coding DNA Sequence Number=SeqID_26842
  Homolog annotation: Hit_ID=A5BQX5; Match level="QueryCoverage=67%, HitCoverage=35%, E-value=1e-10, Identity=34%"; Hit description =Putative uncharacterized protein
MTRGNPSDLQPFDPEIDRTFYRLVRHHLVPFEHPEHSVIGDLEHYCFEHSDFEHFENMAQPPPRERTLREMVAPDFTYESLCIQYPDEDVPYVLKTGLIHLLPKFHGLPGEDPHKHLKEFHNVCSTMKPPDVQEDHIFLKAFPHSLEGVAKDCYITLLQGPSRPSERIFQ

SEQ ID NO: 118528 - protein, 72 aa, Glycine max
  Coding DNA Sequence Number=SeqID_26843
MQDPRQRHRQEKFRSLSVDHTPRPMLLAPAVVVIGGILPRSVILVDWDKFSIGSDQPLNSLPSSPSRSYETI

SEQ ID NO: 118529 - protein, 115 aa, Glycine max
  Coding DNA Sequence Number=SeqID_26844
MVSRGIIPSKKHIAVVGTTSNNMLSKRKTLDEGSLLSRRERDPNTVLYWFGKLRAYVQYSSNPLDVSTRPLCKNPCVQSLNHTRNTIPLCSAFLQQRPLKSSKSLNDKKEKRNIS

SEQ ID NO: 118530 - protein, 39 aa, Glycine max
  Coding DNA Sequence Number=SeqID_26845
MQQATIHRILGLHNYASKGGKGTQSNPGRGNSGVKGNKV

SEQ ID NO: 118531 - protein, 116 aa, Glycine max
  Coding DNA Sequence Number=SeqID_26846
MTDPLDESISCFLIRVNPWVLVPSPPEDYIGLHVLTFKGHVLPFKGLHVLAFKGSCTFNFRGLHVLVVKGSCTFTFVGLHALTFRGLHVLAFRGLHVLAIRGLHVPHFQRGTCPHL

SEQ ID NO: 118532 - protein, 377 aa, Glycine max
  Coding DNA Sequence Number=SeqID_26847
  Homolog annotation: Hit_ID=Q84VH5; Match level="QueryCoverage=100%, HitCoverage=60%, E-value=1e-142, Identity=68%"; Hit description =Envelope-like protein
  Subcellular localization annotation: CTP_CleavageSite=21; ConfidenceScore=5.34e-01
MATSPKETSAPGSPSVPSSPSSTKAPSNQERPEFNIQPIQMIPGSAPVPEKLVPKRQQGVKISENPSPATSPREVDPEMDKKIRSIVSSILKNASVPDADEDRSTEEDDQATEETPAPRAPEPAPGDLIDLEEVESDENPLPTSWHLALQKDYKAERENPHSRSGRIKTMAQKKSTPITPTTSRWSKVAISSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAGKLSV

SEQ ID NO: 118533 - protein, 310 aa, Glycine max
  Coding DNA Sequence Number=SeqID_26848
  Pfam annotation: Domain name=Transposase_23; Domain location=145-210; Score=-4.3; E_value=0.0035; Accession=PF03017.5; Description =TNP1ENSPM transposase
MAIGRPEHPGRVRGAGTGVTITQYCGPASRRSTTSSNITVEQLADIIGNLKEEWRRHAEEENIKRDEAWMRRVEEEKQCTMDTFKGQIQQAIKLELSQIVSQHSAPLQPNDIEVLAARVSTKGSCAAAETNALAKKPSELNGDSVGLHVTVENSNKLVAVGKQCDSFGTIHNVPYADDVVRVSVVEVIFGDAEVPIPTSEIKFVKEALGSFVPWPRHLVKPMLPEEAEKDVSSPLKTVEEEKPPEVIDPLGELVKNLFDIYQRPVEVLWDGAKFGINNVKDGFFITHADVSEIILGDKCLNISILQLWLM

SEQ ID NO: 118534 - protein, 97 aa, Glycine max
  Coding DNA Sequence Number=SeqID_26849
MEHMNLGIPRSCGSASHRTLGTRGNTGSNKDRRKSLKVYQSHTGQGLTFSPWVKVYDKLGFWLKACRTVGHDICQVLTSGFRDKGDVLHYFHDTHAQ

SEQ ID NO: 118535 - protein, 172 aa, Glycine max
  Coding DNA Sequence Number=SeqID_26850
  Homolog annotation: Hit_ID=Q0KIL1; Match level="QueryCoverage=95%, HitCoverage=18%, E-value=2e-08, Identity=28%"; Hit description =Gag/pol polyprotein, 3'-partial, putative
  Pfam annotation: Domain name=G-patch; Domain location=43-82; Score =22.0; E_value=0.00042; Accession=PF01585.14; Description=G-patch domain
MPYVEAAEESLETAFQSFEVVSISSVDSFSGQACLSDAAVMMARVMLGNGYEPGMGLGKDNGGITSLINAKGNCGKYGLGYKPTQADIKRSIAGRKSGSQNSRLRQEGEGSPPCHISRSFISAGLGDEGQVVAMYEDGVPSTLDLVRSCPPDFQLGNWRVEERPGIYVMSIM

SEQ ID NO: 118536 - protein, 86 aa, Glycine max
  Coding DNA Sequence Number=SeqID_26851
MMTKVMTKSSKINQRTTQVNQRSIKNNSRVQDKNQEEFKTQEESLKSRIKIQGSRPQESRSRFKTQDSRIKRRLNQDKYEKVFLKN

SEQ ID NO: 118537 - protein, 173 aa, Glycine max
  Coding DNA Sequence Number=SeqID_26852
  Gene Ontology: Mol. function=RNA-directed DNA polymerase activity; Biological process=RNA-dependent DNA replication
  Homolog annotation: Hit_ID=Q2HTK5; Match level="QueryCoverage=97%, HitCoverage=66%, E-value=4e-13, Identity=30%"; Hit description=H+ -transporting two-sector ATPase, alpha/beta subunit, central region
MGSFGEAGWEWEFSWRRNLFDNELGRASAFIEQATTLSPNAALKDYWVWGADPKGIFTTRTAYLCIKGDQPIGYLNRGFSQLWEIKVPPRALSFAWRLLWDRLPTKENLIRRQVVIENDLCTFCQSQVECASHLFFTYKKVMPTWWEFNSWVKEDRVMHCRPGDNFSQHFSLA

SEQ ID NO: 118538 - protein, 89 aa, Glycine max
  Coding DNA Sequence Number=SeqID_26853
MTIICLCAPSNTIASGWRKGSPPLDDNRAQNDHNLSLRAIGHDRAWTERRRMTIICLCAPSDTIAFGWRKGVWNDHNFSPHAIGLAASG

SEQ ID NO: 118539 - protein, 106 aa, Glycine max
  Coding DNA Sequence Number=SeqID_26854
  Gene Ontology: Mol. function=nucleoside-triphosphatase activity; Cellular component=chloroplast
  Homolog annotation: Hit_ID=Q2PMM5; Match level="QueryCoverage=68%, HitCoverage=3%, E-value=6e-29, Identity=90%"; Hit description =Protein ycf2
SFRDKRIIYDEEDELQENDSEFLQGGTMQYQTRDRSSKEQGFFRISQFIWDPADPLFFDLFPKDHAFVSGIYHLEKKMSHTNGFGSTTMGSMYEINSSLPNEAFFR

SEQ ID NO: 118540 - protein, 97 aa, Glycine max
  Coding DNA Sequence Number=SeqID_26855
MGKLDHLEERLRAIEGGEDYAFANLEELFLIPKHGHSQVQGAGLWQVQGDYSLQEPSKDCQYNSDMAPDRMQLQKCAKGGTNLSKNTPKDGETWQLK

SEQ ID NO: 118541 - protein, 105 aa, Glycine max
  Coding DNA Sequence Number=SeqID_26856
  Subcellular localization annotation: CTP_CleavageSite=54; ConfidenceScore=5.77e-01
MATPPSSPPPSPPHPPTGAASQSPSTLKSTRNATRLRSLATRLVGTERPLVHVDPATGKADGPHNKKLRTYLGIVTRDKVDVTYKNKKQVPDAQKDLIWEDIQVL

SEQ ID NO: 118542 - protein, 140 aa, Glycine max
  Coding DNA Sequence Number=SeqID_26857
MSDQEEVQEQMKADMSALKEHMASMMDAMLGIRQLMENNVATAAAVSSATKADPTLPATVHHPIPNVSYVTTWVMSLHPSLKGSLLDSWTRSTRIVESMLRETSIPTPHSPLRDRHPTRYLSATSRKNRETAQHNQYFCP

SEQ ID NO: 118543 - protein, 220 aa, Glycine max
  Coding DNA Sequence Number=SeqID_26858
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=99%, HitCoverage=45%, E-value=3e-44, Identity=71%"; Hit description=ATP synthase subunit alpha
  Pfam annotation: Domain name=ATP-synt_ab; Domain location=2-184; Score=21.2; E_value=1.8e-09; Accession=PF00006.16; Description=ATP synthase alphabeta family, nucleotide-binding domain
MCLCSYGQKASLCSSGEYLTRKRSNGIHYVVAETADSPATLQYLAPYTGAALAEYFMYRERHTLIIYDDLSKQAQAYRQMSLLLRRPPGREAYPGDVFYLHSLSYWRVINALKPIDGRGEISASESRLIESPAPGIISRRSVYEPLQTGLIAIDSMIPIGRGQRELIIGDRQTGKTAVATDTILNQQGQNVICVYVAIGQKASLWLKCDTLQKEEHEYTM

SEQ ID NO: 118544 - protein, 76 aa, Glycine max
  Coding DNA Sequence Number=SeqID_26859
MAPKKLSTKRSRRDAAAEGTSAAPEFDSHHFRSAEHQQRFEAIKGWSFHRERHVQLRDDEYTDFQEEIACRHWTSL

SEQ ID NO: 118545 - protein, 176 aa, Glycine max
  Coding DNA Sequence Number=SeqID_26860
  Gene Ontology: Mol. function=protein dimerization activity; Biological process=DNA integration
  Homolog annotation: Hit_ID=A3BRV8; Match level="QueryCoverage=88%, HitCoverage=26%, E-value=8e-24, Identity=39%"; Hit description =Putative uncharacterized protein
MSCITEMFASSEYQDDHAPLWSFVTIKEKIGDGGECGSGIATCPKVTNAYLVDLRRVCEETENRLKSKNVPLPTDKRTPTSPTLPPKRRKSSNIESAFNIEDRNHLRAEIARMFYSAGLSFHLARNPHFVSSYSFATNCNLSGFLPPSYNALRTSLLQQERSHIERCFNLSNLCGV

SEQ ID NO: 118546 - protein, 121 aa, Glycine max
  Coding DNA Sequence Number=SeqID_26861
MPFIIQEQQAEWINTHRRILLPLSFRNSKLGGKRAETNSAPFIIQEQQVGWNSKLSDKRAETDFAPFVIRGQLDRVQQHVETNYGHSASCMNQEEQIRQYQDDVPLAAEVHWLNGVSLERN

SEQ ID NO: 118547 - protein, 80 aa, Glycine max
  Coding DNA Sequence Number=SeqID_26862
MVEEQNNKTTLTSDEDIPVKGLLEKRDGCGKKEVLLEEASKFLRIIQQSEFKVIEQLNKTLARISLLELLMSSEPHRALL

SEQ ID NO: 118548 - protein, 1130 aa, Glycine max
  Coding DNA Sequence Number=SeqID_26863
  Gene Ontology: Mol. function=ribonuclease activity; Cellular component=exosome (RNase complex); Biological process=rRNA processing
  Homolog annotation: Hit_ID=A7NV97; Match level="QueryCoverage=79%, HitCoverage=99%, E-value=0.0, Identity=59%"; Hit description =Chromosome chr18 scaffold_1, whole genome shotgun sequence
  Pfam annotation: Domain name=RNB; Domain location=522-876; Score =480.5; E_value=2.1e-141; Accession=PF00773.10; Description=RNB-like protein
MRATVEGSMTERFDDGEKEKKKKRRSNRRSKQNPPSSSASEVNEAQGVSPESGKIGTPTHASPSFGSSLKQVNVCSPNEQGLSKSSNVAFNSMPPMHINEQVEPGDLRIVPMYDGGIDSKSFSEPTGCRGSSVINKNKDSVPCGQIGLSGQKNYFSPHWSVEAVEKALEKGDIFKALLHVNAHNRLEAYCKIDGMSTDVFIGGIPAQNRAVQGDIVAVKFDPLPLWTKMKGPNGSCNNTATLEGCNLLTEDKEVGGNICNGKAKVGAEYESAHCRSYPGQNKEDADQNSSYRSYPLPEKTMVYDDITSQGSTNHLDLHGMASHDSINGHHCAAPDSIKNNSCSGQSNALEKMCLLVNSFPSKRPTGRVVAIMERSPRREGIVGHINVKQWVSFRDTGKKDLKKNKNLISEHEYIQLTPTDPKFPNMMLLVRKLPNCIKKRMKSGDVTIEMDLVAAQIDDWVEESPFPEAHILRVFGRGGEVQTQLDAILFQNAICLSEFLPEALSCLPCVPWEVPLKEIQSRIDLRNLCIFTIDPSTATDLDDALSIEELPNGNYRVGVHIADVSYFVLPDTPLDSEAQFRSTSVYMLQRKLPMLPALLSENIGSLSPGGDRLAVSMLLDINLAGDVVDRWIGRTVIHSCCKLSYEHAQDIIDKAFDFEGSNFSEDGYPRVYGHFEWPDVIKSLKSLYEISNVLKQKRFTDGALRLENPKVVILFDENGVPYDSMLSERKESNFLVEEYMLLANRIAAEVICRAYPDGALLRRHPEPNMRKLREFMAFCQKHGLELNTSSSGQFHWSLEQIREKLKGDPVLYNILISFATRPMQLASYFCSGDLKDSENEWGHYALAVPFYTHFTSPLRRYPDIIVHRTLLATIEAEELYMKHQKALQGYKEVKVQKRCFTDISFDKIAAESMEGREALSAAAVKHSVPCAETLADIAAYCNERKLASRNVKDACDKLYIWFLLKKKEVLLSEARILGLGPRFMSIYIQKLAIERRIYYDEVEGLTVEWLETTSTLVLSMSTSKCAFRRGCPNKWRAFEEVALLTCPYNLDFTMDNSNQSEVMKVDDSITAMDREEPISRSDLSETEIDPAFFPLTVCLLSTIPVALHAVGGDDGPLDIGVRLYMSSYFR

SEQ ID NO: 118549 - protein, 31 aa, Glycine max
  Coding DNA Sequence Number=SeqID_26864
MGEEVAAQLAQASWDASSRSYGNFTEALRAS

SEQ ID NO: 118550 - protein, 118 aa, Glycine max
  Coding DNA Sequence Number=SeqID_26865
  Gene Ontology: Mol. function=protein histidine kinase activity; Cellular component=integral to membrane; Biological process=two -component signal transduction system (phosphorelay)
  Homolog annotation: Hit_ID=A4WBA6; Match level="QueryCoverage=77%, HitCoverage=15%, E-value=9e-36, Identity=84%"; Hit description =Integral membrane sensor signal transduction histidine kinase precursor
  Subcellular localization annotation: CTP_CleavageSite=14; ConfidenceScore=5.21e-01
MGILQGMHQNSAIPASRPRQEPGNSMLKRCLSPLTLVNQLALIVLLSTALGVTGMAISGWLVQGVQGNAHAINEAGSLRMQSYRLLASVPLTQDDQPLIDEMERTAFSPELENAAIRA

SEQ ID NO: 118551 - protein, 180 aa, Glycine max
  Coding DNA Sequence Number=SeqID_26866
RALKAILHSHPFSEPHEFHCLALFMCPPLSSAKPLVTGKYVLLLFFGSKKKEGVETRVVITERAGRTKSVSYLSFPLISDESPETCQKSKGSRLARSVKFRNVAEIEKRFFLQKAVASGGSNLARLGELGGKLLPYFAINRGRSEGRRGSAFLALLILSKLLRKIIFVKKIQAKALPLQR

SEQ ID NO: 118552 - protein, 103 aa, Glycine max
  Coding DNA Sequence Number=SeqID_26867
  Homolog annotation: Hit_ID=Q51617; Match level="QueryCoverage=36%, HitCoverage=59%, E-value=8e-10, Identity=82%"; Hit description =Putative uncharacterized protein
MTVKTSDTCSSRRRSQLVCKRMPGADKPVRAASAGVWAGCSGAGFKLCGIRADCTESAPYAAAQLLGRAIGAGLFAITPAGERGMCCKAIKLGNARVFPVTTL

SEQ ID NO: 118553 - protein, 151 aa, Glycine max
  Coding DNA Sequence Number=SeqID_26868
MAPTRHPLDPDKSNRALGFPTLITGLCQSFGVPVAPTKAGQAGSFDTKRYLRHLVRQQAANHRAHVQTHDCLYQLSLSMQSQGFASFSCPTPDQFRAEVAWPGDWPEAQAGEAPPEAPGDEEEAHEDEEMADLLDFLGGSGSYMTGRSPDS

SEQ ID NO: 118554 - protein, 94 aa, Glycine max
  Coding DNA Sequence Number=SeqID_26869
  Subcellular localization annotation: CTP_CleavageSite=41; ConfidenceScore=5.07e-01
MSFMCLNSVSISMIHLMWSNWMTCKVFGTCFGPRSYVGCCVCSWGAKCTGLPWSLALALGHVHTLDVVYVRGGRSALAFQGLWHLLWATFIHRM

SEQ ID NO: 118555 - protein, 108 aa, Glycine max
  Coding DNA Sequence Number=SeqID_26870
INSVNSVYTRESVRATASPDDESERSIIPPTRELGGSSVSPTGESGGATISFDDASEMIIRGGDGGTTSSSREGGGFTTRDRHSVGIGSTRVGAGSEEATSLGLTNRS

SEQ ID NO: 118556 - protein, 73 aa, Glycine max
  Coding DNA Sequence Number=SeqID_26871
AKFWKCKKYSWAKRASTAKRSFIALSAKENLADHQHQVSSARLSARLALSPNPLTRAKREGGAKCNVANLEPI

SEQ ID NO: 118557 - protein, 55 aa, Glycine max
  Coding DNA Sequence Number=SeqID_26872
MVQDKSYPKFGGVKSVRMQRKKRASAKRNTPGLSARKNPEEDELYRFAKHTASSL

SEQ ID NO: 118558 - protein, 183 aa, Glycine max
  Coding DNA Sequence Number=SeqID_26873
MSPDFMGHDDRRYKRQCQSLRVNGLVCPCLTKGAEYAGDDVSLCASTGSFAPWLTKGVGNHKRKNVYTDNHLGIFRQPPNFTGIVYAENYLCISARYLTSRVSMTDNAEDDVNLRVSTGSLAAIDKGNCLCGELLVYLRTSPDFTGWDNRKHEASLPEDADISGKGADDHIGLCLSIRLGVFE

SEQ ID NO: 118559 - protein, 66 aa, Glycine max
  Coding DNA Sequence Number=SeqID_26874
MGAKYLEVVKRGSHPNNGWSPDEIRTQNDHNLSLCFVGHDRLWMAKKVCRNDHNSSPATSQLVIFE

SEQ ID NO: 118560 - protein, 82 aa, Glycine max
  Coding DNA Sequence Number=SeqID_26875
  Homolog annotation: Hit_ID=UPI0000ECBAF8; Match level="QueryCoverage =50%, HitCoverage=48%, E-value=1e-16, Identity=100%"; Hit description= UPI0000ECBAF8 related cluster
LKAAFADAVLGDNRAGTGGSGAGASVSSGGMQAWHWPSFYNVVTGKTLALPNLIALQHIPLSPAGVIAKRPAPIALPNSCAA

SEQ ID NO: 118561 - protein, 138 aa, Glycine max
  Coding DNA Sequence Number=SeqID_26876
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLTGTELEFVIMVIAVSFGKPVVPAALMNRPTRGERRFAYWALFRFLAH

SEQ ID NO: 118562 - protein, 204 aa, Glycine max
  Coding DNA Sequence Number=SeqID_26877
  Homolog annotation: Hit_ID=A7Q794; Match level="QueryCoverage=87%, HitCoverage=87%, E-value=4e-12, Identity=29%"; Hit description =Chromosome chr18 scaffold_59, whole genome shotgun sequence
MCLIVRQGHYIENGQVVVRRTYIIPQEDPEIAKFRDQGLKFLPEMEFLFKGTIATNFAAYAPSKDSRQYEGFNTRTKETNDSIDDNTDMEVNEPEIDTTTQNTSLAKENGRRKRGREGDKRTGVAAKLSSQLDRIIQTFESSVSAPDPTSITACVAKLKDLPGLEHGSELFYKTTKLMKKRANRITFVALEEPELQLGWIKSKT

SEQ ID NO: 118563 - protein, 85 aa, Glycine max
  Coding DNA Sequence Number=SeqID_26878
MQIMVRTRDLGRALGRAIGKALGRIDGSDDDAPSSEGGLRIGRSSASSLTDSLRSVVRLRRAVSAHSKAVIRLSTESGDNAGKNM

SEQ ID NO: 118564 - protein, 109 aa, Glycine max
  Coding DNA Sequence Number=SeqID_26879
MDFTFLGSTSIPFWLTMKPSNFPDLTPKVHLAGFNLNLIFPKPFEQLLQVDKVFLFGLKLGNYVIHIDLDFTMHHIVEQSHHSPLISYPGVLESKGHHLITERPPQGDE

SEQ ID NO: 118565 - protein, 104 aa, Glycine max
  Coding DNA Sequence Number=SeqID_26880
MLESFKQQDQMSVLELYIEKDVAGGSMFHSANSLTSCGNYLSNDETQPATNLSNLHIDEDNDDDVSNSYVEESLDEDDSLDGISDTDDEVTDIPQPVKIVHPAE

SEQ ID NO: 118566 - protein, 76 aa, Glycine max
  Coding DNA Sequence Number=SeqID_26881
MPYTDLSPYLLNNTMAVISPAKISQPPFPRGYNPNVTCAYHEGVSRQSIEHCMTLKHKVQSLIDVGWLRFEEENCS

SEQ ID NO: 118567 - protein, 346 aa, Glycine max
  Coding DNA Sequence Number=SeqID_26882
  Homolog annotation: Hit_ID=Q84VH5; Match level="QueryCoverage=100%, HitCoverage=52%, E-value=1e-137, Identity=73%"; Hit description =Envelope-like protein
MDKKIRSIVSNILKNASVPDADEDVPTSSTPDVTVPEKDVPTSSTPNTEVLSSPSKEESTEEEDQATQETPAPRAPEPAPGDLIDLEEVESDEEPIANNRKGKTPIKRSGRIKTMAQKKSTPITPTSSRRSKVAIPSKKRKEISSSDSDDDVELDVSTSKRAKTSGKKVPGNVPDAPLDNISFHSIGNAERWKFVYQRRLALERELGRAALDCKEIMDLIKAAGLLKTVTKLGDCYESLVREFIVNIPSDITNRKSDEYQRVFVRGKCVRFSPAVINKYLDRPTDGVVDITVSEHQIAKEITAKQIQHWPKKGKLSAGKLSVKYAILHRIGAANWVPTNHTSTVAT

SEQ ID NO: 118568 - protein, 141 aa, Glycine max
  Coding DNA Sequence Number=SeqID_26883
  Homolog annotation: Hit_ID=A5BP71; Match level="QueryCoverage=53%, HitCoverage=19%, E-value=2e-10, Identity=46%"; Hit description =Putative uncharacterized protein
MKGKYIVQSLLKNFEKIKNKLVRTSFACMTSTPQACGYVSLNYYQYIDVVYTNEHIVKAYSAQWWPLGNEAVIPPSNDAWTLIPDPTTIRAKGRPKSTRIRNEMDWVEPSEHRQKYSRCGAEGHNRRHCPMQSERGSCSTH

SEQ ID NO: 118569 - protein, 113 aa, Glycine max
  Coding DNA Sequence Number=SeqID_26884
  Gene Ontology: Mol. function=nucleoside transmembrane transporter activity; Cellular component=integral to membrane; Biological process=nucleoside transport
  Homolog annotation: Hit_ID=P76417; Match level="QueryCoverage=100%, HitCoverage=26%, E-value=9e-49, Identity=83%"; Hit description =Putative nucleoside transporter yegT
  Pfam annotation: Domain name=Nuc_H_symport; Domain location=1-113; Score=-157.5; E_value=7.6e-05; Accession=PF03825.7; Description =Nucleoside H+ symporter
MMFVEWFIWGAWFVPLWLWLSKSGFTAGEIGWSYACTAIAAILSPILVGSLTDRFFAAQKVLSVLMFAGAILMYFAAQQTQFSTFFPLLLVYSLTYMPTIALTNSIAFANVDD

SEQ ID NO: 118570 - protein, 54 aa, Glycine max
  Coding DNA Sequence Number=SeqID_26885
MKKSKPRHFRNAPRRFRERFREDSSPFFIVLRSFFIVLRSSTGARETPLSTTKR

SEQ ID NO: 118571 - protein, 25 aa, Glycine max
  Coding DNA Sequence Number=SeqID_26886
MDKSLKEGEDEWRERERRSTKFLNY

SEQ ID NO: 118572 - protein, 194 aa, Glycine max
  Coding DNA Sequence Number=SeqID_26887
MNCDLAGGEHHKDNCYFYSINNFDRRQELVMYDYHEKERAPDLESILANFMTFQASSKGYCYSMQQQGTQFERNQSFESYQWESYRQPYYHNKAEGVLNLDDLLMQFKDTVKSMQQAFRRTETQISKLVDEMTNAAARKEEEHAEIEIHQESIHQVTSIHHQLTNEEEKPEVSSTPEYPYLATVGYVGGKDKVD

SEQ ID NO: 118573 - protein, 361 aa, Glycine max
  Coding DNA Sequence Number=SeqID_26888
  Gene Ontology: Mol. function=transporter activity; Cellular component= integral to membrane; Biological process=transport
  Homolog annotation: Hit_ID=A6X4F5; Match level="QueryCoverage=95%, HitCoverage=80%, E-value=1e-152, Identity=81%"; Hit description =Major facilitator superfamily MFS_1
  Pfam annotation: Domain name=MFS_1; Domain location=1-321; Score =109.5; E_value=1e-29; Accession=PF07690.7; Description=Major Facilitator Superfamily
  Pfam annotation: Domain name=Sugar_tr; Domain location=1-353; Score= -143.7; E_value=0.0023; Accession=PF00083.15; Description=Sugar (and other) transporter
  Pfam module annotation: Pfam domain module=MFS_1::Sugar_tr; Domain location=1-321::1-353
  Subcellular localization annotation: CTP_CleavageSite=32; ConfidenceScore=5.49e-01
MPLFAHDFNITPAASSLSLSVSTGFLAFAIFCAAAISERFGRRTLMFVSLLGSALCTIASAIVPDWHMLLAIRALQGLLLGGVPAVAMTYLAEEIDPRGLGASMGLYIAGNAFGGMAGRVIAGTLAEYFSWRVGLAGMGLLGLAASIGFLLLLPPSQNFIARPGFNARFHLGAWLGHIRNPALPLLFAIGFLVMGSFVTIYNYIGFRLVAAPYSLSQTALGAIFTVYLFGIAASWLAGRMGDRLGYFTVLPIGLAIQAAGCLLTLFAPLPVIVAGIILVTVGFFVSHSVASALVGRLALQTKGHASSLYLLAYYLGSSVAGAAGGYFWTANGWSAVAEFTFVMLALAFAAALGAARLSRRK

SEQ ID NO: 118574 - protein, 254 aa, Glycine max
  Coding DNA Sequence Number=SeqID_26889
  Homolog annotation: Hit_ID=Q2HW90; Match level="QueryCoverage=73%, HitCoverage=37%, E-value=2e-23, Identity=32%"; Hit description =Putative uncharacterized protein
MVSIWDLARVEVSVEPIASLAQYYDQPLRCFIFGDFQLSPMVEEFEEILGCPLRGRKPYLFSGFYPSLARISKKVQISAQELDRQRQVKNGVVGIPRQYLEVKARILADKGEWTPFIDILTLLIFEGVLFPNVDGLVDLEAIDVFLAYHNHKESPVVAMLADLYDTFDRRCEESNARIVCCTPALYVWLVSHLFLQEGRPVYPLQSHRSYVEKGKGNWDQLLASMEGRLLIGSLARRKEESGFYLHAKDFQMFP

SEQ ID NO: 118575 - protein, 226 aa, Glycine max
  Coding DNA Sequence Number=SeqID_26890
KLDALVNLVTQLALNQKSVPVARVCGLCSSADHHTDLCPSMQQPGAIEQPEAYAANIYNRPPQPQQQNQPQQNNYDLSSNRYNPGWRNHPNLRWSSPQQQQQQPVPSFQNVAGPSRPYIPPPIQQQQQPQKQPTVEAPPQPSLEELVRQMTMQNMQFQQETRASIQSLTNQMGQLATQLNQQHVKGPQPVAPSSSANEPAKLHSTPEKGDDKNLPNNFCAGDLLPQ

SEQ ID NO: 118576 - protein, 166 aa, Glycine max
  Coding DNA Sequence Number=SeqID_26891
  Gene Ontology: Mol. function=oxidoreductase activity, acting on single donors with incorporation of molecular oxygen, incorporation of two atoms of oxygen
  Homolog annotation: Hit_ID=A1FWR0; Match level="QueryCoverage=100%, HitCoverage=100%, E-value=1e-56, Identity=82%"; Hit description =Glyoxalase/bleomycin resistance protein/dioxygenase
  Pfam annotation: Domain name=Glyoxalase; Domain location=34-159; Score=33.2; E_value=9.7e-07; Accession=PF00903.16; Description =GlyoxalaseBleomycin resistance proteinDioxygenase superfamily
MERPDSSEHPAKDRQVASSSTAVMSFIGFFQCGGAFHITVGTNDLDTAAIFYDALLTPLGMRRRPVTPDGGPAAACWVTAHVALPRFYVYAPYDREPASHGNGSMVAFLAPSADAVDAAHAAGLAAGGTDEGAPGLRPHYGAGYYGAYLRDPDGNKCHIVHRGDLA

SEQ ID NO: 118577 - protein, 122 aa, Glycine max
  Coding DNA Sequence Number=SeqID_26892
MSLPSAVHVSSTFEYGAPRMSLPSAVRQFSILHIFSETHECHCLALFMHPPPKEFGAMLHDFLVAVHVSSTFEYGAPRMSLPSAVRQFSILHIFSETHECHCLALFMHPPPKEFGAMLHDCL

SEQ ID NO: 118578 - protein, 52 aa, Glycine max
  Coding DNA Sequence Number=SeqID_26893
MIMRGQDIYSSQDEGTTSPSSSESEEILVSTVTPLRLDIIPQVKELLDEGLE

SEQ ID NO: 118579 - protein, 162 aa, Glycine max
  Coding DNA Sequence Number=SeqID_26894
MTEREMITIMVDTLPMFYYEKLIGYMPATFADIVFAGERIESGLRKGKFEYASNVAPNNNRRAPVVGARKKEGDTHTVTTAPTSLPTQVKGPPAAERTSAQRTAPATPRPTLHLPIAASGLYGLSWRRRKGRMFVSPRGVTRHGNLSRGGRIASAAHGLGAA

SEQ ID NO: 118580 - protein, 170 aa, Glycine max
  Coding DNA Sequence Number=SeqID_26895
MFDDGGAVTTIDGPRPLADKESPAKPKPLVIHFTRDVASQKPQGSQPISGRKPVPFLYQSDKAILWRYTPQKPSKKKKEATSIDLLFAKITNITDLSGVTRSSCLFIAPNPSGRPTDAKGKAKVVTKETSEASRTLEEDVPAERFAEKGGDFSGKKVSMEEANEFFRIIQ

SEQ ID NO: 118581 - protein, 205 aa, Glycine max
  Coding DNA Sequence Number=SeqID_26896
MDRARLFYGLVMKMDMDVGFLISHQISQMAQSNSSRLGFPALIFALCVVRGVVSGSLTFESLSLAINLAYIKKNYWNLDDPTIEFPGTRKARARAPSATPVSFAPAPSPAPAPSTSAPPLYPSMHDSAQHRPFISMDEFMPQVAWPGVQPSPLGGGEASVAQEPQPEPEVAHEATLEAAQSTWDPWPTAALETPQPAQDTPSSPY

SEQ ID NO: 118582 - protein, 160 aa, Glycine max
  Coding DNA Sequence Number=SeqID_26897
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=95%, HitCoverage=16%, E-value=1e-08, Identity=31%"; Hit description =Gag/pol polyprotein, 3'-partial, putative
  Pfam annotation: Domain name=G-patch; Domain location=26-70; Score =23.1; E_value=0.00031; Accession=PF01585.14; Description=G-patch domain
MAFQSFEVVSIASIDSLSGQPRLSDTAMMVAQVMLGYGYEPGMGLGRKNGGKTSLVSTRGNRGKFGLGYRPTQADIRKSIMEKKNKGQGSRLGQQTEGAPPYHISRTFISEGLRHEGQVAAICEDDPPRGSVLVRPCPPGFRLGNWRVEERPNVYATSIM

SEQ ID NO: 118583 - protein, 322 aa, Glycine max
  Coding DNA Sequence Number=SeqID_26898
  Gene Ontology: Mol. function=transcription factor activity; Cellular component=intracellular; Biological process=regulation of transcription, DNA-dependent
  Homolog annotation: Hit_ID=A9CI57; Match level="QueryCoverage=64%, HitCoverage=65%, E-value=1e-107, Identity=95%"; Hit description =Transcriptional regulator
  Pfam annotation: Domain name=GAF; Domain location=3-108; Score=15.6; E_value=0.024; Accession=PF01590.17; Description=GAF domain
  Pfam annotation: Domain name=HTH_8; Domain location=183-223; Score =11.2; E_value=0.029; Accession=PF02954.10; Description=Bacterial regulatory protein, Fis family
  Pfam module annotation: Pfam domain module=GAF::HTH_8; Domain location=3-108::183-223
GVALERRGAAGDDREFRALGLWSGAVWSEASVGTNGIGTALVDERSVVVYRDQHFFTSNTELCCTTAPIRDHTGRVTGALDISTCRDDINEMTFSFVTQAVKDAAQRIEGNLFRRAFPGARIVVVPNGFGAAISLLAVDQDDLVLGATRAARLALKLDDTLIAQGLPAADILQEQRHDSGSDLAEAERSALRRVLSRTNGNVTQAARLRSGRSRRINAALSQMIVFIREDEIMNIQVQQKAGEAPFKLKYGNYIGGKWVEPKSGRYMDNLSPVTGHKICEVPRSDAADIEFALDAAHKARDKWGKTSITERSNILLKIAQRI

SEQ ID NO: 118584 - protein, 65 aa, Glycine max
  Coding DNA Sequence Number=SeqID_26899
MDLFRSWRGSIIMPIGWTSQESGADIEEEEPTDLRSNPLQGGGDDAILPRKGPVTRAMSKRLQED

SEQ ID NO: 118585 - protein, 158 aa, Glycine max
  Coding DNA Sequence Number=SeqID_26900
MALARKSGSESQRPFVGENKLMEEKKKKQLEEVTKSGSTDTVIDPPSPIRRHMKWKMAHTKKTGQMTFEVAKKIANKIDSLKEQTSQGSFVTHGRRDVLTAAIGQMQSQFQLQMQSQRLALPPKPKVGPSATRVSTKESCVDPLGNDPDTGDSREMRV

SEQ ID NO: 118586 - protein, 286 aa, Glycine max
  Coding DNA Sequence Number=SeqID_26901
  Homolog annotation: Hit_ID=Q53L20; Match level="QueryCoverage=54%, HitCoverage=22%, E-value=3e-09, Identity=26%"; Hit description =Transposon protein, putative, CACTA, En/Spm sub-class
PPRPERPVVHVDPATGKVDGPHKKKLKTYVGIVARDKVDVTYETWKEVPTAQKDLIWEDIQAEFDVPEASDTLAAYKDNVDDTICEKYGPPSPIRQHVKWKMARTKKTRQMMSEAANKNAEKIASQGSFVPHGREDVLTAAIGRPEHPGHVRVAGVGVTIKQYFGSATWTSHTSSSMTPEELKQLTQQIRDQLEESITKKPKVGPSAARVSTKGSCVDPSPTDHDTGDSDKCGLYIEENPSRLVALGRIYEGSIAVHNIPLLHGQVKVGVEEVKDAEALVPVPTDE

SEQ ID NO: 118587 - protein, 233 aa, Glycine max
  Coding DNA Sequence Number=SeqID_26902
CQFARIGAIDGSTPTLWKDQPLRCFTCRDFQLIPTVEEFEEILGCPLRGRKPDHFSGFYPSMAKYDPEIVMEFYANARPTEEGVRDKRSWVRGQWIPFDEDVINQFQGHPLVLEEGQRCEFSQRKSLALGFNEEAISQLLSILGQDSARSVAGRQVRIMRTSMTTLTQIWMIPPPAEVSTGLRHSDLGITPPRHPVDPERSSRALGFPALIRGLCQFYGVPVNPTKCGSNVFQ

SEQ ID NO: 118588 - protein, 273 aa, Glycine max
  Coding DNA Sequence Number=SeqID_26903
  Gene Ontology: Mol. function=iron ion binding; Cellular component =integral to membrane; Biological process=peptidoglycan biosynthetic process
  Homolog annotation: Hit_ID=A6T4N2; Match level="QueryCoverage=94%, HitCoverage=60%, E-value=1e-121, Identity=86%"; Hit description=Cell division; membrane protein involved in shape determination
  Pfam annotation: Domain name=FTSW_RODA_SPOVE; Domain location=1-262; Score=326.3; E_value=5.6e-95; Accession=PF01098.10; Description=Cell cycle protein
MEFWQRHSTAMLIASIVMLLIVLVVGSSVNGASRWIALGPLRIQPAEFTKLSLFCYIANYLVRKADEVRNNLRGFLKPMGVIFVLAILLLAQPDLGTVVVLFVTTLAMLFLAGAKLWQFIAIIGMGISAVVLLILAEPYRIRRVTSFWNPWEDPFGSGYQLTQSLMAFGRGEMWGQGLGNSVQKLEYLPEAHTDFIFAIIGEELGYIGVVLALLMVFFVAFRAMSIGRKALEIDHRFSGFLACAIGVWFSFQALVTSGRRRDAADQRSDPAID

SEQ ID NO: 118589 - protein, 124 aa, Glycine max
  Coding DNA Sequence Number=SeqID_26904
  Homolog annotation: Hit_ID=Q84VH5; Match level="QueryCoverage=62%, HitCoverage=11%, E-value=5e-34, Identity=97%"; Hit description =Envelope-like protein
MKRESPLSLHYKLFEGTHVPDIVSTSGKAADSGAVSKDALIAELKDTCKVLEATIKATTEKKMELERLIKRLSESGIDDGEAAEQEDEAAEEEVEAAEEEEEAAEEEEDAAEDTESDDDSEATP

SEQ ID NO: 118590 - protein, 99 aa, Glycine max
  Coding DNA Sequence Number=SeqID_26905
MVFRWEYGFECICLFLFCFCLVRGEKVASAQDFVGNQRERTTSGRGQGLTFSPWVKVYDNLGFWLKACRMAGHDICQSLASGSGIKGMSYIISMIHMQQ

SEQ ID NO: 118591 - protein, 58 aa, Glycine max
  Coding DNA Sequence Number=SeqID_26906
MPKTKRKHCYAIREGGANSIQATWAFQDVPPEGGCFWTKQPSSPGRAGWQAPPPFSYK

SEQ ID NO: 118592 - protein, 116 aa, Glycine max
  Coding DNA Sequence Number=SeqID_26907
MTFPSTLKRTRKATRLRSLATRPVGEERPLVHMDLAMGKADGPHRKKLRTYLGIVSRDKVDVTYENWKQVSTTQKDLIWEDIQPTRTVSMILFVKSTTLARKSGPDFIKAVETLRG

SEQ ID NO: 118593 - protein, 86 aa, Glycine max
  Coding DNA Sequence Number=SeqID_26908
MQNFAVKIGAAGFWLVQKNACVWLAVERVVQNEFWMFASRSQRSQCRLMHYRLPLGRIDGDPVLRGTRIWATWEYVRSVGGGQQGM

SEQ ID NO: 118594 - protein, 135 aa, Glycine max
  Coding DNA Sequence Number=SeqID_26909
MGEVEEVQEQMKANMEVVKEQMATMMEAMMSMKKIMEANAVAVAATSTVAKVNPMPPSGLNQMNHPNSDMVGKDLGSTGGPHEVQIQNEHAFPPYDLPLNYTPPNVAYTPNKNVNNSTPIPIESQQPQTDHAHVS

SEQ ID NO: 118595 - protein, 75 aa, Glycine max
  Coding DNA Sequence Number=SeqID_26910
  Subcellular localization annotation: CTP_CleavageSite=42; ConfidenceScore=5.37e-01
MTKDNDCTYHLQRTVRPHLMRATRPRLQRDTRPHRQRTTSPRLQRTSRPHLQRDTRLRLRRTRRPQIQRTARPRL

SEQ ID NO: 118596 - protein, 210 aa, Glycine max
  Coding DNA Sequence Number=SeqID_26911
MGDQEETQEQMKADMSALKEQMASMMEAMLGMKQLMEKSAATAAAVSSAAEADPTLLATTHHPPSNIVGRGRDTLGHDGSPHLGYNRAAYPYGLPPNYSPPILQEDAGHIASPVHEKEPPQQPDEVHKNPQDYARRDVEFYPPIPEGPAPGTLPQPNLAASPIVLSMEGPSPATEERRKLDLLEERLRAVERFGDYPFADMTDLCLVPDV

SEQ ID NO: 118597 - protein, 118 aa, Glycine max
  Coding DNA Sequence Number=SeqID_26912
MGPNSSLLRGKSFIRLISMNYCRNLPFGGRAMRGSWVRLPREENAWSRHQCLFEEKVGKTETCGLRTLSVKGSGVIFTHGEGCFPHFYVSSIAVRKSDLHSSFRTKCWLSCFYPFSQD

SEQ ID NO: 118598 - protein, 149 aa, Glycine max
  Coding DNA Sequence Number=SeqID_26913
MARTKKTGEMTTEAAKEIAEKIESFEEQATQGSFIPHGQHPGRVRAAGAGVTIKQYFGSTPRTSRSASSLPPDELQQMVQQIRDQLEESIIEKVTTQVMTSFSHIQSQLQSQMQSQGLAVPPKPLVGPFGPRVSTKGSCVDPLGSDPET

SEQ ID NO: 118599 - protein, 176 aa, Glycine max
  Coding DNA Sequence Number=SeqID_26914
MKGITGAPYRARCDGLTVTDVSWLPYTEHRGGQFRWGPMVVTVRPERVVRQFGYIQSIPPPPVSVDYMEWFFRISHPFMTPTQAGDQQKDAPVADPKDYIQPPRPQVPVAFDPPPHVDDYEGYEAIALRLERVLNLRIVTAGTELYDIMQDCLTIARGGPSADGTVRARQRRRTDH

SEQ ID NO: 118600 - protein, 100 aa, Glycine max
  Coding DNA Sequence Number=SeqID_26915
  Homolog annotation: Hit_ID=Q0T7R0; Match level="QueryCoverage=100%, HitCoverage=24%, E-value=5e-49, Identity=89%"; Hit description =Esterase frsA
MTQANLTETLFKPRFKHPETSTLVRRFNPGIQPAVQSALDGKNVPHWYRMINRLMWIWRGIDPREILDVQARIVMSESERTDSELYDTVVGYRGGNWIYE

SEQ ID NO: 118601 - protein, 74 aa, Glycine max
  Coding DNA Sequence Number=SeqID_26916
MSARKDDRSSRCDEDKNKGKDPLEGLGGPLTRARARKAKEALQQVLSILFEYKPKFQGEKSKVVSCIMAQMEED

SEQ ID NO: 118602 - protein, 112 aa, Glycine max
  Coding DNA Sequence Number=SeqID_26917
KFGVEEFKDADAPVPVPTDEVNLVGADTLHLPCLADTSRKAFIRKGVVGPAKPADRLDHEVDDPLYLMTLTIPQLFLKPLQVMSDATMFGVFNPDFPLYIKHEDLSEIAHGG

SEQ ID NO: 118603 - protein, 330 aa, Glycine max
  Coding DNA Sequence Number=SeqID_26918
  Homolog annotation: Hit_ID=Q6WAY6; Match level="QueryCoverage=76%, HitCoverage=60%, E-value=1e-12, Identity=34%"; Hit description =Putative uncharacterized protein
MGTNQNGKRFYQVKVKSLDVTSLKELGRLMGPLQRQAFRKVYGKILDLAAAEVFTEAVVSLAQYYDQPLRCFTFGDFQMVPTIEEFEEILGCPLEGRKPYLFSGFLPSLSKIAAVVGDSAKELDRMKQTRGCLDTRQPCLLQSYRSCAEKGRVDWDQHLAGIGGSTINWFPRWKEGKEGVLFSCGDYPNVPLVGTRGCINYNPALAIRQLGYPMRGAPTEESLSPFLVRDLGVQGLKVIQRIHKAWRSPLRKDKELRGIRNGVIGGYHGWLRIHTRGLDWLSKLKVINEENFEAPEEDEEVRALKLELGKARLAKEKFKSAATHIRKECT

SEQ ID NO: 118604 - protein, 125 aa, Glycine max
  Coding DNA Sequence Number=SeqID_26919
  Homolog annotation: Hit_ID=A6FJQ2; Match level="QueryCoverage=30%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARSHPGGLLFTKFGSNQTALLDLAFPAFSATVTSLPCFLYLSG

SEQ ID NO: 118605 - protein, 188 aa, Glycine max
  Coding DNA Sequence Number=SeqID_26920
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=78%, HitCoverage=51%, E-value=3e-78, Identity=99%"; Hit description=Beta -lactamase TEM precursor
MAPDAVFSPYASVRPDTRQHPLTRPDGLVCSRHPLTDKLKSMSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELT

SEQ ID NO: 118606 - protein, 144 aa, Glycine max
  Coding DNA Sequence Number=SeqID_26921
ALAHGKEGEDDKVCEKYDISKEKWNQFCQNRRDPSWEAIQKQNTAPHVLSHGGYDFLEQKLMEEKKKKRLEEATQSRSTDIIVDPPSPIRRHMKWKMVCMKKSGQMMSEAASQLSFVVDGRQDVLTATIGRLEYPSRVLAAGVV

SEQ ID NO: 118607 - protein, 218 aa, Glycine max
  Coding DNA Sequence Number=SeqID_26922
  Subcellular localization annotation: CTP_CleavageSite=31; ConfidenceScore=5.11e-01
MTRVPSVRTIVEFPDTTLTPSSRSNIRTNPLASHGGASVNAVEEDGPSRAKRLGEVATSRRFIYQSLQAACMVSRGGGERDECLFHLGESHDMETCPAVEELLQRLMDWGQLEVSIGGREEPQICMQSEEKKVPLTPKALVICFTRKGTGSTPIYPRAAPKPTPFAYQSNKVVLWKYTPPTSSERVATEIDSLSAKVTNIIGSICSAIPRGLFPKWIP

SEQ ID NO: 118608 - protein, 60 aa, Glycine max
  Coding DNA Sequence Number=SeqID_26923
  Subcellular localization annotation: CTP_CleavageSite=21; ConfidenceScore=5.11e-01
MVLVVAIAAALTSIISFMLIMASIIVAICSFKASVSAFICSCTFSTSPITLALARVRTWG

SEQ ID NO: 118609 - protein, 129 aa, Glycine max
  Coding DNA Sequence Number=SeqID_26924
MAASDHTILRDQTHIPTKRSLLELSSQDALLAQNKLLSKKLETLTKTLNDTAQEVNYMENQPRPNFNAGEYSGFQHGQNYNQQQGQWRSHPGNQFNKDQGGPSNRPQQQGPSLYGRMTKLEETLAQFMQ

SEQ ID NO: 118610 - protein, 44 aa, Glycine max
  Coding DNA Sequence Number=SeqID_26925
MELASIFNFRFQSSFRAQNFVLFSSSPFVHLLLPPSFYPWPPMV

SEQ ID NO: 118611 - protein, 183 aa, Glycine max
  Coding DNA Sequence Number=SeqID_26926
  Subcellular localization annotation: CTP_CleavageSite=73; ConfidenceScore=5.53e-01
MARPPPSNQNNDLPNMEGQPTQTSVSNANVNSGIGAIPGQTVGTTSSTASTVMNQTGVTSPMTNMTLATSTTSASVFAPWNNPSLGNPSGSPFRPLQNPLYGMPTSLMAGLQNSQPNIENLNMSSPSGSVAGNQGRQPPIRQIQIQAPVQEIQMPNNPGMQMAQAPQPLARIEPPAQQVEPNP

SEQ ID NO: 118612 - protein, 156 aa, Glycine max
  Coding DNA Sequence Number=SeqID_26927
MARRDKNWSLCTLVSSRGGGPDDTRRYLTVIRALLSSRGGGPDDTRRHLTVIRTLVSSRGGGPDDTRRYLMAAGPMTRRDKIWSFCTLVSSRGGGPYDTRRYLTVICTLLSSRGGGPDDKQRPMWSFCTLVSIRWPTSPLTRGDLHHLPHLQDLSH

SEQ ID NO: 118613 - protein, 163 aa, Glycine max
  Coding DNA Sequence Number=SeqID_26928
  Homolog annotation: Hit_ID=Q6WAY4; Match level="QueryCoverage=82%, HitCoverage=24%, E-value=8e-12, Identity=33%"; Hit description =Putative uncharacterized protein
MGTNQNGKRFYQVKVKNLDVTSLKELGRLMGPLQRQAFRKVYGKILDLTAAEVFTEAVISLAQYYDQPSRCFTFGDFQMVPTIEEFEEILGCPLGGRKPYLFSRFLPSMSKIAVVVGDSARELDRMRQTRNGIVGLSRKYLEGKARDRASQEKWGPLAYLGIL

SEQ ID NO: 118614 - protein, 264 aa, Glycine max
  Coding DNA Sequence Number=SeqID_26929
  Subcellular localization annotation: CTP_CleavageSite=30; ConfidenceScore=5.36e-01
ARFLPAPAVPPALCVHLSRGSSAGAHRRVGAAVPRRRACRHRVGGHRPRGGGPGDRAGRHPPAPAPDGAAFHGGGAGAAGHRHDRGGAAALRRLRLQALRPGHRGLSGEDPRVRHQRVLARPQPPRAGQPVVAAGGGGAVRGLGDRRDLEPAAQGVGQPDLVGRVQVGQGQHAFADVAGIEQFGALHAGQAAAVDRWRVPVAIQAQVDVAAAAFAQLAAFVQVDQVEDVRMGRQPFDGLGVPRAGKWSCSATAARTNAAPRAPA

SEQ ID NO: 118615 - protein, 138 aa, Glycine max
  Coding DNA Sequence Number=SeqID_26930
MAPTRHPLEPDKSNRALGFLVLIMGLCQSYGVPVTSSKATGAPPPPWQVDPAGPLGVEHYLQHLVCQQAANHHGQGQGSSPFVCPTPEHYGADVTWPGDWPNAQAGEESAGSLGEAGESHMDEDMTDLLNFLGESGAT

SEQ ID NO: 118616 - protein, 88 aa, Glycine max
  Coding DNA Sequence Number=SeqID_26931
MMTIIVDTLPSFADLVFASERIDVGLKRGKFSHPAWTNEKTGANEEGKDEGEARAVTAIPIQPSFPPTQQCHYSANNKHPPYPPTSYL

SEQ ID NO: 118617 - protein, 86 aa, Glycine max
  Coding DNA Sequence Number=SeqID_26932
  Subcellular localization annotation: CTP_CleavageSite=15; ConfidenceScore=5.16e-01
MSCPFSSSTHHLQPSSSYPWLPMVVSFFLTHLLLEVTSSIIFLPSPFRSHDLQEAKDSIDEEDSRPTSSTWSYTMWYQEHLRSGIL

SEQ ID NO: 118618 - protein, 137 aa, Glycine max
  Coding DNA Sequence Number=SeqID_26933
MDSFASWKMNGSGMEKEEREEHHFKENMSLEEAHHHKRPWIRAWRKKEMNEGRGREKHEILYSKRALKSEVLSQRALRGRARARLTGALSKGGKMRGVVTNEGISTSHVDKSGAFAPTYHPLERKSDLRSSFLCVNQ

SEQ ID NO: 118619 - protein, 889 aa, Glycine max
  Coding DNA Sequence Number=SeqID_26934
  Gene Ontology: Mol. function=binding
  Homolog annotation: Hit_ID=A7P3R0; Match level="QueryCoverage=53%, HitCoverage=91%, E-value=1e-169, Identity=65%"; Hit description =Chromosome chr1 scaffold_5, whole genome shotgun sequence
  Pfam annotation: Domain name=Arm; Domain location=126-172; Score =10.7; E_value=0.48; Accession=PF00514.14; Description=Armadillobeta -catenin-like repeat
  Pfam annotation: Domain name=Arm; Domain location=173-213; Score =13.6; E_value=0.2; Accession=PF00514.14; Description=Armadillobeta -catenin-like repeat
  Pfam annotation: Domain name=Arm; Domain location=214-257; Score =10.4; E_value=0.53; Accession=PF00514.14; Description=Armadillobeta -catenin-like repeat
  Pfam annotation: Domain name=Arm; Domain location=406-446; Score =38.0; E_value=3.3e-08; Accession=PF00514.14; Description =Armadillobeta-catenin-like repeat
  Pfam annotation: Domain name=Arm; Domain location=531-571; Score=3.9; E_value=3.5; Accession=PF00514.14; Description=Armadillobeta-catenin -like repeat
  Pfam annotation: Domain name=Arm; Domain location=809-849; Score =14.3; E_value=0.17; Accession=PF00514.14; Description=Armadillobeta -catenin-like repeat
  Pfam annotation: Domain name=Arm; Domain location=84-125; Score=22.4; E_value=0.0016; Accession=PF00514.14; Description=Armadillobeta -catenin-like repeat
  Pfam annotation: Domain name=HEAT; Domain location=179-215; Score =17.0; E_value=0.071; Accession=PF02985.13; Description=HEAT repeat
  Pfam annotation: Domain name=HEAT; Domain location=412-448; Score =0.9; E_value=20; Accession=PF02985.13; Description=HEAT repeat
  Pfam annotation: Domain name=HEAT; Domain location=92-127; Score=3.1; E_value=9.3; Accession=PF02985.13; Description=HEAT repeat
  Pfam module annotation: Pfam domain module=Arm::Arm::Arm::Arm::Arm::Ar m::Arm::HEAT::HEAT::HEAT; Domain location=126-172::173-213::214 -257::406-446::531-571::809-849::84-125::179-215::412-448::92-127
MVMPVTAPSTPPLPCGTQNLDSHSDRFSDNLFRPWLCGIDAVTSTSSGLSDGYVALFVRMLGIDRDPLDREQAIVALWKYSLGGKKCIDTLMQFPGCINLVVNLLRSESNSACEAAAGLLRSLSSVNLYRNSVADSGAIEELNRLLRQSSLASEVWELVKEQSLSTLWNLSVDEKLCIKISKTEILPLAIRYLDDEDIKVKEASGGILANLASSRVNHNIMVEAGVIPKLAKFLTSNLEGSNVLRKVTRNALLELVKDKYYSILVIEEGLVPVPLIDAAAFKSFTPGIHLWPMLPDGTEIERTSRQPSRYGASELLLGLNIDDKNANLEEAKVNAIVGRTQQQFLARVGALEMEQKTMPHSECSNDQRFTLLPWMDGVARLVLILELEDRFAIIKAAESIATACINEHMRIAFREAGAIKHLVRLLNCDDNSVQLAATQALERLSVSNIVCRVIEAEGVLGPLVSILKCSEIAGTILEKSLNILARILDPSKVMQLKFYDGPVNGSEKAFGGTKGDCVSTGFSSTEQAVSKTYTRNDILDSVFIAHLVEIMKSSPPSLQEKAATVLEFVALTDPTLAPIIFLDIESGLNSAFQQKILKISGPTVPGGPFCSAALLRAKQFWFLYHCSISSFSREQYHELLQAFIGGCRALLSPKRPHPLSLHLPAKQLVSYSDMVNQADMESDVEDQFSEAYAIEFEEAGLAIAAASRLLTRLLDHEQFRHKINSSQFIDLLRGILRSCIPLHNKKWVATCLVKLSSLSGSITSLYPINVEVTLYETIPRLLEQIKTSFSPEAQETAVVELNRIISEGVVDYTEAIISDEAIYSLVNLIEEGSDRAVEASLAILYNLSMDSENHSALVAAGAVQVLKRSVLANRPHWERALLLLRILQP

SEQ ID NO: 118620 - protein, 101 aa, Glycine max
  Coding DNA Sequence Number=SeqID_26935
MGHLSDQGVPTDPKRIKVIPDWPTPPSVEGRSLEYEESRDLRSDPFQDGGDDAILPPRVLDRRLQEDWARIAKEGHGVLMNLRVDFLSPWAKVGSTFLCKY

SEQ ID NO: 118621 - protein, 244 aa, Glycine max
  Coding DNA Sequence Number=SeqID_26936
EELAPVISRGFSETNVETLQKVCKAWEVVQKKDKELRGSNNGPIGGYRKWLKAHVQGLDWLPSLRTAKREEVEAPEEDEEVQALRAEIEQAQTIKERFKSAALKIRKENAELRDINTTTARALEQETKRACREEHSRNKFRGALWGSNSELKLRREERDRSRVDNLILKDELKVCSRSKRNLSQRLCETETNMLAIISKYQAELNLAMAHEHKVVDEYAQVYASQELPRLLAKAKAMADTYSTA

SEQ ID NO: 118622 - protein, 166 aa, Glycine max
  Coding DNA Sequence Number=SeqID_26937
  Subcellular localization annotation: CTP_CleavageSite=56; ConfidenceScore=5.38e-01
LTTEGYRGIWGAASLVKYITKGLGFPRPPSSADCMHMCCSSSPSSSISSRPWSIIRCKRSSTAKHGLVDKPPGGRYVLQRLGPAWPTRHDDINCSPFMISERVRFHVGPVLLKCQPSGVYQMLDLLFKGQAAFGGVARGFPMVCAGLRQGYATLGKEAGRSSREIS

SEQ ID NO: 118623 - protein, 92 aa, Glycine max
  Coding DNA Sequence Number=SeqID_26938
MEIYVSDRLGKSVCVCFLISEVVIIKKGEIVEAKLHDDDKGDDKKLKGQSKNEFKIFKIESRTLQDSRGKLISRIKNQDSTDQDFKNQDSTD

SEQ ID NO: 118624 - protein, 142 aa, Glycine max
  Coding DNA Sequence Number=SeqID_26939
  Homolog annotation: Hit_ID=Q5CDC4; Match level="QueryCoverage=19%, HitCoverage=21%, E-value=1e-07, Identity=100%"; Hit description =LacOPZ-alpha peptide from pUC9
MASRKRKATASRPREPYDTTRFIFEGAWERYDQNVHSQNILPERNIILYISEYDEFRRELERHSWHKALTRQPDGHIGVALVKEFYANLYDPEDKSLRQVRVRGKLIKGTELEFVIMVIAVSCVKLLSAHNSTQHTSRKHKV

SEQ ID NO: 118625 - protein, 231 aa, Glycine max
  Coding DNA Sequence Number=SeqID_26940
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=64%, E-value=3e-32, Identity=100%"; Hit description=LacZ protein
NSYDHDYEFELGTHPREPLAWGGGGYHAPGQGDVDPTSYVRVYTVESDADVAGRTTSKRWVMSDRDRGREMHESSSGLVSSNGNSEKYYHGSENNMMGRYSRGNSRECGHTHEFDALLRRNRYRRRVLFLGFRRLGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 118626 - protein, 49 aa, Glycine max
  Coding DNA Sequence Number=SeqID_26941
AVNTITKHTFRHPYRTHSKTRVMGDIEEVQEQIKADIEALKDQVASVSA

SEQ ID NO: 118627 - protein, 76 aa, Glycine max
  Coding DNA Sequence Number=SeqID_26942
MRIKIHETQCGPPWVHRMNRKAWFEQNRGGACRPASPGELSSPRRARLLPPEATAFWRNILEGPSGPGCYLHPHFY

SEQ ID NO: 118628 - protein, 183 aa, Glycine max
  Coding DNA Sequence Number=SeqID_26943
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKRRPVPSLHACRSTLEDPPWNGATVKKFYELRRKLRAHIGHGLRTGIELYELEFPVVPQ

SEQ ID NO: 118629 - protein, 155 aa, Glycine max
  Coding DNA Sequence Number=SeqID_26944
  Homolog annotation: Hit_ID=B0HC01; Match level="QueryCoverage=21%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTHSLTSRCYNSHSFSRPLTLTLLAEPLVAEKEGIWMVLTETLEDGIL

SEQ ID NO: 118630 - protein, 48 aa, Glycine max
  Coding DNA Sequence Number=SeqID_26945
MVKVGTSYVPINVSFSPKVGPGLPAVPPVQLLTGWCVTAKAPPDISAG

SEQ ID NO: 118631 - protein, 158 aa, Glycine max
  Coding DNA Sequence Number=SeqID_26946
MRQHTKTGLLEEPSLYVLYRHVAGVIQRRSFLGPVIVSQIVSRLRHVLVTFSYFGAPYHFFAPFFDYLPLLWRPSYTDLLLRQRASSPTNSISCPLPVVPFAAAADKGPLLLLVVFIVVYIIVFKEDKWGLQSKDELRERPAAILHQWCHPVPHYQFR

SEQ ID NO: 118632 - protein, 309 aa, Glycine max
  Coding DNA Sequence Number=SeqID_26947
MAKFDPEIVLEFYANAWPTEEGVRDMRSWVRGQWIPFDADAISQLLGYPMVLEEGQECEYGQRRNRSDGFDEEAIAQLLCIPGQDFAWTAAGRRVRIMRTNMTTLTQIWMTLLLSNILPTDHNSDLPMPKCQLVHPLDPDKSNRALGFPALITGLCQSFKVPVAPTQGDSAAHHPGFYSRSTSPQRQAQGDAPQATGAPPPPHQAGPAGLFDMEQYLRHLVRQQAANHRAHVQTHDCLYQLSLSMQSHGFAFFSCPTPDQFRAEVAWPGDWPEAQAGEAPPEAPDDGEEAHEDEEMANLLDFLGGSGVT

SEQ ID NO: 118633 - protein, 179 aa, Glycine max
  Coding DNA Sequence Number=SeqID_26948
MNAHPCQDGVHQLALRHGEVGIMIGGQDVAEQQSHPYLSQGGHVGAHDPHPSSGSSPGKILPRPVPPLAIFAFLALFQYHRISQELADSVGIERDPLTPNPGSHVTHALLCWPSIGIKLKDYFWIKLGHGSNQWCPPPAPYFLLEISILVVPELDASLPEKRPSLDGFEALLVHNAPKA

SEQ ID NO: 118634 - protein, 130 aa, Glycine max
  Coding DNA Sequence Number=SeqID_26949
  Homolog annotation: Hit_ID=A2Q4S5; Match level="QueryCoverage=90%, HitCoverage=18%, E-value=6e-13, Identity=36%"; Hit description=IMP dehydrogenase/GMP reductase, putative
  Pfam annotation: Domain name=DUF1723; Domain location=43-92; Score =47.1; E_value=6.3e-11; Accession=PF08330.1; Description=Protein of unknown function (DUF1723)
ERPELKLFFHGRKVQKFGRPAPESQGLVAVTGLSSLIACSVDTCDRELIFAFVERWHKKTSSFHPPVGEVTITLDDVTSLLHLSIIGAFQSFETLHVDKAVLMLVELLEVFGEEARVETAQCHGAYIHIS

SEQ ID NO: 118635 - protein, 141 aa, Glycine max
  Coding DNA Sequence Number=SeqID_26950
  Homolog annotation: Hit_ID=Q6WAY4; Match level="QueryCoverage=58%, HitCoverage=15%, E-value=9e-09, Identity=40%"; Hit description =Putative uncharacterized protein
MGTNQNRKRFYQVKIKGLGVTSLKELGRLMGPLQSQAFHKVYGKILDLTTAEVFTEAIVSLAQYYDQPLRCFTFGDFQIVPTVEEFEEILGCLLGGRKPYLFSGFLPSLSKIAAVIEDSARELDRIKQTRNGIVGPVWRES

SEQ ID NO: 118636 - protein, 77 aa, Glycine max
  Coding DNA Sequence Number=SeqID_26951
MEWLACLGEIRANFDSERWSLRLMAERPWIFFINEVLCFLKMNGSGMEKKKDDWKCHFKEKMSQEEAHHYRKPWIRT

SEQ ID NO: 118637 - protein, 73 aa, Glycine max
  Coding DNA Sequence Number=SeqID_26952
MWYHVSENLVGRLGVHDKTNHTIISQVTLTSFNSSPLKGLSINSPPLKGLIINSSPLKGLIINSPSLKGLKVV

SEQ ID NO: 118638 - protein, 80 aa, Glycine max
  Coding DNA Sequence Number=SeqID_26953
MPPNACPSVAYPRQGSELARVWSRVGRQAIWWEGMLVLNLHKMGVARTSQCFASLTYHIQGWMIYLIEARWVSRVHFCGG

SEQ ID NO: 118639 - protein, 185 aa, Glycine max
  Coding DNA Sequence Number=SeqID_26954
  Homolog annotation: Hit_ID=A8ARU6; Match level="QueryCoverage=23%, HitCoverage=56%, E-value=3e-17, Identity=88%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTRLDTTYRHWQQPL

SEQ ID NO: 118640 - protein, 59 aa, Glycine max
  Coding DNA Sequence Number=SeqID_26955
MTTTTTTRVAQRESFWGVSSLNKIFINSWTRSRLVNLPKLVRVYTKSDESTLISILLPI

SEQ ID NO: 118641 - protein, 144 aa, Glycine max
  Coding DNA Sequence Number=SeqID_26956
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLVWSSKINGTELEFVIMVIAVSFGKPVVPAALMNRPTRGERRFAYWALFRFLAH

SEQ ID NO: 118642 - protein, 168 aa, Glycine max
  Coding DNA Sequence Number=SeqID_26957
MPISPCRCISWDRAHKTPSGPKEVQQGPRVSSSGYGPLSVLQGAHPPARSCHCDIGIAPTRHPVDPKKSNRALGFPALVSSLCQSYRVPVPPARSCHRDIGIAPTQTPNGPREVQQGPGVSSSGIAPARNPVDPKKSNRVLELPSSNYGTLSVLRSACRPQQGHQALY

SEQ ID NO: 118643 - protein, 60 aa, Glycine max
  Coding DNA Sequence Number=SeqID_26958
MRQKIQRLSQGSLTVEEYYKEMEMEYVELDDLLHKAVWVEQQLKRKSAARRNSSNTFNQN

SEQ ID NO: 118644 - protein, 111 aa, Glycine max
  Coding DNA Sequence Number=SeqID_26959
MTQELVARGDTLRLFAPRHSVTPSVIDEQRPMWLSAPLCHPEAAGPMIRGDTLRLSAPLCHPEAAGPMIRGDTLRLSAPLCHPEAAGPMIRGNTQVVIRINILLLSVRQNA

SEQ ID NO: 118645 - protein, 151 aa, Glycine max
  Coding DNA Sequence Number=SeqID_26960
YGATRHPLDPDKSNRALGFPALIMGLCQSYGFPITPSKAVGAPPPPRQADGPLGIERYLQHLVLQQAANHRGQVQIHECLYQFSLSQQGLRSTTSICPTPEQFGAEVAWPGDWPDAQIGEEPAGSPGEADESHMDEDMTDLLDFLGESGAT

SEQ ID NO: 118646 - protein, 122 aa, Glycine max
  Coding DNA Sequence Number=SeqID_26961
MSRWRDLVGGDEHPVGLIEARNQSWKPQGPVGLLQILLRGRSALWSLGRMLLSSNVIHIFVRVVMLVRMIRAHLFAAAQVKSCPGMHSGCTIASSSGCARTVGPPPGSRGGLGTHKRKLLAP

SEQ ID NO: 118647 - protein, 83 aa, Glycine max
  Coding DNA Sequence Number=SeqID_26962
LWNFMTRIPDKIRSIDGSKETLKLVVRITDLWFVGTPNKSEQAEMVFVDSEGDQIHAICKSDHLKSWKADLKENCTSAMHNFR

SEQ ID NO: 118648 - protein, 118 aa, Glycine max
  Coding DNA Sequence Number=SeqID_26963
VSYEKAHASRREKADTYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 118649 - protein, 150 aa, Glycine max
  Coding DNA Sequence Number=SeqID_26964
  Homolog annotation: Hit_ID=Q8TGM5; Match level="QueryCoverage=27%, HitCoverage=61%, E-value=6e-08, Identity=70%"; Hit description =Uncharacterized protein ART3
GTWARSATEDASPDYNSDAEGDDFMRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 118650 - protein, 114 aa, Glycine max
  Coding DNA Sequence Number=SeqID_26965
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLFLVSTKLSGYILPIGTFLTVVGK

SEQ ID NO: 118651 - protein, 129 aa, Glycine max
  Coding DNA Sequence Number=SeqID_26966
MVKQLRGKDIPLVKVVWGSALIEDATWELEGQMRDTYPTLFDTGKFQGPNKATGGGALESTRNVNIANKERLSDYLKPHKKIPKGCHWVENSHPLAVSFGHNYAIGPIGVLTIAAIYPILGRSVLQWSW

SEQ ID NO: 118652 - protein, 101 aa, Glycine max
  Coding DNA Sequence Number=SeqID_26967
MVAEYATRFENLVRIFDEDQLEKVTFYRNANVSHGKEKNLVTHNRAKPYSVPPGQYGNHFGGQKTSEGLHPAGGSSQLVNKVRATSLPVAHIRGRKRGVEV

SEQ ID NO: 118653 - protein, 131 aa, Glycine max
  Coding DNA Sequence Number=SeqID_26968
  Gene Ontology: Mol. function=binding; Cellular component=nucleus; Biological process=mRNA modification
  Homolog annotation: Hit_ID=A5C4T3; Match level="QueryCoverage=82%, HitCoverage=18%, E-value=7e-27, Identity=55%"; Hit description =Putative uncharacterized protein
  Pfam annotation: Domain name=PPR; Domain location=43-77; Score=4.7; E_ value=2.1; Accession=PF01535.11; Description=PPR repeat
  Pfam annotation: Domain name=PPR; Domain location=7-41; Score=11.6; E_ value=0.32; Accession=PF01535.11; Description=PPR repeat
  Pfam module annotation: Pfam domain module=PPR::PPR; Domain location =43-77::7-41
MAYRDVNSWNSMILDFAMHGEAEAALDYYVRMVKVEKLVPNSITFVDVLSACNHRGMVDKGIVHFDMMTKEYNVEPKLEHYGCLVDGCINESANARGEAVCVLGALPLPRSLTRCARSFGCGERYQLTQRR

SEQ ID NO: 118654 - protein, 78 aa, Glycine max
  Coding DNA Sequence Number=SeqID_26969
  Homolog annotation: Hit_ID=A5C8K0; Match level="QueryCoverage=96%, HitCoverage=6%, E-value=1e-09, Identity=32%"; Hit description =Putative uncharacterized protein
MYNLNHLVRKDLVIGLPKLKFEKNKLCGACKKVIVDNYSRFTWTLFLKTKKEAFDAFRKLAKVIQNENGLNIVSLRSD

SEQ ID NO: 118655 - protein, 281 aa, Glycine max
  Coding DNA Sequence Number=SeqID_26970
  Gene Ontology: Mol. function=chorismate mutase activity; Cellular component=cytoplasm; Biological process=aromatic amino acid family biosynthetic process
  Homolog annotation: Hit_ID=A2TSE7; Match level="QueryCoverage=100%, HitCoverage=77%, E-value=9e-94, Identity=58%"; Hit description =Putative chorismate mutase
  Pfam annotation: Domain name=DAHP_synth_1; Domain location=1-245; Score=68.4; E_value=2.4e-17; Accession=PF00793.11; Description=DAHP synthetase I family
MIAGPCSAESEAQMLETARRIKETNAQVPVFRAGIWKPRTKPNGFEGVGVIGLNWLKKVKEEYGFKTATEVANAHHVFAALEADVDILWIGARSTVNPFTVQEIAMALRGTDKPVLVKNPVNPDLALWIGALERLVGQGIHNLGAIHRGFSTYQKTKYRNNPNWQIALDFKSQFPNIPMLIDPSHICGNRTGLADITQEAMNVGYQGAIIESHCNPDEAWSDASQQITPEVLAELIGNLKMRNAGLAGFDGEMGRHRTLISDLDFQLIELLSQRMKISEKI

SEQ ID NO: 118656 - protein, 105 aa, Glycine max
  Coding DNA Sequence Number=SeqID_26971
MMNQAILMMPKAQVIDSRLQDPASRIQSKIQDSREEIKKQQVKTSYRITPFELIGLGSSSSMESFASWRSIAAEWRRKIDDRRSHFKEKMNQEEAHHHRKPWIRA

SEQ ID NO: 118657 - protein, 83 aa, Glycine max
  Coding DNA Sequence Number=SeqID_26972
MGVQIATRPTWALQKIPPEGCCFWRKQPGSLGGNHLPYFAINRGGTEALPKRFRNVFREEFRKGFDRSSTFFIRSSSFFDLER

SEQ ID NO: 118658 - protein, 77 aa, Glycine max
  Coding DNA Sequence Number=SeqID_26973
MEKDFAVHLNQWSSNLKEALLARWGGVVYNHDPAKYLLSTVVSLVPLVITTAVEFKLNLDKYLMKRPATLSQLTSQN

SEQ ID NO: 118659 - protein, 229 aa, Glycine max
  Coding DNA Sequence Number=SeqID_26974
  Homolog annotation: Hit_ID=A5B1P9; Match level="QueryCoverage=77%, HitCoverage=14%, E-value=5e-09, Identity=25%"; Hit description =Putative uncharacterized protein
MQKKHKKKKRKRTELKVNSSKEDYKESSSDDENVENLSLMVKKIRKFLKRSKDRKFSKPLKKIQSNNKTFTCFEFGKQGHIKCECPIYLRKELVEKKGKKIRKQKKAYIAWEDNASTFSDSSSEEDVSNMCLMADSMDDSSIIEETEVNSEFEEDLETFNEMHQEAQRLVVSNKKMRSNLKLHITKLASIQSVLDKLRQENEKLVSSYKATNCVCASTSLIWMITNLCN

SEQ ID NO: 118660 - protein, 118 aa, Glycine max
  Coding DNA Sequence Number=SeqID_26975
  Homolog annotation: Hit_ID=A2Q1D6; Match level="QueryCoverage=78%, HitCoverage=15%, E-value=1e-11, Identity=38%"; Hit description =Ovarian tumour, otubain, related
MRLDTDTGVRGRASFLLIACERSGEYRPKKHNLVRICTSSRKCGCSFKLRAKPVSGGGGWMVKLICGAHNHEMAKSLVRHPYVGRLTKDEKIVVADMRKSMYLQNKCWTCGLNNISGG

SEQ ID NO: 118661 - protein, 69 aa, Glycine max
  Coding DNA Sequence Number=SeqID_26976
  Gene Ontology: Mol. function=nucleic acid binding
  Homolog annotation: Hit_ID=Q7XDY0; Match level="QueryCoverage=100%, HitCoverage=21%, E-value=7e-09, Identity=43%"; Hit description =Transposon protein, putative, unclassified
MDLDLALRTERPISTPKTSNELSIPEAFRGYISKGQSAKKFLEEIEQHFAKNEKSDMSNLLAKLISIKY

SEQ ID NO: 118662 - protein, 92 aa, Glycine max
  Coding DNA Sequence Number=SeqID_26977
  Homolog annotation: Hit_ID=Q5NRP4; Match level="QueryCoverage=43%, HitCoverage=2%, E-value=3e-07, Identity=57%"; Hit description =Putative gag-pol polyprotein, identical
MSLHFSSSVNGEGSTPKDPLYKILDELRSLKLWKEKQERNEKGTKDSWDPPVEYWNDLKSALRKRHIPSYYERELMDKLQRLRQGSMSVGRI

SEQ ID NO: 118663 - protein, 94 aa, Glycine max
  Coding DNA Sequence Number=SeqID_26978
MAKFDPEVVLDFYANAWPTEEGARDMRSWVRGQWIPFDANALSQFLGDPLVLEEGQECEFQSEEEQGRRVRRGGHCPAVMHTGAGFRPDCCREA

SEQ ID NO: 118664 - protein, 58 aa, Glycine max
  Coding DNA Sequence Number=SeqID_26979
MKKILGLQAPMELTSYKLYMELHQHLSWCIVDRGEFMSPLSSRVLGDQCKMLPKFHEI

SEQ ID NO: 118665 - protein, 55 aa, Glycine max
  Coding DNA Sequence Number=SeqID_26980
MGVQIAPRPTWALWNIPPEGGASERFRNVFREDLAKVQPFFDVLHSFFIVLRSST

SEQ ID NO: 118666 - protein, 115 aa, Glycine max
  Coding DNA Sequence Number=SeqID_26981
  Homolog annotation: Hit_ID=Q6WAY4; Match level="QueryCoverage=65%, HitCoverage=13%, E-value=1e-08, Identity=41%"; Hit description =Putative uncharacterized protein
VTSLKELGQLMGQLQRQAFRKAYGKIWDLAMVEVSIEAIASLAQYYDQSLRCFTFGDFQLSPMVEEFEEILGFPLGGGDHTSSQARTLAARDEWVPFIDVLALLIFGGALFPNMD

SEQ ID NO: 118667 - protein, 30 aa, Glycine max
  Coding DNA Sequence Number=SeqID_26982
MEVDEPLGLWLPLNYQVVFVTGSAVGRLCG

SEQ ID NO: 118668 - protein, 310 aa, Glycine max
  Coding DNA Sequence Number=SeqID_26983
  Gene Ontology: Mol. function=cofactor binding; Cellular component =membrane; Biological process=electron transport
  Homolog annotation: Hit_ID=A8GK68; Match level="QueryCoverage=99%, HitCoverage=92%, E-value=1e-173, Identity=95%"; Hit description =UPF0190 protein Spro_4414 precursor
  Pfam annotation: Domain name=Oxidored_molyb; Domain location=90-268; Score=242.1; E_value=1.3e-69; Accession=PF00174.10; Description =Oxidoreductase molybdopterin binding
MNKHPKLTEADVTPESVFHQRRKVLQALGITAASLALPTGAQADLLSWFKGNDRPKAPPGKALEFSKPAAWQAQLAMTPEDKVTGYNNFYEFGLDKADPAANAGGLKTEGWKVRIDGEVAKPITLDIDDLMKRFPLEQRIYRMRCVEAWSMVVPWIGFELGKLIKLAEPNSNARYVAFQTLYDPEQMPGQKDRFIGGGLKYPYVEGLRLDEAMHPLALLTVGVYGKTLPPQNGAPLRLITPWKYGFKGIKSIVHIRLVRDRPPTTWNQSAPNEYGFYANVNPHVDHPRWSQATERFIGSGGILDVKRGIL

SEQ ID NO: 118669 - protein, 93 aa, Glycine max
  Coding DNA Sequence Number=SeqID_26984
MVRIDVIREPTSQGCTREDADEFIFCSYNGHNWVSSKVECDHILGSRISFLSSLYLISSQIDAALGIVSHNDDFQCGVGPKFRVSLVEHAVAA

SEQ ID NO: 118670 - protein, 77 aa, Glycine max
  Coding DNA Sequence Number=SeqID_26985
MTTLCKSSKRYQWAIIVNFVGNLNTSKRIVGSVCLGSKRKKILTIQPISPNGKLVFIGNRVKAPIEAVGIYGLKLKN

SEQ ID NO: 118671 - protein, 328 aa, Glycine max
  Coding DNA Sequence Number=SeqID_26986
  Homolog annotation: Hit_ID=Q2HW90; Match level="QueryCoverage=51%, HitCoverage=31%, E-value=1e-22, Identity=38%"; Hit description =Putative uncharacterized protein
MASQEKWGPFADILALLIFGVVLFPNVDGLVDLAAIDAFLAYHHSKESPVVAILADLFDTFDRRCEKSSARIVCCLPVLCVWLISHLFQQDTRHPCPLQSYCSCAEKGRVDWDQHLAEIGGSAINWFPRWKEGKEGVLFSCGDYPNVPLIGTKGCINYNLALAIRQLGYPMRGAPTEGSLSPFLVKDLGAQVSRLYKESTRRGESVEERQELRGIRNGVIGGYHGWLRIHTRGLDWLSKLKVIDEENFEALEEDEEVRALKLELGKARLAKEKFKSAATHIRKECTELQEENAATARALEQETKRARKEEHGREKFRGALWGSNNEKS

SEQ ID NO: 118672 - protein, 119 aa, Glycine max
  Coding DNA Sequence Number=SeqID_26987
GDAPQATDAPPPHQAGPAGSFDTEQYLRHLVHQQAANHWAHVQTHDCRYQMSLSLQSQGFTSFPCPTPDQYRAEVAWPGDWPEAQAGEAPAEAPDEADEAREDEEITDLLDFLGGSGAT

SEQ ID NO: 118673 - protein, 113 aa, Glycine max
  Coding DNA Sequence Number=SeqID_26988
MNDALLDKVEGDKLYKLKVQSNNHTFSLNWVQGINHSYTRDSCKNHCLLLFVLSQLKITLSPDKIIIKLFKKHGNKNPDPVNDPMHAHSGPVLVQMMGPEKEAGPTLVQMAQA

SEQ ID NO: 118674 - protein, 33 aa, Glycine max
  Coding DNA Sequence Number=SeqID_26989
MALAQVEWALRPLECHPPNPAEASGMQRPHPLL

SEQ ID NO: 118675 - protein, 307 aa, Glycine max
  Coding DNA Sequence Number=SeqID_26990
MASKRRKSSASYSSHIRFDRSRFHSQEAWDRYNDIVVPRKLLLERNEVIYHTEFDEFKEELERRKWDEELTSFDEGNIDVAIVKELYANLYDPEDKSPKQVRVRGHLIKFDEDTLNTFLKTPVIIEEGETLPTYSRFALLRPDPQELAAKLCISGRGFELNADGQPLKILRKNMTTLAQTWSVLSYSNLVPTSHTSDITLDRHDSSRLGFPALIIALSKARGVTSYSRSLESLSPAINLAYIKKNCWNLDDPIVTFRGPRKARGKRSEAPPTSVAPDASAPSSSTLPDPSTITPSSFTPTTPALIPV

SEQ ID NO: 118676 - protein, 400 aa, Glycine max
  Coding DNA Sequence Number=SeqID_26991
  Homolog annotation: Hit_ID=A7PB81; Match level="QueryCoverage=92%, HitCoverage=49%, E-value=1e-81, Identity=45%"; Hit description =Chromosome chr16 scaffold_10, whole genome shotgun sequence
MEKPTVERKSPRPSATPPDVESEKLKAVDDLKEAQRVDEEANEKLLEALIAQKCPEENFEIEKFRKKKEEWQKKIESVRNQHALNMDSLLSTTQELQRVKQQLALTCYAKNQALNHADDATKIVEILAEKAEFLSSELMRLKALLDSKVETEARQNQLILKLKTDIEALKEELEKSKGYDDKLSERESFIELLNVELVASKMDESYARTLLEEWHTKVEELEMRIEEANKLEIYASEYLESIMKRVEGNNDLLHEAESEVDTLKEKVELLEMTIGRQRADVEDSQCQLCKAKEESLEKSKEVEALTSELERVKEEKAQALNDSMLDEARYEINVLVCIIENSKSAFENSKAEWEQRELQLVSCIKKNEEEKVSLEKEIKRLLYLLKETEEEANANREEEA

SEQ ID NO: 118677 - protein, 795 aa, Glycine max
  Coding DNA Sequence Number=SeqID_26992
  Gene Ontology: Mol. function=oxidoreductase activity, acting on the CH-OH group of donors, NAD or NADP as acceptor; Cellular component =glyoxysome; Biological process=tricarboxylic acid cycle intermediate metabolic process
  Homolog annotation: Hit_ID=A5BEJ8; Match level="QueryCoverage=17%, HitCoverage=49%, E-value=3e-38, Identity=54%"; Hit description =Malate dehydrogenase
  Pfam annotation: Domain name=Ldh_1_N; Domain location=563-708; Score =2.2; E_value=1.4e-06; Accession=PF00056.14; Description =lactatemalate dehydrogenase, NAD bind
  Pfam annotation: Domain name=NAD_binding_5; Domain location=564-791; Score=-38.6; E_value=5.8e-06; Accession=PF07994.3; Description=Myo -inositol-1-phosphate synthase
  Pfam module annotation: Pfam domain module=Ldh_1_N::NAD_binding_5; Domain location=563-708::564-791
MGFTLVDLEKFGYKDEPFIMAAQVRQGKTSCIPYHIDASTLVVNELPTFSPQMPSINAENEEDDVDANCNDHDEGLCENTATTVCGKKIPIVHLSSKVVSQSLKNLIWDDIMGKFDIPKGSTAKKKGEDKLDPSAKYAIIIDPPSPIARHMKWKMAQTKQYRQMTSIEAQQTSEKIDDLQEHTMQGSFVPDGHEDILNTALGRPEHLGRVHVAGHGVTINQYFGQALRASNTSSATITPDQLGAALAPKYPQGRLAHASWLLSSKGMSSPKRAGYLVMKLFHGPGLTTSKHSPLVDAPDPHILVAHVSTKGSRVEAAVNVLPEEPSIVDGTTIHNVPYADGVLRVSVVTVYDADMRVPFPMSKIQYVRNAVNTFIAWPTHLVKPLSDDSHNNVPKSVGRVERCNLGAGEDPLGELMKILYDIYLKPVALTWDGMKYELPNVEASFFITHAYLTEIIPGDKCLNMSILQLWMIRGHGFLEPQSIPNAKDRHQQCQQYIKTWVKESQRQLYLGAYLNQDNIVVWFCSLRKKPDINIKVAINSAMKTITSTFEGMLINLHLGGLKRRVMLVGWGGNNGSTLIGGIPWSTKDKIQQANYFGDLTQASAIRHGSFQGEEMYAPFNTLLPIVNLDDIVFGEWDITNINLTEVRGFLGQQQLESALIGMDLVIILAMSCPNAIVNFISNPVNSTVAIVAEVFKKVGTYDPKRLLGVTTIDVVRENTFVAEVLGVEPTKVDVPMVGGHDGVTILPHLSQVLDHCREDKLNGKRALNLANEDKIDGDDDEAKGIITYMVITFVV

SEQ ID NO: 118678 - protein, 99 aa, Glycine max
  Coding DNA Sequence Number=SeqID_26993
MKHLVYGSASCGGARPLGVCSDGLGRTIVGVLGEEERDRGEDVLEEALPNAIRRRCHWVEVVGDVMAGDVEGAPVTAEEEERELGSHRGRVRNERREGD

SEQ ID NO: 118679 - protein, 96 aa, Glycine max
  Coding DNA Sequence Number=SeqID_26994
MTAQLIHDRVMMECLEGVWEALEGNERCRFRGTVRLTATSLELSLEPAMDAPDLPEDDEDPLPDVDSPEDIMPASEADSTEESGPGGTANSDDTSS

SEQ ID NO: 118680 - protein, 225 aa, Glycine max
  Coding DNA Sequence Number=SeqID_26995
MVPMNLRVSGATFPANELKLIWAGYGSSGSGGEEGSGSATVAAVIAFIAIEAKPTLSAEEGRKGWGDRSERGRLSQGGVVGEHPGAFLPVDAPSRPHGRGLKADEPEPRGEWGGEANGAIGEILEGCKIFRHRATLSQLKQGSGGVFVLQRSKARLEGLEKRWPGSELAITGHPMEPGESTTIHIKRRDGGGPEDGEGEEVCGSVRAGGRVGEESAMEGATRAPR

SEQ ID NO: 118681 - protein, 437 aa, Glycine max
  Coding DNA Sequence Number=SeqID_26996
  Gene Ontology: Mol. function=nucleotide binding; Cellular component =intrinsic to membrane; Biological process=defense response
  Homolog annotation: Hit_ID=A7Q1Y0; Match level="QueryCoverage=97%, HitCoverage=46%, E-value=5e-59, Identity=33%"; Hit description =Chromosome chr13 scaffold_45, whole genome shotgun sequence
  Pfam annotation: Domain name=LRR_1; Domain location=169-192; Score =8.7; E_value=7.5; Accession=PF00560.24; Description=Leucine Rich Repeat
  Pfam annotation: Domain name=LRR_1; Domain location=373-396; Score =8.7; E_value=7.6; Accession=PF00560.24; Description=Leucine Rich Repeat
  Pfam module annotation: Pfam domain module=LRR_1::LRR_1; Domain location=169-192::373-396
MATQICRLQYLRTLTVFIVGKQDGLSIRDLRKFPYLLGKLSILNLQNVVNPVDAFRANLKNKEQIEELMLEWGSNPQDPQIEKDSLMSVSDCNNCLLLPPFGQLPSLKELVIKRMKMVKTVGYEFYGSNAGSQLFHPFPSLESLEFEDMSEWQEWLPFESEGRNFPFPCLKRLYLYKCPQLRGTLPDYLPSLTNVSFSECNQLVPNLSDVHWNISIEVMHIREGQEGLLSILDNFSYCELLIEKALYPFYSKLGSNYYSRWRSSFQISCFIVTDCEKLRSLPDQIDLPALEHLDSEARLSPRCFPSGLRSLYVDVRVLSAMSRQELGLLFQHLTSLSHLLVKGLRNDEDLINTLLKEHGLKLLDGKGLQNLTSLQMLHMYNCPSFESSPEDQLPSSLVILSLRKCPLLEARYRGQNGKYWSKIAHIPAIQINEKVII

SEQ ID NO: 118682 - protein, 102 aa, Glycine max
  Coding DNA Sequence Number=SeqID_26997
  Homolog annotation: Hit_ID=A2Y3N2; Match level="QueryCoverage=44%, HitCoverage=18%, E-value=4e-07, Identity=59%"; Hit description =Putative uncharacterized protein
MVYDKIQTENGFSKLSTVERQEIQMKKAKLIGMLDEVFEIEYGYCAEYHLGQLKAKIAKLRTQLLEPPKGWYHGGHDEGVKFINIEEEQEIHQAEIDETCSS

SEQ ID NO: 118683 - protein, 214 aa, Glycine max
  Coding DNA Sequence Number=SeqID_26998
  Subcellular localization annotation: CTP_CleavageSite=42; ConfidenceScore=5.11e-01
MGSWCFPSSCMRVELTTSSTIERYKRKGTPGPGRLKTGATCRMTSVFQRAWGGTWTWMLVCRLTFGLPRWVGFYSPMCDDKAQELASADPENFSEYLFQVCHMLGYATGFDNHVVNVDLDISSDMLLKIRSINLWTHPVKVGVVSAYSHLQLAFLTMMMLANQHVRWLPSKQVRVPVYDISYASLLMAGEVSAELHALPEFGSELQLDKFFNRL

SEQ ID NO: 118684 - protein, 213 aa, Glycine max
  Coding DNA Sequence Number=SeqID_26999
  Homolog annotation: Hit_ID=Q5XM22; Match level="QueryCoverage=31%, HitCoverage=37%, E-value=1e-16, Identity=61%"; Hit description =Resistance-like protein HAAS-2
MVRTRGLGRSLSRVIGRALRREVSCDSDEAPERRRPTASALHEQHEEATNDDVVIDIKGFSSGPHNTSILSGYVHHVAVTIWNGEEHPELNFHLPVGEVIITLDDVASLLHLPIIGTFHSFEALHMDKVVFLLVELLEVSSKEVRAETVQCHGPYVRLLWLQDTYRSKCDVAQWTIAARAYLLHLVGCTLFANKSATHVYVVFLDAFRDLTQS

SEQ ID NO: 118685 - protein, 447 aa, Glycine max
  Coding DNA Sequence Number=SeqID_27000
  Gene Ontology: Mol. function=nucleoside diphosphate kinase activity; Cellular component=chloroplast; Biological process=nucleotide metabolic process
  Homolog annotation: Hit_ID=A7QZ31; Match level="QueryCoverage=29%, HitCoverage=64%, E-value=6e-47, Identity=69%"; Hit description =Nucleoside diphosphate kinase
  Pfam annotation: Domain name=NDK; Domain location=167-287; Score =190.2; E_value=5.1e-54; Accession=PF00334.10; Description=Nucleoside diphosphate kinase
MGFELRPSLQGIKSGCTRSRAVDEHVRRLRITGVGLCERLQTIGEELSVYANNLGVNLEFWVVEKNLENMKPEDIKVREEEVLVVNSILQLHCVVKESHRALNSVLQMIHGLGILVVLTRSFLSQPQTEMEAVCGSFWVTSSLPRSPNVVVIVNYSNSNSNAQEQVDQTYIMVKPDGMQRGLGFKLTDLKLFKCSKELAEEHYKDLKQKSFFPKLIDYITSGPVVCMGVGVVASARKLIGATYPLQAEPDTIRGDLTVQTRKNVVHGSDNPENGKHEIDNMFGIFDVVEAIVVAPGKIILTGEHAVVHGSTAVASSIDLYTYVSLCFSTPSDNEDSLKLKLKEAALEFSWSITKIRAAFPESTTQLSSPPNSCSVENAKVIATLVEELNIPEAKLGLAYGVTNIFANDYFYPQGKSSAVILKFELFHTPTPEIRLVNDALSPLLFIN

SEQ ID NO: 118686 - protein, 92 aa, Glycine max
  Coding DNA Sequence Number=SeqID_27001
MHHRKRETLDEASQLSSESGTQHDHRWTSTPYGKHIPGYRAQYLKGKLTQASQLLRLEGISSPKQAGCLRMKAFHIPGKPNAGVGELGSRKF

SEQ ID NO: 118687 - protein, 113 aa, Glycine max
  Coding DNA Sequence Number=SeqID_27002
  Gene Ontology: Mol. function=oxidoreductase activity; Cellular component=endoplasmic reticulum; Biological process=electron transport
  Homolog annotation: Hit_ID=A5Y5L3; Match level="QueryCoverage=94%, HitCoverage=26%, E-value=4e-39, Identity=62%"; Hit description =Flavonoid 3'5' hydroxylase
MFTGYGVCSLRQRWKLLRKLSNLHMLGGKAVDDWAQVRNEEIGYMLRAMHDCSKRGSESNEFKDMVVELMTVAGYFNIGDFIPFLAKLDLQGIERGMKQLHKKFNLMRCVAMF

SEQ ID NO: 118688 - protein, 200 aa, Glycine max
  Coding DNA Sequence Number=SeqID_27003
  Gene Ontology: Mol. function=isopentenyl-diphosphate delta-isomerase activity; Cellular component=cytosol; Biological process=isoprenoid biosynthetic process
  Homolog annotation: Hit_ID=A7PVI7; Match level="QueryCoverage=90%, HitCoverage=23%, E-value=5e-56, Identity=57%"; Hit description =Chromosome chr9 scaffold_33, whole genome shotgun sequence
MRPFWVSAGKEKATMRKDSKLDVTIGPYETYEDKLFGYKSKFTGNLLALSPLKRPMMLSLTCESVLVIALQFFCATFEAYIGIRDDEATAQLKLLGDYLLDVKGPQTLAFNLPNDEHIVKDRGSSMVMLKNVSEAKFKHILLPIAAACVAKEQQEHVDFESFFTRSICHECCHGIGPHTITLPNGQKSTVRLLSSTICFT

SEQ ID NO: 118689 - protein, 196 aa, Glycine max
  Coding DNA Sequence Number=SeqID_27004
MVSARVYGDDVSEGATYAQEEDLLDKIKKKIKESETLLSEGVVGVNEGVVGANEGDSPYREKLLTEIGGDEIDFVENHDENDCDMMEIHSLGVEKKKEFVHVKDGVEIPVSDEDHLGHKKDGCSEPIMGMKKVTRKVANVTKDMKEVTNEGVNEAQGGDGNVVMEARFGLWMMVTQRDVKNNDNGNFSAGEEDLSM

SEQ ID NO: 118690 - protein, 426 aa, Glycine max
  Coding DNA Sequence Number=SeqID_27005
  Gene Ontology: Mol. function=4-(cytidine 5'-diphospho)-2-C-methyl-D -erythritol kinase activity; Cellular component=chromoplast; Biological process=isoprenoid biosynthetic process
  Homolog annotation: Hit_ID=P93841; Match level="QueryCoverage=95%, HitCoverage=81%, E-value=1e-122, Identity=77%"; Hit description=4 -diphosphocytidyl-2-C-methyl-D-erythritol kinase, chloroplast/chromopl ast precursor (EC ...
  Homolog annotation: Hit description=2.7.1.148) (CMK) (4-(cytidine- 5'- diphospho)-2-C-methyl-D-erythritol kinase)
  Pfam annotation: Domain name=GHMP_kinases_N; Domain location=122-180; Score=59.9; E_value=9e-15; Accession=PF00288.17; Description=GHMP kinases N terminal domain
MVSDSNTSRRQIEIVYDPEGRINKLADEVDREASLSRLTLFSPCKINVFLRITNKREDGYHDLASLFHVISLGDIIKFSLSPSKTKDSLSTNVSGVPLDDRNLIIKALNLYRKKTGSDKYFWIHLDKRVPTGAGLGGGSSNAATALWAANQFSGCPASEKELQEWSSEIGSDIPFFFSQGAAYCTGRGEVVQNIPPPVSLDVPMVLIKPPEACSTAEVYKTSNVDPLTLLEKISKIGISQDVCINDLEPPAFEVLPSLKRLKQRISAAGRGEYDAVFMSGRKIPRIIFYRHRLLTVTVRSSYPTQIIWYFVRSPFPGEGERVLQADAAKKVLLKAGTKTGRDLKPEASPHLVLSLRREEAERSLEEGCGSTIVGIGSPDPPQFVYDDDEYKDVFLSDAYFLTREANQWYQEPASSPSASPVVSESV

SEQ ID NO: 118691 - protein, 747 aa, Glycine max
  Coding DNA Sequence Number=SeqID_27006
  Homolog annotation: Hit_ID=A7PFY5; Match level="QueryCoverage=81%, HitCoverage=93%, E-value=0.0, Identity=58%"; Hit description =Chromosome chr6 scaffold_15, whole genome shotgun sequence
  Pfam annotation: Domain name=UBA; Domain location=257-293; Score =32.5; E_value=1.5e-06; Accession=PF00627.22; Description=UBATS-N domain
  Pfam annotation: Domain name=UBA; Domain location=319-356; Score =10.2; E_value=0.71; Accession=PF00627.22; Description=UBATS-N domain
  Pfam module annotation: Pfam domain module=UBA::UBA; Domain location =257-293::319-356
MEGQYCTPFMVVGNLLIGKGSVGYLQTVKSYQVAEGVGNLIHCILCWKNIGLDVKFINLIYFSRSLLEISFFFNKEFIEIEEKVTNAIARGGIFATEEMSPASKSKSKDKKAVKEAQKSSAKSSGSGNAVAGVPASAYNPLLGTFHTLETSPTSTSQVNSNGRFRNIDETDEHPAGSVVAGVEYDSVSNNGSWSGESEDHKDKAASNPPARLEAVPGADNDKREKIRQKNEKKHQRQKERRAQELHDRCTGYIMSRKLEALAQQLVAMGFSHERATVALILNEGRVEESVAWLFEGGEEADNHKETNIGGGNLKIDISEELARIADLEIRYNCSKQEVERAVVACEGDLDKAAESLRELKLDRPSGPPKPEEIGDLPSLTNKQSEAVNQNARTQTKPILSPNQPKKDEKDFNYAKQAVMLGGSTESSNRLVQPLKRILPKSEWAKPQQAAVPADKRWPGAGSNPSVSFSLASPLQVSSTPAKTEASYMAVGGDYKNLQPGATREPVIVMQRPQTVNAKQIPAASMSSSPPGVAASWYPTNSVEVMRSNGFMSHPPSTRSLSSNYFSSNQLYHQLQCQPPQQFVAGNSSSVDLQATNQGNNLWNRTSASPTLAAASSLGLFSGLGSAATSGATSPVDWSTGGTMQFDYTNIDWSLDRGLSPPRSNALLFGLSPFTKSSSTLYGSNASGTVAQQAIRSLPSNGSMVPLPGLQEGGVSSAEPSGSRDWSSPFEGKDLFSLPRQFVSSPSL

SEQ ID NO: 118692 - protein, 116 aa, Glycine max
  Coding DNA Sequence Number=SeqID_27007
MITKNDDKGDDKKLKGQSKNEFKIFNIESRTLQDSRGKLISRIKNQDSRDQDFKNQDSRDQDSRLKIQESREGLIKISMKRFSQKLSSTWIFLKTCLPKSFYSLVIDYQIVVINYQ

SEQ ID NO: 118693 - protein, 100 aa, Glycine max
  Coding DNA Sequence Number=SeqID_27008
  Homolog annotation: Hit_ID=A5BR45; Match level="QueryCoverage=44%, HitCoverage=2%, E-value=6e-08, Identity=52%"; Hit description =Putative uncharacterized protein
MNANQNRNSIRGVFIDGSWTDDPHKVKEEVKSFFFHRFQEPIEKAGLGIKDIETFNLALLGKWKWQLMQENGELWTRVLKSKYGGWRNLEETGNSAKQSV

SEQ ID NO: 118694 - protein, 408 aa, Glycine max
  Coding DNA Sequence Number=SeqID_27009
MASEVPTELHALLGFGSELQLDELFNMLWGSVKSVITWIYIEFIVQACMVDNQDLDWRPLVHAHDLSGTILCGVRLGRLPVLTVTISPIKVGNFLIRSGVKTMAPSSLSIFLPIKVDIAFGLYSFSYEAREWTGVRLNGDLGHHQVGNYDGDNQGVVMVYGVDTLEVSINEIDVDVPDGVKVTLARLTGLPSAHVLMEVVDRVFVGGVFIFLDFCSISSSVCVVIPMLILLVSSGSCFYLVVKGVKQDPHPSILISNPINLTSLIGLREPHPQSLTTSLHDGSSVSASLSQPPSLSRPLPSTSSPHPSLSISNPNISLTSSIGLRASPSVPQSLPPWRRLRVSLTLTASLCGSVSSSSSPSCQTLIFVAVHLCATTYLFFHTVSPTSFSFPICCLKLFFSDLTMWNAA

SEQ ID NO: 118695 - protein, 71 aa, Glycine max
  Coding DNA Sequence Number=SeqID_27010
MEHPVPSATSPSNDPLHGTGGPMTRSKTKRIKQALQGFIIKIKEKEDQCELRVVPNWVALLQIDEDALGLT

SEQ ID NO: 118696 - protein, 138 aa, Glycine max
  Coding DNA Sequence Number=SeqID_27011
MELIENMVAMTMPSLVIEPTHLQKKSLLKFTSQDAPLAENKLLAKKLEILTKTLSKLPQHLQAVQPAHSSVMHIGGCNICGGGYESGMCMVSLSNPKSTESAIRNLEVQVGQLAKQLAIASTNSFEANTEKNPKVECK

SEQ ID NO: 118697 - protein, 293 aa, Glycine max
  Coding DNA Sequence Number=SeqID_27012
  Homolog annotation: Hit_ID=A7PFU7; Match level="QueryCoverage=93%, HitCoverage=100%, E-value=1e-108, Identity=57%"; Hit description =Chromosome chr6 scaffold_15, whole genome shotgun sequence
  Pfam annotation: Domain name=F-box; Domain location=21-68; Score =44.4; E_value=4e-10; Accession=PF00646.24; Description=F-box domain
MSLVRKSLTSRVENVEESLDMSVLDLPELALDCILERLPPSSLCRIAAVCRTLRERCVSDHLWEKHMRKKWGRVIGPAAYREWKWHVASKRNVGGLKHGRQKGLMRFMSLHWPFQWIRPKVDANYNNPKLRSSLPVDSVMNWYLALESGNFWFPAQVYNRENGHVGFMLSCYDAELSYDPRTDTFQARYPPHGRRADARECGIPWERLRAPPIDTSPHDLHVSDCLNDLYPDTVVLEFNHYTPGSRWRLTTVSRKDHREEGNEADGFYGGIRKITSEAEIATWKCLWPSEVLD

SEQ ID NO: 118698 - protein, 138 aa, Glycine max
  Coding DNA Sequence Number=SeqID_27013
MWAFHTGQQIDWAHLVRYRMHKALRLNAQFPYPHLVTLFLQHFNIPLDSKPYVPIKRSFLIGAAVIASFGYRKEHDGSWILDRFDGFQTFVGERFDALELQVDMRFDEMDSRITKVEGDVYYIRTCFDLPPPPPPPSS

SEQ ID NO: 118699 - protein, 138 aa, Glycine max
  Coding DNA Sequence Number=SeqID_27014
DLPLEVILPHSNNSNIKKKSRVNVPFGQYDLKVASEEVGQRISGPTHSATKVYVRRKEVLRSNGKAQQFKEPAVDSNSVSKTDSMPSIQQDPIELQCALLNEMGLTYGEDANKVKGLILDMENRDDMMAAERGIKKHQ

SEQ ID NO: 118700 - protein, 42 aa, Glycine max
  Coding DNA Sequence Number=SeqID_27015
MWDRHRLKGTLKPGVFNPKAYTPKSLSGPLPPDSVLSRRACD

SEQ ID NO: 118701 - protein, 57 aa, Glycine max
  Coding DNA Sequence Number=SeqID_27016
  Subcellular localization annotation: CTP_CleavageSite=41; ConfidenceScore=5.00e-01
AWQRVETGTSIAFPTPAPDFLTNPRPRPRPPPGLKNPYPPPSPLEVGFPRPAPARID

SEQ ID NO: 118702 - protein, 18 aa, Glycine max
  Coding DNA Sequence Number=SeqID_27017
MGKGSLRRRLPEDPLRIL

SEQ ID NO: 118703 - protein, 68 aa, Glycine max
  Coding DNA Sequence Number=SeqID_27018
MTGAGDGGGEYHQLDGSQHLLLDVMTTQMPCLLNRNNEELYRQIEGLEHQMLGDLMVATEGSMMDRTE

SEQ ID NO: 118704 - protein, 69 aa, Glycine max
  Coding DNA Sequence Number=SeqID_27019
MQEMTRMKRTPLSSSYMFIVKWVNLVLLVIQHCIFYIVGLRTDVKTFNYQRRRILHLLTTDLEWRFPPM

SEQ ID NO: 118705 - protein, 241 aa, Glycine max
  Coding DNA Sequence Number=SeqID_27020
  Gene Ontology: Mol. function=hydroxymethylglutaryl-CoA lyase activity; Cellular component=mitochondrial inner membrane; Biological process=metabolic process
  Homolog annotation: Hit_ID=Q2PF06; Match level="QueryCoverage=44%, HitCoverage=24%, E-value=3e-46, Identity=87%"; Hit description =Putative hydroxymethylglutaryl-CoA lyase
MAVVPAEKLAVHFHDTYGQSLPNILVSLQMGISAVDSSVAGLGGCPYAKGASGNVATEDVVYMLNGLGVKTNVDLGKLMLAGEFIGKHLGRPSGSKTAVKVISVGGDCCSGRFDSDVVGVLYVCDVENFESIVKMDEDQWMYDNIMSEEVDTNDENEHDVGVNEEPHWARSVAHEIGFVAVIMRSDTNIGMRGRTSFVLIGYEMSGQYRSRKKDFVRRDTGSRKCGCPFQVSWETQWLEGK

SEQ ID NO: 118706 - protein, 233 aa, Glycine max
  Coding DNA Sequence Number=SeqID_27021
  Pfam annotation: Domain name=Transposase_23; Domain location=19-84; Score=-13.9; E_value=0.039; Accession=PF03017.5; Description =TNP1ENSPM transposase
MQSQGLELPPEAEVGPSVSRVSTKEMFPDWLPLEEFMRDRRPTVHNIPLDNDLVKVGVEEVQDVDAHIPVPTQKVQLVGQALNIFLAWPTHLDKQGVEGSAKPVDMLDLDVNPLYLMTLSIPQLFLKFVGFNNNQGSKSKAAARWIIIKCNKDKGSTECRLGKSSYSVANRVAYWESRESDIYNYVANLGLGRFGQPYQQKRESELQPIAIKKAALLGNGGIMPNGLDFQLSG

SEQ ID NO: 118707 - protein, 90 aa, Glycine max
  Coding DNA Sequence Number=SeqID_27022
MVVGVSGGAMIGADDAGFVGKTMFVGKDNCAFYCQNNRNILARKNGSSKSGSFDDSMNKCQLLLNRIGGNEKGEEKQEAQISFLSHYPKV

SEQ ID NO: 118708 - protein, 239 aa, Glycine max
  Coding DNA Sequence Number=SeqID_27023
MEDAPVSPRVALPSKAFDLRMKKKILQTVGERCKQFKLDLTLKWALIDDKEGDDDTVCEKYDIRNEKWNQFCQSRKDPSWEASQGSFVAHGCQDVLTSTIGRPEHLGCIRAAGVGIMIKQYFEPVPRTSCTSSSMTPEDLEQLTQEIRDQLEESIIEKGLALPLEPEDPDMGESEKCGLYVDENPSYLVALGRLYEGSNIIQNIPLGNDQVKVGIEEVQDADARNLVPTEEDKQRAEES

SEQ ID NO: 118709 - protein, 73 aa, Glycine max
  Coding DNA Sequence Number=SeqID_27024
MALATSPFLGRITSWAQKSTLREDCIMGSEIYLEVHENPRAFFSNSSLILLEPLAYGSGDWSLPREDYITLSL

SEQ ID NO: 118710 - protein, 93 aa, Glycine max
  Coding DNA Sequence Number=SeqID_27025
MAYLHYKWIQISNISKIEQEAPYQDDELVGLQEVLELDPDVINESLADVDGGGEEIDADLLKQLDLVELDEDECMLSENDHDIESDFDDTDTS

SEQ ID NO: 118711 - protein, 260 aa, Glycine max
  Coding DNA Sequence Number=SeqID_27026
  Gene Ontology: Mol. function=serine carboxypeptidase activity; Cellular component=extracellular region; Biological process =proteolysis
  Homolog annotation: Hit_ID=A7Q6D4; Match level="QueryCoverage=89%, HitCoverage=51%, E-value=3e-52, Identity=44%"; Hit description =Chromosome chr11 scaffold_56, whole genome shotgun sequence
  Pfam annotation: Domain name=Peptidase_S10; Domain location=10-249; Score=-83.7; E_value=4.4e-10; Accession=PF00450.13; Description =Serine carboxypeptidase
MLHVHRCTCPRTADKTKNLDIHGLVLASPRLDSFMDNNTKVEFAHQRTLISNELYESIKSNCNGDYVNLDPNNTKCMSDYEAYTELVRYINEYQILEPSCVIAPKENQRILSQELNYIHQTKFRCRDDLYAIGELWANDPHVQKALQVREGTKDHFQRCNRSAAYTWNVPSVVQYLHNLTNTNMRSLIYCTDLDMSIPYLSSLSIVKSLNLKFDMTWHPWFVDGQVAGYAEEYKKSEYHLTYAIVKEKGVRVSLDPSPPP

SEQ ID NO: 118712 - protein, 107 aa, Glycine max
  Coding DNA Sequence Number=SeqID_27027
  Gene Ontology: Mol. function=metal ion binding; Biological process =defense response to fungus
  Homolog annotation: Hit_ID=A7P0H2; Match level="QueryCoverage=67%, HitCoverage=5%, E-value=1e-21, Identity=65%"; Hit description =Chromosome chr19 scaffold_4, whole genome shotgun sequence
MPLYMWPNQENSTLLQYDALYDPRMLSSKPTVAGEIQIFYCKNCEYNQHECFACGTLGCSDKFSGAKVFKCASATCGFFYHPHCVAKLLHGIVEDAPKEHEKKIAKG

SEQ ID NO: 118713 - protein, 117 aa, Glycine max
  Coding DNA Sequence Number=SeqID_27028
  Gene Ontology: Mol. function=protein domain specific binding; Cellular component=barrier septum; Biological process=G2/M transition DNA damage checkpoint
  Homolog annotation: Hit_ID=A7P1Z4; Match level="QueryCoverage=68%, HitCoverage=30%, E-value=1e-23, Identity=69%"; Hit description =Chromosome chr19 scaffold_4, whole genome shotgun sequence
MVLNISASHICTTRQGNELNAKQIKEYRQKVELELSNICNDVMRVIDEHLIPLAAAGMLKCSACKKGDYYCYLAEFKSGNEKKEAVDQSMKAYELNKAVSGPRSPGVIGERGSRESE

SEQ ID NO: 118714 - protein, 310 aa, Glycine max
  Coding DNA Sequence Number=SeqID_27029
  Gene Ontology: Mol. function=phosphoinositide phospholipase C activity; Biological process=intracellular signaling cascade
  Homolog annotation: Hit_ID=Q2HTA0; Match level="QueryCoverage=70%, HitCoverage=42%, E-value=9e-29, Identity=32%"; Hit description=IMP dehydrogenase/GMP reductase, related
  Pfam annotation: Domain name=DUF1723; Domain location=154-203; Score =58.1; E_value=3e-14; Accession=PF08330.1; Description=Protein of unknown function (DUF1723)
MHGVKDQRIRSCLRSGHWQRCGQRSPTASARRQRVTVTADHVDEPVIPDPDVQDDSMEAPAVVEDIPTDISANTGAEAAEDQPQGFPGGQSDPSVLTAYADHIACSVWTGEECPELKLSSHGRKVHSLGRSVPAIEGLIAGTGLSPLIACSVDTGDRGLLSAFVERWHRETSSFHLPVGELTITLDDVSSLIHLPVIGDLHAFQSLHVDDAVQMLVDLLMVIGQLRLTHIFFTYWVANKSATNVHVVYLEALRDLSMTKRYAWGVAALVHMYDQLNDASMSHSRQLGGYITLLQCWIYEHFPSVAESTAD

SEQ ID NO: 118715 - protein, 71 aa, Glycine max
  Coding DNA Sequence Number=SeqID_27030
  Homolog annotation: Hit_ID=A5C3W9; Match level="QueryCoverage=84%, HitCoverage=14%, E-value=2e-11, Identity=58%"; Hit description =Putative uncharacterized protein
MADTTGRIPPQLLTIVSCDTLLQELAVPHATPLVLCDNLSVVQLAHNPVLHARTKHMELDVFFVREKVLTK

SEQ ID NO: 118716 - protein, 194 aa, Glycine max
  Coding DNA Sequence Number=SeqID_27031
  Gene Ontology: Mol. function=calcium ion binding
  Homolog annotation: Hit_ID=O82062; Match level="QueryCoverage=40%, HitCoverage=23%, E-value=3e-14, Identity=51%"; Hit description=39 kDa EF-Hand containing protein
MGSRNGSGYEAEMVSIFSQIESPDRSLHDHIIEALGKLTVEQRIPYVLSNIVEPALLSQDGSDLDKPVSQETFLEEFKIVTMSVANRRFPVNTHSGDEDEEELTSTMPMRGRSNTTVNTHTRRTKHTIGRSRRRPTNVTKKTHKKTQPSFFERKKKDAKVTNEGHEEATMARKKRNGEEEEEATEIAKKKKWRK

SEQ ID NO: 118717 - protein, 85 aa, Glycine max
  Coding DNA Sequence Number=SeqID_27032
GVDVTIQQCTELVPQGKSKWAVKNKMCPIVVCEEEIKDDVDGCEFPNLDCGVVVEGERDVWGGIYELSKTVSFGGVKVVHIGKEL

SEQ ID NO: 118718 - protein, 202 aa, Glycine max
  Coding DNA Sequence Number=SeqID_27033
MDDEVQHKDIKAPLSHIYLDRFQHQGPPTRDPNLSNDTIARLLRRIHQQGSKFFLFQSGSDFTPRENKRRQPWKQGLVERACDKYVSMLAIRDGHFIQEYTNKIDVLFKDKSEAQNEEKAKEKEDKELLPLALPTPLMQGMGGGYAPSPPPPMGGIGMLMQAPLELVGLGSSSSMDSFASWKMNGSGMEKGRERGDATSRRR

SEQ ID NO: 118719 - protein, 268 aa, Glycine max
  Coding DNA Sequence Number=SeqID_27034
  Homolog annotation: Hit_ID=A5B5G7; Match level="QueryCoverage=85%, HitCoverage=15%, E-value=4e-11, Identity=25%"; Hit description =Putative uncharacterized protein
MASMKRKAPSTPTQAKFDRSRFTSQEAWERYTDIVVLRKIFPKRNAILHHTEFDEFTEELERRNWNKELTNFVDGSIDLAIVKEFYANLYDPEDKPPKLVKVRGCLVKFDVDTLNSFLKTPVILEEGENFLVYSRFCRSKLEPQELAARLCIPGRGFELNADGLPLKILRKNLTTLAQTWSILSFSNLVPTSHTSDITLDTTKLIYGIIQKMDMNLGYIISAQISMIAQHDSSRLGFPALITALWQARGVISDSLTLESLGPAINVAY

SEQ ID NO: 118720 - protein, 103 aa, Glycine max
  Coding DNA Sequence Number=SeqID_27035
MPSIGGLPLLGKEGFMGILQLQEDWARVAGEGPSVLMSLRGSIVLGGYPSNWRLQSPFLLLYSAAIDLQNAKDSIDEEDPRPRSSTWSHINNLAKDLAFNIMR

SEQ ID NO: 118721 - protein, 702 aa, Glycine max
  Coding DNA Sequence Number=SeqID_27036
  Gene Ontology: Mol. function=catalytic activity; Cellular component =nucleus; Biological process=metabolic process
  Homolog annotation: Hit_ID=A5AIJ1; Match level="QueryCoverage=99%, HitCoverage=95%, E-value=0.0, Identity=44%"; Hit description =Putative uncharacterized protein
  Pfam annotation: Domain name=PPR; Domain location=173-207; Score =30.3; E_value=7.1e-06; Accession=PF01535.11; Description=PPR repeat
  Pfam annotation: Domain name=PPR; Domain location=358-392; Score =10.1; E_value=0.5; Accession=PF01535.11; Description=PPR repeat
  Pfam annotation: Domain name=PPR; Domain location=419-453; Score =41.7; E_value=2.7e-09; Accession=PF01535.11; Description=PPR repeat
  Pfam annotation: Domain name=PPR; Domain location=520-554; Score =34.2; E_value=4.9e-07; Accession=PF01535.11; Description=PPR repeat
  Pfam annotation: Domain name=PPR; Domain location=555-589; Score =25.0; E_value=0.00027; Accession=PF01535.11; Description=PPR repeat
  Pfam annotation: Domain name=PPR; Domain location=656-690; Score=5.3; E_value=1.8; Accession=PF01535.11; Description=PPR repeat
  Pfam annotation: Domain name=PPR; Domain location=70-104; Score=21.0; E_value=0.0045; Accession=PF01535.11; Description=PPR repeat
  Pfam module annotation: Pfam domain module=PPR::PPR::PPR::PPR::PPR::PP R::PPR; Domain location=173-207::358-392::419-453::520-554::555 -589::656-690::70-104
MVRAGVKPDECTYTFVPKVRKGREVHGVAFKLGFDGDVFVGNTLLSIYGNCGLFGDAMKVFDEIPEGDKVSWNTVIGLCSLHGFYEEALGFLRKMVAVKPGIQPDLVTVASVLPVCAETEDEVMVRIVHCYAMKVGLLGHVKVGNALVDVYGKCGSEKASKKVFDDIDERNVVSWNPIITSFSFRGKYMDALDVFRLMIDVGMGPNFVTISSMLHVLGELGLFKLGAEVHGSRCFARMLQPYEISIGLKEHSNPVTPKAYTPKSPSGPLPPDSDSSGFLRERKRLQCEGCFSQFRHDIEIPNGENARNSVANMILKFHDDPTVNGFKIVVFLRLNRLEYEAVELVRQMQAKGETPNNVTFTNVLPVCARSGFLNVGKEIHAQIIRVGSSLDLFVSNALTKCGCINLAQNVLNISVREEVSYNILIIGYSRTNDSSESLSLFSEMRLLGMRPDIVSFMGVISACANLASIKQGKEVHGLLVRKLFHIHLFAVNSLFDLYTRCGRIDLATKVFDHIQNKDAASWNTMILGYGMQGELNTAINLFEAMKEDSVEYNSVSFIAVLSACSHGGLIGKGRKYFKMMRDLNIEPTHTHYACMVDLLGRADLMEEAADLIRGLSIVLDTNIWGALLGACRIHGNIELGMWAAEHLFELKPQHCGYYILLSNMYAEAVRWDEANKVRKLMKSRGAKKNPGCSWVQIGDQKP

SEQ ID NO: 118722 - protein, 171 aa, Glycine max
  Coding DNA Sequence Number=SeqID_27037
  Homolog annotation: Hit_ID=A5BV16; Match level="QueryCoverage=32%, HitCoverage=13%, E-value=2e-10, Identity=58%"; Hit description =Putative uncharacterized protein
  Pfam annotation: Domain name=RVT_2; Domain location=81-169; Score= -180.2; E_value=0.0082; Accession=PF07727.5; Description=Reverse transcriptase (RNA-dependent DNA pol
MGSKIYPKVHESPRAFFSSSSPILLEPLAHGSGYEPAEDWNVIFYEDCFSFIGQNKPDPVTILPIPHNSIDQSNGVSSESPVDHIMHVPNNTNSDPLTLEQSSNRTRRSLRQAHRPQLYGLKQASRQWYARLSFFLISHGYKQCASYHSLFLKHGFNTIIALLVYVDDIAL

SEQ ID NO: 118723 - protein, 119 aa, Glycine max
  Coding DNA Sequence Number=SeqID_27038
MKDGDVIDGLRNMSENLSICSSCEWTSLKKQVQALTLKNSTLEDRVTHLDSALKECVRQLRQTRTTLLVTSILKSAIDEWIAQKKANHQGRGRGRGRGIPYALQLNLPQRSNQKPKKRK

SEQ ID NO: 118724 - protein, 104 aa, Glycine max
  Coding DNA Sequence Number=SeqID_27039
MVAGHTTATEALISEAPELRCWKVTTMLDSVIEVGATRVMVKCGESDNGETRGTGTREMARKPRQDFSVSKVRFFSLFVAEYESQSKGKVSPSCSTQMETCGIA

SEQ ID NO: 118725 - protein, 82 aa, Glycine max
  Coding DNA Sequence Number=SeqID_27040
MVFFPRLYTKLPRRSEAFQSCTMALTQHLQGFLGIIKLKANLRKVESFLNFTLNANITLASANAYLKGRVSNFEGEMKGLET

SEQ ID NO: 118726 - protein, 64 aa, Glycine max
  Coding DNA Sequence Number=SeqID_27041
MGKEEKKPEENKVEEKKAEEEEKKEEEKKPEESKDDKEFKEESAPPEIVQGTAFAMHGHFKHDF

SEQ ID NO: 118727 - protein, 98 aa, Glycine max
  Coding DNA Sequence Number=SeqID_27042
MHGGKEREESKEFSNCVVLNSLTREKGDTKEFRRLVLCSFGKGRRDTQKEFRRLVLGEFFLAKGEENEKMNSTSFQGLENQKAFGTKKKKKFKETQGL

SEQ ID NO: 118728 - protein, 55 aa, Glycine max
  Coding DNA Sequence Number=SeqID_27043
MSERIGPCCWDLLHQRSTCPEWCILWDQWEALACGWRRGIWWRRQRGGDAEVAVQ

SEQ ID NO: 118729 - protein, 111 aa, Glycine max
  Coding DNA Sequence Number=SeqID_27044
  Gene Ontology: Mol. function=nucleic acid binding; Cellular component= cytoplasm; Biological process=mRNA metabolic process
  Homolog annotation: Hit_ID=Q00M91; Match level="QueryCoverage=73%, HitCoverage=16%, E-value=8e-31, Identity=69%"; Hit description =Poly(A)-binding protein
  Pfam annotation: Domain name=RRM_1; Domain location=1-63; Score=5.7; E_value=0.044; Accession=PF00076.13; Description=RNA recognition motif. (a.k.a. RRM, RB
MEKAKIIKTSLRLNTISQNLHKHDVATQQSLGYSYVNFSNSHDAAKAIDVLNFTPLNGKIIRIMYSIRDPSAQKSGATNVFIKEFGQDASGQSKGHGFVKFKSEEFVGFND

SEQ ID NO: 118730 - protein, 79 aa, Glycine max
  Coding DNA Sequence Number=SeqID_27045
MELIENMTASDHAILRDRTHNMLLAKQLESLPETLSKLPTQLQAAQSSHSVIIQVGVVVFMEELMNLTVVYPKMMLLKK

SEQ ID NO: 118731 - protein, 70 aa, Glycine max
  Coding DNA Sequence Number=SeqID_27046
  Subcellular localization annotation: CTP_CleavageSite=14; ConfidenceScore=5.02e-01
MASPLSLPYPFYFHSSSKKQRNPLMKKILGLQAPMELTSEVLSLFSLLQHIPGLSGAGSKIMYSKAGFRT

SEQ ID NO: 118732 - protein, 188 aa, Glycine max
  Coding DNA Sequence Number=SeqID_27047
MANEHQQRVTLEDYSSSSVLQFFTCIAHPEGNLFQGLPNEDPYAHLATFIEICNTIKITGGKIKLKTPEEATELIENMSASDHAIMRNRVHQPTKKSLLQVVPSMVRLMKQASAFPLKKTLKKFTIWEINRDKDILKEDFRASSRVLIINKDSGEKNPKEECKAVMTKSKRFMEAEDEDSVVSKKKAV

SEQ ID NO: 118733 - protein, 77 aa, Glycine max
  Coding DNA Sequence Number=SeqID_27048
MVADVEVAVVHLRSAAAASHAPVVVPALACKLAETYDQCWESQCHVGLFWVHWVSRRCDTYKLVDGIRDKLCYMKRR

SEQ ID NO: 118734 - protein, 313 aa, Glycine max
  Coding DNA Sequence Number=SeqID_27049
  Gene Ontology: Biological process=response to desiccation
  Homolog annotation: Hit_ID=A9PFS2; Match level="QueryCoverage=99%, HitCoverage=98%, E-value=1e-144, Identity=79%"; Hit description =Putative uncharacterized protein
  Pfam annotation: Domain name=DUF1511; Domain location=62-168; Score= -26.6; E_value=0.027; Accession=PF07427.2; Description=Protein of unknown function (DUF1511)
  Pfam annotation: Domain name=LEA_2; Domain location=27-182; Score =249.5; E_value=7.5e-72; Accession=PF03168.4; Description=Late embryogenesis abundant protein
  Pfam module annotation: Pfam domain module=DUF1511::LEA_2; Domain location=62-168::27-182
MSTSDKSEVVERGAKDDEKPKEEHEKGGFLDTVKDFIQDIGEKIEGAVGFGKPTADVTGIHIPSINLEKAELVVDVLIKNPNPVPIPLIDINYLVESDGRKLVSGLIPDSGTIHAHGEETVKIPLTLIFDDIRNTYDDIKPGSIIPYRVKVDLIVDVPVFGRLTLPLEKTGEIPIPYKPDIDLDKIQFERFSFEETVAILHLKLDNKNDFDLGLNALDYEVWLGDVSIGGAELAKSAKLVKSGISDIDVPITFRPKDFGSALWDMIRGRGTGYTFKGHIDVDTPFGAMKLPITKEGGTTRLKKNEDSGDDEVC

SEQ ID NO: 118735 - protein, 198 aa, Glycine max
  Coding DNA Sequence Number=SeqID_27050
MANNICSFGQLSSASSALLVELVIEIPQMLRFDDFPYDLCIIPLLSPLLLLYSFHNIPWLITNTLSSRCWDLKSRPRNNLMAQFKNKIAKTRATKGTHQIEEILLLHGLKKKPQEGARVVNSSLHGEDLDGQTSLPMKCKPALTVVVVEAMASVVVVEVTAADTVVMGGMQGRSQGAQGGVVRQHAEHYETRDSLFGS

SEQ ID NO: 118736 - protein, 58 aa, Glycine max
  Coding DNA Sequence Number=SeqID_27051
MSLEEAHHHRRPWIRAWRKKEMNEGRGREEHEILCSKRALKSEPTNPRSIPRFSTKCA

SEQ ID NO: 118737 - protein, 478 aa, Glycine max
  Coding DNA Sequence Number=SeqID_27052
  Gene Ontology: Mol. function=phosphoprotein phosphatase activity
  Homolog annotation: Hit_ID=A2Q4S5; Match level="QueryCoverage=69%, HitCoverage=61%, E-value=2e-33, Identity=29%"; Hit description=IMP dehydrogenase/GMP reductase, putative
  Pfam annotation: Domain name=DUF1723; Domain location=78-127; Score =64.3; E_value=4.1e-16; Accession=PF08330.1; Description=Protein of unknown function (DUF1723)
MRADAQGADSGEGSDGDDAVEGFPGGPRDPSVLTSFAEHVAHAVWSGHVTLIGRPVPEIEGMVATTGLSPLIDCSVITGDPGLISAFVERWHSETSTFHLPVGELTITLDDVSSILHLPITGALHSFHALSTEEARFLLTELLEVSAEEARAETALTRGAYVRLGWVRDIYETRCQARQWIVAARAYLLHLVGVAALVHMYDQLDEACRTTTRQLAGYLTLLQCWIYEHFPSVHQCVTDDTYQETSPCASRWLTSKAHMKGITGAPYRARCDGLTVTDVSWLPYTEHRGVRAFQEISSFQGQLRWGPMIVTVRPERVVRQFGYIQSIPPPPVSARLSHDQIDDKWMEFADHLLPAGQLCLVPGQVSADYIEWFFRISHPFMTPTQAADQQRDAPAADPEDYIQLPSPQVPVAFDPPPHVDDYEGYGAIAQRLECVLNLRIVTAGTELYDIMQDCLTIARGGSSADETVRARQRRRTDH

SEQ ID NO: 118738 - protein, 49 aa, Glycine max
  Coding DNA Sequence Number=SeqID_27053
  Homolog annotation: Hit_ID=A3C5Q0; Match level="QueryCoverage=53%, HitCoverage=6%, E-value=5e-07, Identity=88%"; Hit description =Putative uncharacterized protein
MVLCKSYPSEFVSYFHYCSSLQFEDKPFINRFPSMCSCHLLIKIRREKN

SEQ ID NO: 118739 - protein, 58 aa, Glycine max
  Coding DNA Sequence Number=SeqID_27054
METTKKERGVVVVNGALVVPLGLLSEGSQELGWNGERGFEKPRVLLRESHTEKEKYNM

SEQ ID NO: 118740 - protein, 181 aa, Glycine max
  Coding DNA Sequence Number=SeqID_27055
MEVDYATHYPWAKEEVIKARSMYYDWPSLERVRDDFVLTIDGYDENVIIKPCLVSELAYTDTDTDTDKGMRIILCYIFEIVLSKLGIRFPLTEFESGMLLMLNVASTQLHPNSWAFVKVFLLPCKIFGLTLTITPMKGALAHNAEVLDRFPKYWTSNPQNYGNLDLERMLDAEQAGIEDIK

SEQ ID NO: 118741 - protein, 423 aa, Glycine max
  Coding DNA Sequence Number=SeqID_27056
  Gene Ontology: Mol. function=metal ion binding
  Homolog annotation: Hit_ID=A7PFZ8; Match level="QueryCoverage=98%, HitCoverage=99%, E-value=1e-113, Identity=52%"; Hit description =Chromosome chr6 scaffold_15, whole genome shotgun sequence
  Pfam annotation: Domain name=F-box; Domain location=48-95; Score =43.8; E_value=6e-10; Accession=PF00646.24; Description=F-box domain
  Pfam annotation: Domain name=Kelch_1; Domain location=143-181; Score =1.6; E_value=2; Accession=PF01344.16; Description=Kelch motif
  Pfam annotation: Domain name=Kelch_1; Domain location=183-225; Score =46.8; E_value=7.4e-11; Accession=PF01344.16; Description=Kelch motif
  Pfam annotation: Domain name=Kelch_1; Domain location=227-293; Score =6.1; E_value=0.57; Accession=PF01344.16; Description=Kelch motif
  Pfam annotation: Domain name=Kelch_1; Domain location=363-410; Score =4.5; E_value=0.89; Accession=PF01344.16; Description=Kelch motif
  Pfam annotation: Domain name=Kelch_2; Domain location=183-225; Score =27.1; E_value=6.4e-05; Accession=PF07646.6; Description=Kelch motif
  Pfam annotation: Domain name=Kelch_2; Domain location=227-293; Score =4.3; E_value=14; Accession=PF07646.6; Description=Kelch motif
  Pfam annotation: Domain name=Kelch_2; Domain location=363-410; Score =2.0; E_value=26; Accession=PF07646.6; Description=Kelch motif
  Pfam module annotation: Pfam domain module=F-box::Kelch_1::Kelch _1::Kelch_1::Kelch_1::Kelch_2::Kelch_2::Kelch_2; Domain location=48 -95::143-181::183-225::227-293::363-410::183-225::227-293::363-410
MGSDRERESCNSRHFAWLMKSCFPNPNDAVAKLASPPQSHRNSPVPATTISSLPDDIVLDCLSRVPTSSLPALSLVCRRWSRLLSSPDFSDLRRHRLLLRHTAVAIAGTNLGLSSATLLDGAWHPSLFVPCYDAHSLDNFHSLLAHARACSVGPRIYLVGRNNTLLYDTWTATVSTRASMIFPRKKFALAAVGGKIYVSGGSSGTSAVEEYDPETDTWSVVCNAPRKRYGCLGTSFQGVFYVIGGLRIGATEQNLPNLFPRASRGVEAHAAYASSMDLFDVEARVWLRSRTVPGGGCVVAACAAVGCVYVLTSHAVELSFWSFHARRKNHNNYNGNDNYNNNVFGEWCRIKSPPLPAQVRVDSRIRFSCVGIGDKVILIQSLNEVRGVKEGFVFVYDCVAEEWGRGVDLPEVYRRAAYVGVEC

SEQ ID NO: 118742 - protein, 133 aa, Glycine max
  Coding DNA Sequence Number=SeqID_27057
LETCRKSKGSIVMQSVKFRNMPEIKRKYCYAIREIPMFLQKAFASGGSNLARLGELGGKLLPYFPINRGRSEGERGSTLLVLHNHLKLVRKIVSVKKIQAEALPKRFRNIFVGDFTKIFNRSSSFVVRSSVFN

SEQ ID NO: 118743 - protein, 119 aa, Glycine max
  Coding DNA Sequence Number=SeqID_27058
MDVEEDHEVPVILGRPYMSTATCIIDMGKKTLEMGFEDQKINFDLFEENKSVPEHNICFPFAKHKPRAKRIFCHVLSGESLALSTQPLHLKLIWSAKLAKAKLSPFQFDLNSAKRWPAH

SEQ ID NO: 118744 - protein, 189 aa, Glycine max
  Coding DNA Sequence Number=SeqID_27059
MSTSSLSPCFDIKFGSFEGFPKGVANTYGGTTDECNSTVEPRKDDEAKEVSEVEGLHSGVEAVVDYKGWQCQAHVVESFVVVTKAKANCPSFETMNMPSLSIQFILEPFITPGETLPKYSQLNKLCTREKRYPCKSKDFAFDVLMMPYDRDVLMPYENALLKFNSRQKFKNTRYNIKKISSVFRKGIPN

SEQ ID NO: 118745 - protein, 125 aa, Glycine max
  Coding DNA Sequence Number=SeqID_27060
  Subcellular localization annotation: CTP_CleavageSite=41; ConfidenceScore=5.26e-01
MTESSKKRKGSSSTTAVVGHHRHGPSEAPTTPIHPSLSSPRSSTLFSLDDQRLWYNSQFSSRIILDPKSLDTNFFNDETFDCYQVFQNSGLVDFMSLKLPYYPKIVKVFYSNLKIQDGIISSEVD

SEQ ID NO: 118746 - protein, 204 aa, Glycine max
  Coding DNA Sequence Number=SeqID_27061
TLEDYSSSTVPQFFTSIAQPEVQAQTITYPPSLIQMTQNNLFHGLSNEDPYAQLATYIEICNTIRLAGEIVAKSLGNQFNRDQGGSSTRPQQQMPSLYDRTTKLEETLAQFMQVSMSNQKSTESAIKNLEVQLAERPSDNFIVNTEKNPKEECKAVMTRSKMAIQAEESRADQKVEGFKQQLADELALKPVDDLVELEEIVEEA

SEQ ID NO: 118747 - protein, 154 aa, Glycine max
  Coding DNA Sequence Number=SeqID_27062
  Homolog annotation: Hit_ID=A5BSP7; Match level="QueryCoverage=54%, HitCoverage=6%, E-value=2e-07, Identity=30%"; Hit description =Putative uncharacterized protein
  Pfam annotation: Domain name=zf-CCHC; Domain location=81-98; Score =22.5; E_value=0.00059; Accession=PF00098.14; Description=Zinc knuckle
MAHPRPHSHWREKERKPQEANINLLYFHGKDNVEANLDWEIRKDQGQAILGVTPSKPKDDKGKAIENQPLKASMQEKTSSVKCFKCLGRGHITSQCPTKKTMIMRCQEIYSSQDKATTSPSSSKSEVAKREESSKEIYPQEEGQPLIVKEECKE

SEQ ID NO: 118748 - protein, 36 aa, Glycine max
  Coding DNA Sequence Number=SeqID_27063
MEALNISHTFCGGPFLDGLEGGSPGGISLENISPNS

SEQ ID NO: 118749 - protein, 139 aa, Glycine max
  Coding DNA Sequence Number=SeqID_27064
  Homolog annotation: Hit_ID=Q2QPM1; Match level="QueryCoverage=23%, HitCoverage=21%, E-value=4e-10, Identity=82%"; Hit description =Putative uncharacterized protein
MTTRNGQIKISLRFRPQHPAAHVRHEAADAESAPMPLAMPCLVPRHGGGQKGEGCEGGLVIHTSALAGPGVPVKGASAYPGNAAARDNPPIHSQRGGWHYWQRPSGENAAGAKRGRPVPGEHSIGRKGSQDGGRARGGR

SEQ ID NO: 118750 - protein, 231 aa, Glycine max
  Coding DNA Sequence Number=SeqID_27065
  Pfam annotation: Domain name=Rep_fac-A_C; Domain location=69-176; Score=-60.9; E_value=0.02; Accession=PF08646.1; Description =Replication factor-A C terminal domain
MCYLCDCNFKLLNILLDLGIEVRSVLTPIGQGSSQVLGSSQLSSKDAFLSKAEVKNISQINAICEEIIYVTVAKITTIVVDNYSWCYPACGQCYKKTDIETVRFTCPCGKENDQPVLRLLSIFILLFPRKDDDVDLNASPQALDRLLGCFLAFKVKVQPRFRNVVVLKYSDESNLINVVLDMLPDSEPCCKIESSILESTDPTELEYQSVSVTADDDRSMLDSTEPTELES

SEQ ID NO: 118751 - protein, 61 aa, Glycine max
  Coding DNA Sequence Number=SeqID_27066
MSPDFTGQDDNGVEDDMLTSPERVQMTTLVSACQSDLGSPNDEVRIIVRCLRILPDSWVAG

SEQ ID NO: 118752 - protein, 66 aa, Glycine max
  Coding DNA Sequence Number=SeqID_27067
  Homolog annotation: Hit_ID=Q2HST2; Match level="QueryCoverage=93%, HitCoverage=12%, E-value=4e-09, Identity=45%"; Hit description =Peptidase aspartic, active site
MELASHNKALHASVKCLDYIVAKMVIKNGSSLDGMPKATLDKFPFNASHLRPSSMVVQAFEGSRRD

SEQ ID NO: 118753 - protein, 93 aa, Glycine max
  Coding DNA Sequence Number=SeqID_27068
  Subcellular localization annotation: CTP_CleavageSite=5; ConfidenceScore=5.18e-01
AVHVSSTIESGHPRIHCLAMFMCPPPTTLFMCPPPTSLEPRESLPSAVRNFSILNFIRRPMNSLPSAVHVSSTIESGHPRIHCLALFMCPPPT

SEQ ID NO: 118754 - protein, 171 aa, Glycine max
  Coding DNA Sequence Number=SeqID_27069
  Gene Ontology: Mol. function=transmembrane receptor activity; Cellular component=intrinsic to membrane; Biological process=innate immune response
  Homolog annotation: Hit_ID=A7QQ44; Match level="QueryCoverage=78%, HitCoverage=15%, E-value=1e-36, Identity=61%"; Hit description =Chromosome chr2 scaffold_140, whole genome shotgun sequence
MANDGDKSDSNSSYSLHHSDHPGMVLSAHVQPLVNGLTELQLQQILSIMQDNGASQSATPKANNFNFSSSLSVPKLIIDSGTKNHITSPSLLVNNKENSSLPPVVMPNGDQAPIISTGNLPLSPIICLKNVLGVPSCKVDLMFDLMMGMTIGLREQRDGLYYLVSMNKTHK

SEQ ID NO: 118755 - protein, 151 aa, Glycine max
  Coding DNA Sequence Number=SeqID_27070
MPLPSEEYTSSLLEGYTPSPFRGLHALTFKGLHVLALRVLHALAFRGLDVLTFRGLHALTFKGRHVLNFRGLHALAFRGLHTLAFKGRHVLNFRGLHALAFKGLRVLAFITGPPPDPGGGPTMRAQPEREAITRLLCIPGQDSTRAAAKRR

SEQ ID NO: 118756 - protein, 91 aa, Glycine max
  Coding DNA Sequence Number=SeqID_27071
MGRRESIFRKVGRSLSTFVNKIEPKTSYELGSRTSSELSIILCRAYQSIRVMGHLTGAYNPKGERTRGKVMLTQFPGLGLGSVFEKDNFLD

SEQ ID NO: 118757 - protein, 188 aa, Glycine max
  Coding DNA Sequence Number=SeqID_27072
  Subcellular localization annotation: CTP_CleavageSite=24; ConfidenceScore=5.08e-01
MFAHSIKGCRPLGRACGVLIPSPCVNTTPEPLNLKIRRSRLFRFFRRFPQINVGGDSARIPFVEHASRESRVALPPKGRLRHISFDHSEHSITGESMHSVIGDFEHPDLEHYNFEHSDSEHSDFAHSENMAQSPPCERTLREMAAPDFTYESLCIQYPDEDVPYVLKTGLIHLLPKFMALQVKTRTNI

SEQ ID NO: 118758 - protein, 61 aa, Glycine max
  Coding DNA Sequence Number=SeqID_27073
MQEQLYMELVGLGSSSSMESFASWISMAVEWRRKKDDWRCHFKEKMSQEKAHHRRKPWIRA

SEQ ID NO: 118759 - protein, 222 aa, Glycine max
  Coding DNA Sequence Number=SeqID_27074
  Gene Ontology: Mol. function=nucleoside-triphosphatase activity; Cellular component=intracellular; Biological process=regulation of transcription, DNA-dependent
  Homolog annotation: Hit_ID=A4WAU7; Match level="QueryCoverage=100%, HitCoverage=45%, E-value=4e-85, Identity=71%"; Hit description =Transcriptional regulator, TyrR
  Pfam annotation: Domain name=ACT; Domain location=1-63; Score=24.5; E_ value=0.00039; Accession=PF01842.16; Description=ACT domain
MRLEVFCEDRLGLTRELLDLLVLRSIDLRGIEIDPVGRIYLNFAEIEFNTFSSLMAEIRRIAGVTDVRTIPWMPSEREHLALSALLEAMPEPFLSLDLKSKVERVNHASCQLFAQSQEKLSNQHAAQLVPGFNFQRWLDSNPQNTHSEHVVINGQNFLMEITPGLSERGKRHSRTNRLQNLSSQDVGAFSQIIAVSPKMRHVVDQARKLASLTAPLLITGDT

SEQ ID NO: 118760 - protein, 219 aa, Glycine max
  Coding DNA Sequence Number=SeqID_27075
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=99%, HitCoverage=34%, E-value=1e-120, Identity=83%"; Hit description =Photosystem I P700 chlorophyll a apoprotein A2
  Pfam annotation: Domain name=PsaA_PsaB; Domain location=1-218; Score=- 135.0; E_value=0.00021; Accession=PF00223.10; Description=Photosystem I psaApsaB protein
MTGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRGGNVSQFNESSTYLMGWLRDYLWLNSSQLINGYNPFV

SEQ ID NO: 118761 - protein, 249 aa, Glycine max
  Coding DNA Sequence Number=SeqID_27076
MAPRKLASKRSRKDAAAAGTSAAPEFDSHRFRSAEHQQRFEAIKGWSFHRERRVQLRDDEYTDFQEEIARRCWTSLVTPMAKFDPDTILEFYANAWPTEEGVRDLRSWEGQECEYGQRRNRADGFDEEAIAQLLCIPGQDFARTAAGRRVRIMRTNMTTLTQTWMTLLLSNILPSDHNSDLPLPKCQLVYSILTRMSVHVAQLIADAIYLFAGMPPTRHPLDPDKSNRALGFPALITGLCQSFGFLSHL

SEQ ID NO: 118762 - protein, 194 aa, Glycine max
  Coding DNA Sequence Number=SeqID_27077
  Gene Ontology: Mol. function=transporter activity; Cellular component= membrane; Biological process=transport
  Homolog annotation: Hit_ID=A4WBT1; Match level="QueryCoverage=100%, HitCoverage=63%, E-value=2e-98, Identity=92%"; Hit description=Inner- membrane translocator
  Pfam annotation: Domain name=BPD_transp_2; Domain location=1-178; Score=-16.1; E_value=0.0011; Accession=PF02653.7; Description =Branched-chain amino acid transport system  permease component
MSLILQNYAQLSQGPRQQGVPTMLDGVIRLHLGDGFVQITYTKVFILLASFTGMLVLTWIINHTRLGRMCRAVQQDRKMASILGINTDRIISLVFVIGAAMAGLAGVLITMNYGTFDFYVGFVIGIKAFTAAVLGGIGSLPGAMLGGLILGVAEAQFSGMVNSDYKDVFSFGLLVMILIFRPQGLLGRPIVAKV

SEQ ID NO: 118763 - protein, 231 aa, Glycine max
  Coding DNA Sequence Number=SeqID_27078
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=88%, HitCoverage=52%, E-value=2e-92, Identity=71%"; Hit description =Photosystem II 44 kDa reaction center protein precursor
  Pfam annotation: Domain name=PSII; Domain location=1-231; Score =170.0; E_value=6.3e-48; Accession=PF00421.10; Description =Photosystem II protein
MTTILGIHLILLGIGAFLLVFKALYFGGWIGSVDDLEDRVGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTDLSRLKKDIQPWQERRSAEYMTHAPLGSLNSVGGVATEINAVNYVSPRSWLATSHFVLGFFLFVGHLWHAGRARAAAAGFEKGIDRDFEP

SEQ ID NO: 118764 - protein, 103 aa, Glycine max
  Coding DNA Sequence Number=SeqID_27079
  Subcellular localization annotation: CTP_CleavageSite=72; ConfidenceScore=5.80e-01
APVASVSISCPPVQLLTGWCVTAKSNRRTSALASVAVTLRVTTTPAALNAPLQGASHSPFRLRNCWEGRSVRASSLLRQLAKGGCAARRLSWVTPVFSPVTTL

SEQ ID NO: 118765 - protein, 80 aa, Glycine max
  Coding DNA Sequence Number=SeqID_27080
MKLARMQRKEKTGKSWFVELVVAARIWFVEVVVIGRAVWDFTRARKLVMQSYPARPLDRKLEVDWARDTREGPRILMSLT

SEQ ID NO: 118766 - protein, 72 aa, Glycine max
  Coding DNA Sequence Number=SeqID_27081
MGVQIAPRPIWALQKIPPEGGCFWRKQPCSPGRAELAWASWAATTSPIFAINRGGRQEGRENLSRGASETFP

SEQ ID NO: 118767 - protein, 181 aa, Glycine max
  Coding DNA Sequence Number=SeqID_27082
  Homolog annotation: Hit_ID=A8GEG9; Match level="QueryCoverage=62%, HitCoverage=47%, E-value=4e-23, Identity=52%"; Hit description =Putative uncharacterized protein precursor
  Pfam annotation: Domain name=DUF1120; Domain location=2-179; Score= -12.9; E_value=2.7e-08; Accession=PF06551.3; Description=Protein of unknown function (DUF1120)
MMNKMMKTACALAVLAASANVMAESIELKVIGTITPPACKPMLAGSGTVDFGTIAPASLSKDNYTVLADKETTLNIVCDAPAKVAIKAVSGRKNTTLSDGAEGTNGAAKPLVNLGQSADFGVAGLGMDGEKKIGAYGVVVSDVVVDGVNGRPIKSEDKQTWSDSNANGLYQASGNDNFITW

SEQ ID NO: 118768 - protein, 118 aa, Glycine max
  Coding DNA Sequence Number=SeqID_27083
  Gene Ontology: Cellular component=mitochondrion
  Homolog annotation: Hit_ID=Q5MA28; Match level="QueryCoverage=60%, HitCoverage=69%, E-value=2e-29, Identity=88%"; Hit description =Putative uncharacterized protein orf108
MSPEQFQYIWRKTIPHIEVGMGSGVFTSHRSARPHSSKLAPLGEEGFSIAKDSIQPQVPLRLPCYDFTPVEDPTVVCANKTTKSLCGTSGTQKSWVIIGPMLRAKPIAGCDGRCVQGP

SEQ ID NO: 118769 - protein, 311 aa, Glycine max
  Coding DNA Sequence Number=SeqID_27084
  Homolog annotation: Hit_ID=Q6WAY6; Match level="QueryCoverage=31%, HitCoverage=17%, E-value=2e-12, Identity=38%"; Hit description =Putative uncharacterized protein
EGKEGVLFSCGRYPNIPLVGTRGCINYNPALAMRQLGYSMRGAPTEESMSPFLVRDFGAQNSKTIQRIHKAWETPLRKDQELRGIRNGIIGGYHEWLKVRIRGLGWLAKLKVVSEENFEAPEEDEEVQALKSELGKAKLAKEKFKLAATHVRKECAGLREENAITARALEQETKRARKEEYGRNKFRGALWGSNNELKLRREERDQSKRSLSQRLCETETNMLAIIAKYQEELGLATAHEHRIADEYAQVYAEREARGRVIDSLHQEATMWMDRFALTLNGSQELPRLLAKAKAMADTYSAPEEIHGLLGY

SEQ ID NO: 118770 - protein, 209 aa, Glycine max
  Coding DNA Sequence Number=SeqID_27085
  Gene Ontology: Mol. function=phosphoprotein phosphatase activity; Biological process=intracellular signaling cascade
  Homolog annotation: Hit_ID=A7R8Y3; Match level="QueryCoverage=97%, HitCoverage=62%, E-value=9e-33, Identity=37%"; Hit description =Chromosome undetermined scaffold_3090, whole genome shotgun sequence
MCNATDYKTKSIGGMCILLQMWAWERCPTLAPKRTPSQVENTSLGHRWLRRGNQHIGNDDVRVFRRKLDIMKRHEFVWEHPSTVISLLPPVCLVGSLAWYAVVPLICFQVIEWHQPDRVLRQFGMQQPIPESPSQPLNIHGITLKGKHDENWGQLFAPMIHKWNNRHAFRVVAYPRQEGLLSFNSDYMVWYRQKTKMFVDPQNAKTATL

SEQ ID NO: 118771 - protein, 40 aa, Glycine max
  Coding DNA Sequence Number=SeqID_27086
MELERLIKRLSDSGIDDADRSCRSELLHSSRSMETGGAES

SEQ ID NO: 118772 - protein, 110 aa, Glycine max
  Coding DNA Sequence Number=SeqID_27087
MQSSDKSPSKRKPLVIHFTRDITTQIPRGFQLSVAKMLVLVPYKSDKAVPWRYGIQGFNGRQDMSVMRVGTSMPAAKITNIFGTSGMTRSGCIFAPPEPRQGQKTRGRQR

SEQ ID NO: 118773 - protein, 83 aa, Glycine max
  Coding DNA Sequence Number=SeqID_27088
MRVHPEEPARTLQQPVEWILPTPTPYRLVEPVQVIEVSSSEEDPEEDPEEYLLSPAVDALDFPEDDEDPLPDVDSLRGYHVSI

SEQ ID NO: 118774 - protein, 81 aa, Glycine max
  Coding DNA Sequence Number=SeqID_27089
MAPKKLSAKRSRRDATGEGSSAASEFDSHRFRSVKHQRRFEAIKGWSFHRERRVQLREDEYTDFQEEIARKRWTLLVTPTA

SEQ ID NO: 118775 - protein, 63 aa, Glycine max
  Coding DNA Sequence Number=SeqID_27090
MFAHSIKGCRPLGRTCGVPIPSPYEGRFFEDPNNEGLTIDFDRDIRQTINEEEEEDVLSPELE

SEQ ID NO: 118776 - protein, 152 aa, Glycine max
  Coding DNA Sequence Number=SeqID_27091
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=72%, E-value=2e-24, Identity=70%"; Hit description=LacZ protein
MEARKCLIRLVPICVGFLIWCLQVRNQLGISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYRTT

SEQ ID NO: 118777 - protein, 280 aa, Glycine max
  Coding DNA Sequence Number=SeqID_27092
MSPFLVRDLGAQNSKTIQRIHKAWETPLRKDQELRGIRNGIIGGYHEWAETKRILKHRKRTKKVQALKSELGKAKLAKEKFKLAATHIRKECAGLREENAITAKALEQETKRARKEEYGRNKFRGALWGSNNELKLRREERDQSRAHSMVLKEELMACSKSKRSLSQRLCETETNMLAIIAKYQEELGLATAHEHRITDEYAQVYAEKEARGRVIDSLHQEATMWMDRFALTLNGSQELPRLLAKAKAMADTYSAPEEIHGLLGYCQHMIDLMAHIIRNR

SEQ ID NO: 118778 - protein, 99 aa, Glycine max
  Coding DNA Sequence Number=SeqID_27093
AEFDIPKASDGRTKKKVLQTVSERWRQFKFGLTRKWALAADKDSVDDTVREKYSISKEKLAQFCQTLRDPSWEDVWKKAQAIQKQNTAPHVLSCGGYEY

SEQ ID NO: 118779 - protein, 346 aa, Glycine max
  Coding DNA Sequence Number=SeqID_27094
  Homolog annotation: Hit_ID=Q84VH5; Match level="QueryCoverage=100%, HitCoverage=50%, E-value=1e-127, Identity=71%"; Hit description =Envelope-like protein
MATSPKETSAPGSPSVPSSPSSTKAPSIQEQPEFHIQPIQMIPGQAPVPEKLVPKRQQGVKISENPSLATSPREVDTEMDKKIRSIVSNILKNASVPDADEDVPTSSTPNASVPDVEKDVPTSSAPNAEAVPSPSEEESTEEEDQAAEETPAPRAPEPAPGDLIDLEEVESDEEPIANRLAPGIAERLQNRKGKTPLKRSGRIKTMAQKKSTPITPATSRRSKVAIPSKKRKEISSSDSDDDVELDVSTSKRAKTSGKKVPGNVPDAPLDNISFHSIGNAERWKFVYQRRLALERELGRAALDCKETMDLIKAAGLLKTVTKLGDCYEGLVREFIVNIPSDISNRK

SEQ ID NO: 118780 - protein, 287 aa, Glycine max
  Coding DNA Sequence Number=SeqID_27095
  Gene Ontology: Mol. function=transporter activity; Cellular component= integral to membrane; Biological process=ion transport
  Homolog annotation: Hit_ID=A8GBS2; Match level="QueryCoverage=95%, HitCoverage=74%, E-value=1e-148, Identity=91%"; Hit description =Porin Gram-negative type precursor
  Pfam annotation: Domain name=Porin_1; Domain location=1-287; Score =436.9; E_value=2.7e-128; Accession=PF00267.12; Description=Gram -negative porin
MLTGYGQWEYQIAANHTESDGTKDTKTRLGFAGLKYKDLGSFDYGRNYGIIYDVGAWTDMIPEFGDDAYIKTDNFMNGRTNGVATYRNNNFFGLVDGLKFAVQYQGKNENDGRSASKANGDGWGLSSSYEIIDGLSVGAAYASSNRTTTQKAGTFGKGDKADIWAGGLKYDNNNVYLAATYSQSRNIAPISGTATINNNATSVSGFANKAEGIELVAQYQFDFGLRPSLGYVQQKGKDIEGIGDVDLVKYFDVAATYYFNKNMSTYVEYKINQLDDDNKLGLKNDDV

SEQ ID NO: 118781 - protein, 170 aa, Glycine max
  Coding DNA Sequence Number=SeqID_27096
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
  Subcellular localization annotation: CTP_CleavageSite=10; ConfidenceScore=5.19e-01
MKHFTDTLISANIVSQYTLPLAPNTQTASPRALADSLMQLARQVSRLESGHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 118782 - protein, 36 aa, Glycine max
  Coding DNA Sequence Number=SeqID_27097
TEAYTVAKECPSIARSYIGQPTIGHRSRRRRRMDGH

SEQ ID NO: 118783 - protein, 255 aa, Glycine max
  Coding DNA Sequence Number=SeqID_27098
  Gene Ontology: Mol. function=motor activity; Cellular component=cell projection
  Homolog annotation: Hit_ID=UPI00016621D1; Match level="QueryCoverage =96%, HitCoverage=40%, E-value=5e-24, Identity=36%"; Hit description =UPI00016621D1 related cluster
LHALTFRGPHVLTFRGLHALAIRGPHVLTFRGLHALAIRGLHVLTFVGLHALTFRGLHVLAFVGLHVLAFVGLHALTFVGLHALTFRGLHVLAFVGLHALTFRGPHVLTFRGLHTLAIRGLYVLTFVGLHALTFRGLHVLAFVGLHALTFVGLHALTFRGLHVLAFVGLHALTFRGLHVLANRGLHALTFRGLHVLAIRGLHALTFRGLHALAIRELHVLTFVGLHALTFRGLHVLTQTEGCSPSPSKGCTPSPL

SEQ ID NO: 118784 - protein, 151 aa, Glycine max
  Coding DNA Sequence Number=SeqID_27099
  Homolog annotation: Hit_ID=A8P6U5; Match level="QueryCoverage=16%, HitCoverage=40%, E-value=2e-07, Identity=96%"; Hit description =Putative uncharacterized protein
MPPTVPVNHYSDPEGQHNRIRILWCYPMLITGGTTRPVKGQERIAGRRDEPTGAHRSGPIDPTQGPTTSFYCNNLNIRYELEYRGCWHQTALQWILVKGFRLYSFQLPDSMSPVLLFIVTTSPCQDWVICAPAAFLGCGSRFSGSLSGIEP

SEQ ID NO: 118785 - protein, 174 aa, Glycine max
  Coding DNA Sequence Number=SeqID_27100
MAPRKLASKRSRKDKAAEGTSSAPEYDSHHFRSAEHQQRFEAIKGWSPAVASLVTPMAKFDPDIVLEFYANAWPTEEGGQECEYGQRRNRSDGFDEEAIAPACYVYRGKIFARTAVGRRVRIMRTNMTTLTQIWMTLLLSNILPTDHNSDLPLPKCQLVYAILADEHPCGSVNR

SEQ ID NO: 118786 - protein, 188 aa, Glycine max
  Coding DNA Sequence Number=SeqID_27101
  Homolog annotation: Hit_ID=Q84VH5; Match level="QueryCoverage=70%, HitCoverage=28%, E-value=2e-21, Identity=66%"; Hit description =Envelope-like protein
PTEGVVDLVVSEHQIAKEITAKQVQHWPKKGKLSSGKLSVKYAILHRIGAANWVPTNHTSTVATENLLYPCTTNCLRGTHVPDIVSTSGKAAASGAVSKDALIAELKDTCKVLEATIKATTEKKMELERLIKDSQTMALMMEKQLRKKKMQQRIQNQMMMILMPPHDHQTFIFLLLTIDCYWSVIFAH

SEQ ID NO: 118787 - protein, 106 aa, Glycine max
  Coding DNA Sequence Number=SeqID_27102
MTFEGGDLEAIPVEVSPMTDFCISLCRAIRLAKRIDRSILKSIVTPSTGLPRQSQLKNDIVAFSKDLILRGYVGSQLGKRDLRGGRKAIVTMMQGFLNGPPYPIPL

SEQ ID NO: 118788 - protein, 99 aa, Glycine max
  Coding DNA Sequence Number=SeqID_27103
  Pfam annotation: Domain name=hATC; Domain location=21-99; Score=18.7; E_value=0.00037; Accession=PF05699.5; Description=hAT family dimerisation domain
MVITSTISIAQVDVMDEFIQFEDQDMSQVGKSQLNIIPILMFCNIGKDNQAQFPDLSLLACDILSIQITTVASESAFSIGSREKKMKIWRWRRLKLLQI

SEQ ID NO: 118789 - protein, 271 aa, Glycine max
  Coding DNA Sequence Number=SeqID_27104
  Gene Ontology: Mol. function=chloramphenicol O-acetyltransferase activity; Biological process=response to antibiotic
  Homolog annotation: Hit_ID=P62577; Match level="QueryCoverage=80%, HitCoverage=99%, E-value=1e-130, Identity=100%"; Hit description =Chloramphenicol acetyltransferase
  Pfam annotation: Domain name=CAT; Domain location=11-214; Score =528.7; E_value=6.6e-156; Accession=PF00302.9; Description =Chloramphenicol acetyltransferase
AKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGLQLGANCLPGTECQAWNETNAAHNSGMTPVNRKAGTGERPREPPGGNA

SEQ ID NO: 118790 - protein, 48 aa, Glycine max
  Coding DNA Sequence Number=SeqID_27105
MVASSVMFVTLRKENKYRYQFESRPFWNILEVGLLKEEATEWQAPPRF

SEQ ID NO: 118791 - protein, 269 aa, Glycine max
  Coding DNA Sequence Number=SeqID_27106
  Gene Ontology: Cellular component=mitochondrion
  Homolog annotation: Hit_ID=A5AFX7; Match level="QueryCoverage=36%, HitCoverage=58%, E-value=3e-13, Identity=40%"; Hit description =Putative uncharacterized protein
MSDSLVRVSRRAEWGAHRPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGDRFSWWAFPGLVGSVRARKGSSMGPELTGSHVIGLERGSSHHFITAKSAMNPDFKPTHEAGARGRRALGLMASGATCVQRLDGSRDSAIHTKYRISLRSSSMQEPRYPLPRVIDEEAGRTGRRGHPLPPDGR

SEQ ID NO: 118792 - protein, 137 aa, Glycine max
  Coding DNA Sequence Number=SeqID_27107
  Gene Ontology: Mol. function=polyphosphate kinase activity; Cellular component=polyphosphate kinase complex; Biological process =polyphosphate biosynthetic process
  Homolog annotation: Hit_ID=Q8FF70; Match level="QueryCoverage=91%, HitCoverage=18%, E-value=5e-55, Identity=84%"; Hit description =Polyphosphate kinase
FLKDDYTYLAVEIIRGESISYALLEIPSDKVPRFVNLPPETPRRRKPMILLDNILRYCLDDIFKGFFDYDALNAYSMKMTRDAEYDLVHEMEASLMELMSSSLKQRLTAEPVRFVYQRDMPDAMVENAARETDHFAL

SEQ ID NO: 118793 - protein, 76 aa, Glycine max
  Coding DNA Sequence Number=SeqID_27108
MAAEWRRKRERRRHFKEKMSLEEAHHHRRPWIRAWRKKEMNEGRGREEHEILCSKRALKSEPTNPRSIPRFSTKCA

SEQ ID NO: 118794 - protein, 62 aa, Glycine max
  Coding DNA Sequence Number=SeqID_27109
MEMFAFGMKMDEQSAHPLAGRGRTFSKSSFSLVWNGTLYKGLFPNLYIQGAGLDLAWRCPSR

SEQ ID NO: 118795 - protein, 26 aa, Glycine max
  Coding DNA Sequence Number=SeqID_27110
MGAKHLPRPKKGRMSPSNTWGPRTKL

SEQ ID NO: 118796 - protein, 87 aa, Glycine max
  Coding DNA Sequence Number=SeqID_27111
  Subcellular localization annotation: CTP_CleavageSite=33; ConfidenceScore=5.74e-01
MASPPTSPPPSLPPPLAPSDTSASPSAVKRTRKASRLRSLSTRPLGAKRPVVHVDPAIGKADGPHRKKLTTYLGIVARDKVDVTYEN

SEQ ID NO: 118797 - protein, 106 aa, Glycine max
  Coding DNA Sequence Number=SeqID_27112
ELNSSRKILTAKTFDSGVCVRPMIYRDASSIGACRPRIFFINGFLCFLEDEWQRNGERERERRRHFKEKMSLEEAHHHRRPWIRAWRKKEMNEGRGREEHEILCSK

SEQ ID NO: 118798 - protein, 249 aa, Glycine max
  Coding DNA Sequence Number=SeqID_27113
  Gene Ontology: Mol. function=catalytic activity; Biological process =metabolic process
  Homolog annotation: Hit_ID=A8GGS0; Match level="QueryCoverage=100%, HitCoverage=66%, E-value=1e-127, Identity=90%"; Hit description=Male sterility domain precursor
  Pfam annotation: Domain name=NAD_binding_4; Domain location=1-118; Score=-74.9; E_value=0.00064; Accession=PF07993.3; Description=Male sterility protein
MAQVPRLKRFLHVGTVMSCSPEPGSLVAESGEFEEDAEHLVEYTRSKSTIEQLMRQRCPQLPLTIARPSIVVGHTRLGCQPSSSIFWVFGMALMLRKFMCSLQDNIDVIPADYCADAQVMLMNSETLENDVYHISAGEESSVSFAEIDRAMAAALEKAPVGDEYAQVTYDALVKMRRQLKDIFGPCNERLMLKAMRLYGSFAMLNVRFSNEKILKLGMPKPPRFTDYIAGCVQSTRGLSIQQQMVVDFK

SEQ ID NO: 118799 - protein, 105 aa, Glycine max
  Coding DNA Sequence Number=SeqID_27114
MGFTTKGAALPGHRAYPILNLGESVSASVLLAVEELVEWTLSSCQRGKEKRPTTRGESDSAANKRRKPGLRSKRRSLVLLPHMLLPMSYSVGFVNENADHPHAGR

SEQ ID NO: 118800 - protein, 100 aa, Glycine max
  Coding DNA Sequence Number=SeqID_27115
  Homolog annotation: Hit_ID=Q2HW90; Match level="QueryCoverage=70%, HitCoverage=14%, E-value=1e-07, Identity=35%"; Hit description =Putative uncharacterized protein
DPTKIWDLARVDVSMEPIASLSQYYDQPLRCFTFEDFQLVPTVKEFEEILGCPLGGRKPYLFSGFYPSTTRVSKEVFGGKGKGLGKIKANGLLLLTSWRF

SEQ ID NO: 118801 - protein, 274 aa, Glycine max
  Coding DNA Sequence Number=SeqID_27116
  Homolog annotation: Hit_ID=Q9AVH2; Match level="QueryCoverage=24%, HitCoverage=41%, E-value=8e-23, Identity=52%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVAKILPTLACAPLAKSVPRHKGGGGAWSSVRLGHTPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRKSLFEGSKSNVAMNAWLPQASYPC

SEQ ID NO: 118802 - protein, 128 aa, Glycine max
  Coding DNA Sequence Number=SeqID_27117
MLLAGVEGMLAIGVGKVSTLVVAIGVQDRMRQGPLAGTWLLIQVVEYYSSSRRSRPGVETTGSYRAGGTVVELRADGSCSSQVVEQEADEVRLQVDVSFHPSRHGSVESTPTRYQLVLLLVLVVVIVV

SEQ ID NO: 118803 - protein, 36 aa, Glycine max
  Coding DNA Sequence Number=SeqID_27118
MGESKKGKRILDQRSEEKRRNMQKGNDLQDQVMTYL

SEQ ID NO: 118804 - protein, 149 aa, Glycine max
  Coding DNA Sequence Number=SeqID_27119
  Gene Ontology: Biological process=transposition, DNA-mediated
  Homolog annotation: Hit_ID=Q1J7G7; Match level="QueryCoverage=20%, HitCoverage=42%, E-value=2e-10, Identity=100%"; Hit description =Transposase
ASGITGTPGLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLRFAYWALAECILAYYVGTDEGVSEVLHVAGEKRLPPVRQQNM

SEQ ID NO: 118805 - protein, 79 aa, Glycine max
  Coding DNA Sequence Number=SeqID_27120
  Subcellular localization annotation: CTP_CleavageSite=21; ConfidenceScore=5.01e-01
CPPVQLLTGWCVTAKAPPDISAGKCSGHAARNTTPAALNAPLQGAAIGAGLFAITPAGERGMCCKAIKLGNARVFPVTT

SEQ ID NO: 118806 - protein, 224 aa, Glycine max
  Coding DNA Sequence Number=SeqID_27121
  Gene Ontology: Mol. function=transmembrane receptor activity; Cellular component=intrinsic to membrane; Biological process=innate immune response
  Homolog annotation: Hit_ID=A5B6Z3; Match level="QueryCoverage=50%, HitCoverage=12%, E-value=5e-09, Identity=28%"; Hit description =Putative uncharacterized protein
MQNQNCKMLSMNCRRFQVPIISILERIQNKFKFVDQTISIPYQSSSIYDAWERCNVMVISCITRTQIPKIAPSKTLWDELEELQPTLSCTCAAEVYNSMKTQILLMEPLPSINRVYFLVLQQERQLTGGSLNNSRVLSSSIENQNGWKPQGRGNGRGGSRSSHGRSNNYTSKQCAYCNKHGQTVVSVGLSIVYPLAISLRISTVNSCTVSEEGANSLETDKTLP

SEQ ID NO: 118807 - protein, 229 aa, Glycine max
  Coding DNA Sequence Number=SeqID_27122
  Homolog annotation: Hit_ID=Q2HW90; Match level="QueryCoverage=34%, HitCoverage=16%, E-value=4e-08, Identity=35%"; Hit description =Putative uncharacterized protein
MGQLQRQAFRKAYGKIWDLARVEVSMEPIASLSQYYDQPLRCFTFEDFQLVPTVKEFEEILGCLLGGRKPYLFSGFYPSTTRVAKEVFGGKGKGLGKIKANGLLLLTSGAFDLWRCPLSEYGRVSGPSTLSMCGWFRTFFSKKVGPSIRYKVTARRKNQDSIFMRRMSKCSLDGTRGCINYNPVLAIRQLGYPMRGVPSDESITPFIAQGFSDHNARVLQGVRKAWDAA

SEQ ID NO: 118808 - protein, 15 aa, Glycine max
  Coding DNA Sequence Number=SeqID_27123
ILAQTCRMARHDTCQ

SEQ ID NO: 118809 - protein, 55 aa, Glycine max
  Coding DNA Sequence Number=SeqID_27124
MTKARQKGYGKKMKERACHPARPGELGCFLQKAPLLENFLEGPSGPGWYLHPPIY

SEQ ID NO: 118810 - protein, 102 aa, Glycine max
  Coding DNA Sequence Number=SeqID_27125
  Pfam annotation: Domain name=zf-CCHC; Domain location=30-47; Score =31.2; E_value=3.8e-06; Accession=PF00098.14; Description=Zinc knuckle
KFQKFVKRKRIERRQNFNNGRRSQEDSQVLRCYKCNQLGHIKANCPSNEEWPEKSAKKMYDERRTKKAYIAWDNNDSSDGSEKEINLLTKDYESDENISQEG

SEQ ID NO: 118811 - protein, 146 aa, Glycine max
  Coding DNA Sequence Number=SeqID_27126
AQKTTLVSACYLAFRLIDTKNVYTDNHSGISARQRDSKVSMTDLVSAEDDINLHVSTGLSAGLTKVAEDDVSLCVLSGFSSYRMQKVYTDNHSGISARQRDSKVSMTDLVSTEDDQKVYTDNHSGIFARQRDSKVSMTDLMSAEDN

SEQ ID NO: 118812 - protein, 64 aa, Glycine max
  Coding DNA Sequence Number=SeqID_27127
MASNIISKLISSVEENQGFQITEYTLSLKLLRGPLGATRTRYGKIWNKWLNPKGIEEQWGISAY

SEQ ID NO: 118813 - protein, 132 aa, Glycine max
  Coding DNA Sequence Number=SeqID_27128
NATTARALEQEAKRARKEEYGRNKFRGALWGSNNELKLRREERDQSRAHSMVLKEDLVACSRSKRSLSQCLCETETNMLAIIAKYQEELGLATAHEHKVADEYAQVYAEKEARGRVIDSLHQEASYHCDVGS

SEQ ID NO: 118814 - protein, 183 aa, Glycine max
  Coding DNA Sequence Number=SeqID_27129
MGKAEEVQEKVKADMEAMKEKMATMMEAMMSMKKIMEANAVTIAATSTVAKVNPMPPSGLNQMNHPTSAMTLEIPHHNLADFEPCLRYATKEQAVGGIPLQNTLEGPQYHPQLHLLHSTKSKTPHAMAEMGKLDHLEERLRASEGGEDYAFANLEELFLVPNIITPPKFKVLDFDKYKGTTCP

SEQ ID NO: 118815 - protein, 16 aa, Glycine max
  Coding DNA Sequence Number=SeqID_27130
MGVQIATRPTWALQKA

SEQ ID NO: 118816 - protein, 133 aa, Glycine max
  Coding DNA Sequence Number=SeqID_27131
MTLLLSNILPSDRNADLPLGKYQLGSRPQDTQWTRKSPTGPWGFQLWLRASVSPIGCSSPQQGITPARHSVDLEKSIRVLGFSALMTGLFKRPSPPTRSLGPPLIGLSSRSIAPPGRRRARHHSSIGMAGSGQ

SEQ ID NO: 118817 - protein, 172 aa, Glycine max
  Coding DNA Sequence Number=SeqID_27132
GGGMGAGHVSRSDWNGESRSADRLGTLTAADCDGGPKPGLLICSWRRHHRDCGWQRAPLGRASAPARSLASACGLPIRPVLKTRTKESDMWASQRASKPHTCRDPKDGELCLSGAKPEETLVEARSDTDVQIVRLTWVGRCGCSVEPRHGIEKLPSGPFLVAELAMRDEPEA

SEQ ID NO: 118818 - protein, 265 aa, Glycine max
  Coding DNA Sequence Number=SeqID_27133
  Homolog annotation: Hit_ID=Q84VI1; Match level="QueryCoverage=47%, HitCoverage=22%, E-value=3e-48, Identity=71%"; Hit description =Envelope-like protein
MAQKKSTPITPATSRRSKVAIPSKKRKEISSSDSDDDVELDVLDSKRAKKSGRKNWEDGILGSARRPCATARCWIRAQDESQLSGSTVMKPTKQGIQLSHAPSTFFIQKFICLDSRVEDNLQLLVSPAVPSSPHQEQPEFNIQPIQIIPGQASVPAKLIPRRPQGVKIAENPSLATSPREVDTEMDNKIRSIVSSILKDASVPEADEDVPTSSNPNVSVPDVKKDVPTSSAPNAEALPSPSEEESQKRGSSLRGDSCTRAPDLLQ

SEQ ID NO: 118819 - protein, 140 aa, Glycine max
  Coding DNA Sequence Number=SeqID_27134
  Homolog annotation: Hit_ID=Q6UUU1; Match level="QueryCoverage=42%, HitCoverage=40%, E-value=1e-18, Identity=78%"; Hit description =Putative uncharacterized protein
MILSKSRTSQLAAQKLDILRCRSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGKYLTG

SEQ ID NO: 118820 - protein, 68 aa, Glycine max
  Coding DNA Sequence Number=SeqID_27135
MPENQKILMHNPGVYLVKMGVQIAPRPIWALQKIPPEGGCFWRKQPCSPGRAELAWASWAASISPILL

SEQ ID NO: 118821 - protein, 120 aa, Glycine max
  Coding DNA Sequence Number=SeqID_27136
MSKSCGFRMTGPLDESISCFLIRVDPWVLVTLTVERTTRLHVLANRGLHALTSRGLHVLALRGLHALTLGTSYLTRDTPRLGGLHVLANRGLHALTFRGLHVLALRGLHALTLGTSYPHR

SEQ ID NO: 118822 - protein, 147 aa, Glycine max
  Coding DNA Sequence Number=SeqID_27137
MDMNVGYLISHQISITAQHDSSRLGFLSLIIALCKARAVQSDSRSMESLCPAINLAHIKKNCWNLDNPTVKFRGPRKAREPPQRADIPMAQEEETSPNPMPKPSLAPAPEETLPSVPILEPEPTIQDSSVAPVLDMNEDQPRDEQDV

SEQ ID NO: 118823 - protein, 72 aa, Glycine max
  Coding DNA Sequence Number=SeqID_27138
MAEADARNGDNGGNAEELGILSNVSKNTCRNLPFGGRATRGSQVRLPRKENARSCHQRLFEEDVGKTRKCVV

SEQ ID NO: 118824 - protein, 333 aa, Glycine max
  Coding DNA Sequence Number=SeqID_27139
  Homolog annotation: Hit_ID=Q6WAY6; Match level="QueryCoverage=21%, HitCoverage=12%, E-value=2e-10, Identity=42%"; Hit description =Putative uncharacterized protein
MDWDQLLAGIGGRTISWFPRWKEGKEGVLFSCGRYPNIPLIGTRGCINYNPTLAIRQLGYPMRGAPTEESMSPFPCMGNPVKERSRLRGIRNGIIGGYHEWLKVHIRGLDWLAKLKVVSEESFEAPEEDEEVQALKSELGKAKFAKEKFKLAATHIRKECAGLREENAITARALEQETKRARKEEYGRNKFRGALWGSNSELKLRREERDQSRAHSMVLKEELIACSRSKRSLSQRLYETETNMLAIIAKYQEELGLAAAHGHRIADEYAQVYAEKEARGRVIDSLHQEATMWMDRFALTLNESQELPGLLAKAKAMADTYSTPEEIHGLLGY

SEQ ID NO: 118825 - protein, 45 aa, Glycine max
  Coding DNA Sequence Number=SeqID_27140
MEVEEPWLGLWLPLNYRVDMGSSLAYDNGIWGGLRIGSAVDRLCG

SEQ ID NO: 118826 - protein, 95 aa, Glycine max
  Coding DNA Sequence Number=SeqID_27141
  Subcellular localization annotation: CTP_CleavageSite=76; ConfidenceScore=5.08e-01
MTKGADNRKVSPRATGLSGRWIAMGVCGLPSGVSTCHQTLGSLDSKGCLRVIFGCLRMPQNSWVTVAKGGVVDKSRAFAPTYPQFVMRNSYLRSS

SEQ ID NO: 118827 - protein, 162 aa, Glycine max
  Coding DNA Sequence Number=SeqID_27142
  Subcellular localization annotation: CTP_CleavageSite=17; ConfidenceScore=5.10e-01
VKRSRTKLRFGKPKPISLMPKKPNHASVVFNLRLRFGCLSAPPAAAAVLDIGQIELKDRWGISEDEEEERRRPGRILQRDHQQRLEELLFHQELMPYQLIQVVASPRGGYRLLVVRGGISGSAADPNYPSGDSRRSVNYWDIGEFLSSYWNFPRYMSLLYKY

SEQ ID NO: 118828 - protein, 273 aa, Glycine max
  Coding DNA Sequence Number=SeqID_27143
  Homolog annotation: Hit_ID=Q6WAY6; Match level="QueryCoverage=48%, HitCoverage=22%, E-value=7e-11, Identity=34%"; Hit description =Putative uncharacterized protein
MFGDFQLVPTVEEFEEILGCPLGGRKPYLFSGFLPSLSKIAVVVRDSARGLDRVKQTRNAVVGLPQKYLEGKARDMENQEEWVPFMDVLALLIFGVVLFPNMDGLVDLDAIDAFLAYHHSKESSVVVILADLFDTFDRRKERREFSSHVGATQTSRDRNEGCINYNPTLAIDSRVPHEGSTDGRKPASFPCERFWRAKFKVIQRGHKAWESPLRKDKELRGIRNGIIGGYHEWLKVRTRGRLTKEKFKFVATDVRKKCAGLREENAATAKALE

SEQ ID NO: 118829 - protein, 537 aa, Glycine max
  Coding DNA Sequence Number=SeqID_27144
  Gene Ontology: Mol. function=hydrolase activity, hydrolyzing O -glycosyl compounds; Cellular component=chloroplast; Biological process=carbohydrate metabolic process
  Homolog annotation: Hit_ID=A8GKV0; Match level="QueryCoverage=100%, HitCoverage=73%, E-value=0.0, Identity=91%"; Hit description=1,4 -alpha-glucan-branching enzyme
  Pfam annotation: Domain name=Alpha-amylase; Domain location=247-535; Score=-52.8; E_value=1.8e-06; Accession=PF00128.15; Description =Alpha amylase, catalytic domain
  Pfam annotation: Domain name=Isoamylase_N; Domain location=124-207; Score=122.8; E_value=9.9e-34; Accession=PF02922.9; Description =Isoamylase N-terminal domain
  Pfam module annotation: Pfam domain module=Alpha-amylase::Isoamylase _N; Domain location=247-535::124-207
MPVLPDRDVIDQIISGHYADPFALLGMHATDNGLQVRALLPDAGAVWLVEQQTGRRLVQLNCDDPRGFFSAVVPRRKNPFRYQLQVSWRDHQQTVDDPYRFGPLLQDIDSWLLAEGTHLRPYERLGSHLATLDDVDGVSFAVWAPNAQRVSVVGEFNFWDGRRHPMRLRRENGIWELFLPGVRAGQLYKYEIVDCYGNTQLKADPYAFEAQMRPDTASLVAPLPEVVPSTQARRRANDFDQPIAIYEVHLGSWRRHTDNHFWLSYGELAVQLIDYVKDMGFTHIELLPINEHPFDGSWGYQPLGLYAPTRRFGTPADFRAFVAAAHEAGINVILDWVPGHFPSDAYGLANFDGTALYEYADPREGYHQDWNTLIYNYGRHEVRNYLAGNALYWLERFGIDALRVDAVASMIYRDYSRADGEWVPNYYGGNENLEAIAFLRYTNQTIGQAQPGAVTLAEESTDYPGVTLPPDANGLGFHYKWNLGWMHDTLNYMKCDPVHRKYHHNQMTFGMLYAYTENFVLPISHDEVVHGKKSILD

SEQ ID NO: 118830 - protein, 92 aa, Glycine max
  Coding DNA Sequence Number=SeqID_27145
  Gene Ontology: Mol. function=endonuclease activity
  Homolog annotation: Hit_ID=Q9AY32; Match level="QueryCoverage=68%, HitCoverage=95%, E-value=7e-27, Identity=96%"; Hit description=RRNA intron-encoded homing endonuclease
MDTHRILILLCAFGIGVMINRDKRKLGARRRSDTVLVSTINDADQGSADVAFRTPLAPYEKSKSLGSGGSMVARLKLKGIDGRAPPGVEPAA

SEQ ID NO: 118831 - protein, 171 aa, Glycine max
  Coding DNA Sequence Number=SeqID_27146
MKASGNRLPRGCNRLPEEWVTGNRLPDRDAAQLIHDRVEMECLEGDLGDPRRQHEVPISGTIRFTATSLVHPDEPARTLQRTVEWILPTPTPYRLVEPVQLIEVTSSEEDPEEDPEELPPEPVVDALDFLEGDEDPLLEVDSPEEVMSASEADSTEDSGPGEMAISGGSSS

SEQ ID NO: 118832 - protein, 67 aa, Glycine max
  Coding DNA Sequence Number=SeqID_27147
MAPKKLSAKRSRRDAATEGTSAAPEFDSHRFRSAEHQQCFKAIKGWSFHRERRVQLRDDEYTDLGIL

SEQ ID NO: 118833 - protein, 144 aa, Glycine max
  Coding DNA Sequence Number=SeqID_27148
  Homolog annotation: Hit_ID=A8ARU6; Match level="QueryCoverage=34%, HitCoverage=64%, E-value=1e-17, Identity=78%"; Hit description =Putative uncharacterized protein
MAYERGGDFLEDARKILNREAFPPGGSLVRSPVPAFRFTGVIPLLWPRLSHSTPDTQFRGRQFAPSWTVCTNPPFSPTAAPYPVTIVLSPTRKDMQKHHWQQPLVIDFRGVSLEVMRRVKAKTERTSFGDWRSSKPVTSVQRVG

SEQ ID NO: 118834 - protein, 174 aa, Glycine max
  Coding DNA Sequence Number=SeqID_27149
MASGNRLPRVCNRLQGLKMETVSMCRSCVTRVWALIAMAAQLIHDRVEMECLEGVWETLESNERCRFRGTIRLTATSLVHPEKPARTLQRTVEWILPTPTPYRLVEPVQVIEVSSSEEDPEELPPEPAVDALDFPEDDEDPLPDVDSPEDIMSASEADSTEESGPDGTATSGDS

SEQ ID NO: 118835 - protein, 329 aa, Glycine max
  Coding DNA Sequence Number=SeqID_27150
  Homolog annotation: Hit_ID=Q9AVH2; Match level="QueryCoverage=32%, HitCoverage=49%, E-value=8e-47, Identity=69%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRGLGRPSARAHLVSTRQAKREEKPTNGFVGDLEGRDESKRQGAESQWIVAARPLCPLTIPRRVFKSSAKDSPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAST

SEQ ID NO: 118836 - protein, 31 aa, Glycine max
  Coding DNA Sequence Number=SeqID_27151
MGPTHFISKRKSHLVKVSAIALALANKRGRS

SEQ ID NO: 118837 - protein, 307 aa, Glycine max
  Coding DNA Sequence Number=SeqID_27152
MAPWKLASKRSRKDKAAEGTSSAPEYDSHRFRSAVHQQRFEAIKGWSFLRERRVQLRDDEYTDFQEEIGRRRWASLVTPTAKFDPDIVLEFYANAWPTEEGVRDMRSWVRGQWIPFDADAIGQLLGYPLVLEEGQECEYGQRRNRSDGFDEEAIAQLLCMAPTRHPLDPDKSNKALGFPALITGLCQSFGVPVTPTKVIRPPITRAFIEKYCTQRQAQGDAPQAVGAPPPPHQAGPAGSFDMEQYVATYPSAGGRRVARGMRVPRKEYARSRHQRLFEENVGKTGKDAIYELLSERFGSCIYARGRY

SEQ ID NO: 118838 - protein, 255 aa, Glycine max
  Coding DNA Sequence Number=SeqID_27153
MAPRKLASKRSRKDKAAEGTSSAPEYDSHRFKSAEHQQRFEAIKGWSFLRERHVQLRDDEYTDFQEEIVHRRWASLVTPMAKFDPDIVLEFYANAWPTEEGVRDMRSWVRGQWIPFDADAISQFLEYPLVLEEGQEYEYSQRRNRSDGFDEEAIAQLLCIPGQDFARNAAGRRVRIMRTNMTTLTQIWMTMLLSNILPSDHNFDLPLPKCMAPTRHPLDPDKSNRALGFPALITGLCQSFGVPVAPTKVIRPPIT

SEQ ID NO: 118839 - protein, 43 aa, Glycine max
  Coding DNA Sequence Number=SeqID_27154
MTKFCLCVSSGPPPLDDKKGADNRKGADNRKVSPRVIGPAASG

SEQ ID NO: 118840 - protein, 302 aa, Glycine max
  Coding DNA Sequence Number=SeqID_27155
  Homolog annotation: Hit_ID=Q2HW90; Match level="QueryCoverage=49%, HitCoverage=34%, E-value=1e-13, Identity=34%"; Hit description =Putative uncharacterized protein
YYDQPLRCFTFEDFQLVPTVKEFKEILGCPLGGRKPYLFSGFYPSTTRVAKYQGSVWRKGQRPWKIKANGLSFIDILALLIFGVVLFPNMEGLVDLAVIDAFLAFHHGKESPVVAILAMYDTFDRGCEKSDARIFCCALALYVWLVSHPFLQEGRPVYPLQGHRSCVEKGKANWDQLLASMEGRLLIGSLARRKEESGFYLHAKDDRELRGSSNGIIGGYHKWLRVRTQGLDWLPNLKTVRDDEVKASKESDEVQALKAELERAWVVKEKFKAAIVSSNSEEVKGIITGQRHDLEGRAKGLP

SEQ ID NO: 118841 - protein, 50 aa, Glycine max
  Coding DNA Sequence Number=SeqID_27156
MEIYVSDRLGKNDYKGDDKKLKDQSKNNSCESKINQRTTQVNQEQFKSSR

SEQ ID NO: 118842 - protein, 142 aa, Glycine max
  Coding DNA Sequence Number=SeqID_27157
MVSIWDLARVEVSMEPIASLAQYYDQPLRCFIFGDFQLSPMVEEFEEILGCPLGGRKPYLFSGESSFQMWMGWWTWKRSTFFSPIITTRKVRLSLCWPTYMTPSTEDVKKAMQGLFAVLQLSMWGWFHTFFSEKVGPSIRYK

SEQ ID NO: 118843 - protein, 46 aa, Glycine max
  Coding DNA Sequence Number=SeqID_27158
MARPEMIAKGLYVTLTVVCRELMSDAFRCAVFSKLAVFKLSAMGHS

SEQ ID NO: 118844 - protein, 69 aa, Glycine max
  Coding DNA Sequence Number=SeqID_27159
MAAIEMALKKLSAKRYRRDVVAAGTSAAPEFDSHRFRSAEHQQHFEAIKGWSFHRERRVQLSPDEYIDF

SEQ ID NO: 118845 - protein, 130 aa, Glycine max
  Coding DNA Sequence Number=SeqID_27160
  Homolog annotation: Hit_ID=A5BHZ8; Match level="QueryCoverage=92%, HitCoverage=6%, E-value=2e-10, Identity=31%"; Hit description =Putative uncharacterized protein
MRWKVVGGDKVRFWEDKWSQQQQPLAERYPRLYQISTQQNQTIRQMGQHLHSGWEWHFLWRRSLFENEIESAINFLREIEGIYIQQQGSDQWEWLGDQSRNYSTRSDYNLVLEASTGGQQEEWWTDYQQG

SEQ ID NO: 118846 - protein, 152 aa, Glycine max
  Coding DNA Sequence Number=SeqID_27161
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MKGRIERFDGKQRRLMVATDGRGWWRRKVLGLSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 118847 - protein, 171 aa, Glycine max
  Coding DNA Sequence Number=SeqID_27162
MDLIENMATSDIAILRDRAHIPTKKSLLELTSHDALLAQNKLLSKQLETLTETLRCTICGGAHESGCCIPIEEHPTREVNYMGNQPRNNFNARGFSGFQHGQQYNQQQGQWRNHPGNHFNRDQGGPSTRPQQQGPSLYDHTMKLEETLAQFMHVSMYNQKSTESPIKNLEV

SEQ ID NO: 118848 - protein, 91 aa, Glycine max
  Coding DNA Sequence Number=SeqID_27163
  Subcellular localization annotation: CTP_CleavageSite=72; ConfidenceScore=5.22e-01
MPISPCKSISWSVSSDVGIAPTKTPSGPEKVKQGPGVFSSGYGPLSVLQGARIAPARHPVDPKKSNRVLELSSSNYGAKHHSSIGMAGSGQ

SEQ ID NO: 118849 - protein, 121 aa, Glycine max
  Coding DNA Sequence Number=SeqID_27164
MSLLFSNILPQRPQCQSPPADVSVGLCRHDIGIAPTRHPVDPKKSNRALGFPALVTGLCSPTGCPFPPARSRHHDIGIAPARHPVDAKKSNRVLELPSSHYGPQSVLRSACHPQQGHQAPY

SEQ ID NO: 118850 - protein, 183 aa, Glycine max
  Coding DNA Sequence Number=SeqID_27165
MASNPARAQKKTNSLKRKQGECSQATLNRDSTSPTCLKHRAFYTCAKADMEGNLYSTINGVEMVIDVAIWKAVVGIDMGGVRSLRHNVSYIITYILAPTSNNHAQVTYDDLQIIYGPKSVFTSRFIAYFNIDVSNEIVDFTKASNEITKRHLKKLGMAYVDHERIMAGEQPAATNVNQNGIRS

SEQ ID NO: 118851 - protein, 251 aa, Glycine max
  Coding DNA Sequence Number=SeqID_27166
  Pfam annotation: Domain name=zf-CCHC; Domain location=138-155; Score =13.8; E_value=0.013; Accession=PF00098.14; Description=Zinc knuckle
MKNERRTVKNNVGIDHECDLKAPRPHFFFFFLHLLINFTKMLSIYEAEPLPSAPSHLFIGNEGRSARCKSAKEIWNMLEVAHEGTTDKRKGIALKVNSLREEYQGSSSSEEDAKNFSLMDKKFSKSYKKVDDNNNNNNTYFECGKQGHIKSECPIYLRKHGGEKKRKKGNKQKKAYIAWEDSSSKASNSSSDDEIADVFLMEKSKNDPSTSEEIEVNSNFGELLEALDEMQEEAQRLVVLNKKLKSELKLH

SEQ ID NO: 118852 - protein, 93 aa, Glycine max
  Coding DNA Sequence Number=SeqID_27167
  Homolog annotation: Hit_ID=A5ATL8; Match level="QueryCoverage=61%, HitCoverage=45%, E-value=2e-15, Identity=73%"; Hit description =Putative uncharacterized protein
RRTLPGLIVPGNHLKERGAFGNADTGGAWLSSARATAGDKPEEGEDDVKSSCPLCPGRHTCYNGRDKGSRSREGGANSKNPSSVRIVGCNSPA

SEQ ID NO: 118853 - protein, 181 aa, Glycine max
  Coding DNA Sequence Number=SeqID_27168
  Homolog annotation: Hit_ID=A0PAV3; Match level="QueryCoverage=35%, HitCoverage=31%, E-value=5e-07, Identity=52%"; Hit description =Restriction endonuclease
  Subcellular localization annotation: CTP_CleavageSite=84; ConfidenceScore=5.08e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGRMGKKGSSLSIPSTSRGGPEKKGCTGASAEYVIQDIFRFPRSLTRYARSFDCGERKWLTNGAEISWKMPGRYLTGK

SEQ ID NO: 118854 - protein, 87 aa, Glycine max
  Coding DNA Sequence Number=SeqID_27169
  Homolog annotation: Hit_ID=A0ST23; Match level="QueryCoverage=49%, HitCoverage=87%, E-value=4e-10, Identity=74%"; Hit description =Putative reverse transcriptase
MSELTHINCVALTARFPVGKPVVPAALIESANARGEAVAYWALAGVEKRLHRCVSRICDTGYIPVPRSLTRYARPSTAASGMAYERG

SEQ ID NO: 118855 - protein, 134 aa, Glycine max
  Coding DNA Sequence Number=SeqID_27170
  Subcellular localization annotation: CTP_CleavageSite=31; ConfidenceScore=5.67e-01
MGSPPASTPPLPPPPPSDALASPSTVKRTCKASRLRSLSTRPPGAKRPVVHVDPATGKADGPHRKKLRTCLGIVACDKGDITYENWKEAEFDIPEAFDSRMKRKTVSRTLFVRNTTSAKKSGPSFARLAETLLG

SEQ ID NO: 118856 - protein, 172 aa, Glycine max
  Coding DNA Sequence Number=SeqID_27171
  Homolog annotation: Hit_ID=Q6UUU1; Match level="QueryCoverage=34%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTYKGYQAFPPGGSPRALSCSCLSVYRSLPSWTVCTNPPFSPTAAAYPGNYRLEFNPGKTCKSTTGSSH

SEQ ID NO: 118857 - protein, 163 aa, Glycine max
  Coding DNA Sequence Number=SeqID_27172
  Homolog annotation: Hit_ID=Q6UUU1; Match level="QueryCoverage=52%, HitCoverage=55%, E-value=2e-18, Identity=60%"; Hit description =Putative uncharacterized protein
GKPVVPAALMNRPTRGERRFAYWALAECILAYYVGTDEGVSEVLHVAGEKRLHRCVSKICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAAT

SEQ ID NO: 118858 - protein, 135 aa, Glycine max
  Coding DNA Sequence Number=SeqID_27173
  Homolog annotation: Hit_ID=A5AQM5; Match level="QueryCoverage=86%, HitCoverage=13%, E-value=9e-12, Identity=34%"; Hit description =Putative uncharacterized protein
  Pfam annotation: Domain name=zf-CCHC; Domain location=94-111; Score =25.4; E_value=0.0002; Accession=PF00098.14; Description=Zinc knuckle
MSLATLFGKLREHELELMRLNQHEENDKKKKGITLKASSSIQEERDKEDLNEIQEEDDFSFIIKRFNKFLRNKGNQRRTNINPKKRGEDSSFVPKCYECNQPGHLRVYCPSFKRRMEKFDRKTFKDKKAKKAYIT

SEQ ID NO: 118859 - protein, 263 aa, Glycine max
  Coding DNA Sequence Number=SeqID_27174
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=19%, HitCoverage=50%, E-value=2e-23, Identity=100%"; Hit description=LacZ protein
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDPSSFPCGALYADTSYSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 118860 - protein, 131 aa, Glycine max
  Coding DNA Sequence Number=SeqID_27175
  Gene Ontology: Mol. function=nucleoside-triphosphatase activity; Cellular component=chloroplast
  Homolog annotation: Hit_ID=Q2PMM5; Match level="QueryCoverage=65%, HitCoverage=3%, E-value=2e-24, Identity=70%"; Hit description =Protein ycf2
MEREKQMNNHLLPQEIEEFLGNPARATRSFFSDRWSELHLSSNPTERSTRDQKLLKKEQKKHLVLSRRSGKYLMKLVELDLFKIIVLQILWQVPFSRIRLYGSKGERTVPIDFFLKNPIDLFRREAIWRAI

SEQ ID NO: 118861 - protein, 122 aa, Glycine max
  Coding DNA Sequence Number=SeqID_27176
  Subcellular localization annotation: CTP_CleavageSite=65; ConfidenceScore=5.61e-01
MARTCSPLKARTCSPLKVRACSSTKVKVHDPLTARTCSPLKLRACSPLKARTCSPLMARTCSPLQARTYSPLKVIGTSTQESTFMRKQEIDSSRGQIDCPFERGDNSCNLLLSFCKSLRELP

SEQ ID NO: 118862 - protein, 141 aa, Glycine max
  Coding DNA Sequence Number=SeqID_27177
  Subcellular localization annotation: CTP_CleavageSite=18; ConfidenceScore=5.10e-01
SKSLAFVDHTAFCYHDPRAGSLRRHLTVIRTSSVIDKRRPIWSSAPFPKMSKSLPFVGRPIIFVILTLRSCDMHPVSSRGGGPDDTWRYLTIIRTLLSSRGGGPDDTWRYLTIIRTLLSSRGGGPDDTQRQNLVILHPCVI

SEQ ID NO: 118863 - protein, 239 aa, Glycine max
  Coding DNA Sequence Number=SeqID_27178
VNSRGGGGVSIARYRPSQCCCGVSPCACLGAQYFLMKARLVGGLMPLLEATGAIPCRGGYEHPVGLIEARNQSWKPQGPVGLFRVHWVSLGGRLALRSLGRMLLSSNVIYICVRVVMLVRMIRTRLFAAARVKSCPGMHSSCVIASLSGCARTVGPPPISGGGPGTVWIWSPLKVRTRSPLKARACSPLKFRTCRLSKARECSSMMARTCNPLKVRACPHFENAGTCSPLKVRTCSPLK

SEQ ID NO: 118864 - protein, 179 aa, Glycine max
  Coding DNA Sequence Number=SeqID_27179
AWASPITELYGSMVRCDGQIRVLVDVRNEAVSPELYSMGVATTNAPSQQGATRTTTIELLVPSEFMSGIQSEPNRTEEMSQSYSTIPRCCNNEWSYYVQPTSTKRPAYESIANASVAIELVEVASRIQNVPTKLRVPPATMKQKQARGIRSATSYDNQLLLARAIGIYLDSLLPLQPQK

SEQ ID NO: 118865 - protein, 408 aa, Glycine max
  Coding DNA Sequence Number=SeqID_27180
  Gene Ontology: Mol. function=catalytic activity; Biological process =mitochondrial electron transport, ubiquinol to cytochrome c
  Homolog annotation: Hit_ID=Q2R0G4; Match level="QueryCoverage=51%, HitCoverage=21%, E-value=2e-19, Identity=33%"; Hit description =Putative uncharacterized protein
  Pfam annotation: Domain name=DUF1723; Domain location=147-196; Score =23.1; E_value=0.00098; Accession=PF08330.1; Description=Protein of unknown function (DUF1723)
MSQRTSSSVCWESGNTLQSRNDGEKGGSQNHMVTQNKTETWESEVMIPFAVERTVYAFGGPLPDKASLSSKMSKVFPCYQTCEPRIFDSEPYNFNCLSKPNKLFRSAPSIAHRDYLPWLDRVEQAYEDFWKTYGIFDLIQFSRSGPEYRPEMLIAAMHFFESSTNPFQFKCGMMTPTLLDVAASQALGLAEKLTTPTNSSDNIKLVYKENTFSKYIVEHKGPVEEEVSDEEHVAFLTLWLSHYVFCTKSLQVAKRFIPMALQIHEGQNFGFGRLLLAVLYESLGEACDDLKKSKDGSSFLVSGPMWLLQLWLNATFEQEMGLIIPQDYAEEVANRSIEGQRALRLTPKTLDPSSQKLFLKYMRIFLSFDKFLPQHAPFISREVGPAWFTDYFPTVDPDNEEEVFNRTI

SEQ ID NO: 118866 - protein, 16 aa, Glycine max
  Coding DNA Sequence Number=SeqID_27181
ERELSGKRIVPERSKE

SEQ ID NO: 118867 - protein, 135 aa, Glycine max
  Coding DNA Sequence Number=SeqID_27182
  Gene Ontology: Biological process=transposition, DNA-mediated
  Homolog annotation: Hit_ID=Q1J7G7; Match level="QueryCoverage=24%, HitCoverage=47%, E-value=3e-10, Identity=90%"; Hit description =Transposase
  Subcellular localization annotation: CTP_CleavageSite=68; ConfidenceScore=5.35e-01
GTSYVPINVSFSPKVGPGLPVSTGTPGFIYSAKVIFRHRYLFGAKVRRWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 118868 - protein, 124 aa, Glycine max
  Coding DNA Sequence Number=SeqID_27183
  Subcellular localization annotation: CTP_CleavageSite=6; ConfidenceScore=5.43e-01
MQGLTQSSAPFVPPGTTKSFTCGNFMGQLSYPNFVRGPLLDDMRPFFGPCEKAVASGGSNPARLGELGGNHLPYFAINRGGRQEGRAEALPKRSRNVFHEESRKGFNRSSTFFIRSSSFFDLQR

SEQ ID NO: 118869 - protein, 111 aa, Glycine max
  Coding DNA Sequence Number=SeqID_27184
MAYERGGDFLEDARKILNREAFPPGGSLVRSPVPAFRFTGVIPLLWPRLSHSTPDTQFRVGSSLQAGLYARTPRSVRPLRLIRTVLVTALFKPVTSFKSGSSENLRKPPAR

SEQ ID NO: 118870 - protein, 80 aa, Glycine max
  Coding DNA Sequence Number=SeqID_27185
MIMRGQDIYSSQDEATTSPPSSESEEAKGKESHFSIKTNIKETSPLRQPPHLLLCKKTLVSIATPVGLKVIPQVKVLLDE

SEQ ID NO: 118871 - protein, 112 aa, Glycine max
  Coding DNA Sequence Number=SeqID_27186
  Homolog annotation: Hit_ID=Q2HW90; Match level="QueryCoverage=72%, HitCoverage=16%, E-value=2e-08, Identity=38%"; Hit description =Putative uncharacterized protein
MGTNQIGKRFYQVKIKGLDVTSLKELGRLMGPLQMRAVRKVYGKILDLTTAEVFTEAVVSLAQYYDQPLRCFTFGDFQIVPTVEEFEEILGCPLGFNKTNCSCIFSLGFFPP

SEQ ID NO: 118872 - protein, 85 aa, Glycine max
  Coding DNA Sequence Number=SeqID_27187
MARHKVTRTHTHTHSRRHKGGGGAWVVRPPGHTPRILPAARWELRFKASRRANPPHEGHQRHVPLGGRGPLLLVGKRTAGRTRRF

SEQ ID NO: 118873 - protein, 58 aa, Glycine max
  Coding DNA Sequence Number=SeqID_27188
MECYRKHFLNEWAQVKVAIKSRLPVHTPEPRISAFYDDLNPIFEAKSPSWKLNTFHDF

SEQ ID NO: 118874 - protein, 37 aa, Glycine max
  Coding DNA Sequence Number=SeqID_27189
MHNLKELHVACRPWIFFINEVLYFLKINGSGIEKEER

SEQ ID NO: 118875 - protein, 82 aa, Glycine max
  Coding DNA Sequence Number=SeqID_27190
MVRTKKTGEMTTEAAKEITEKIGSFVPRGHQDVLTIAIGRPEHPGRVRATGSGVTIKKYFGSVPWTSHSSSLLPPEELQQLT

SEQ ID NO: 118876 - protein, 75 aa, Glycine max
  Coding DNA Sequence Number=SeqID_27191
  Subcellular localization annotation: CTP_CleavageSite=69; ConfidenceScore=5.49e-01
MDSIRKCFGLVFFSFFFLSLLSSSFWTSRPQGTQGPFSSAFPHLFIAKQGIWNEGSSPRRADNFILKQPCSPRRA

SEQ ID NO: 118877 - protein, 100 aa, Glycine max
  Coding DNA Sequence Number=SeqID_27192
GYVTSQCPTRNYDYEGPRHYNSQDEATTSPSSNESEEAKGEGFIEEIYPQEEGQPLIVKEECKEVSVYSKRLAKKEIHFAIKRNSKETSPLRQPPYLLLC

SEQ ID NO: 118878 - protein, 66 aa, Glycine max
  Coding DNA Sequence Number=SeqID_27193
MEPRGSSRDPSTRWFESYSRTKLEVDEPARVSKAIIELIKLSRCKIHFLADFVVDLGMAFVDKWAV

SEQ ID NO: 118879 - protein, 97 aa, Glycine max
  Coding DNA Sequence Number=SeqID_27194
MEKSKVDTLIAISPNTWHASKFIHISLQDKYVIYGDNKRRPHFSPRKVNMRFMETTNKGHLINNRNNYWKLEVGNESYWKLKVENGGWKLEGEVTKS

SEQ ID NO: 118880 - protein, 94 aa, Glycine max
  Coding DNA Sequence Number=SeqID_27195
  Subcellular localization annotation: CTP_CleavageSite=66; ConfidenceScore=5.11e-01
ISVTGIYSAQSASAVPPVQLLTGWCVTAKAPPDISAGKCSGHAARNHHTRPRLMRRYRARPIRHSGCATVGKGDRCGPLRYYASWRKGDVLQGD

SEQ ID NO: 118881 - protein, 71 aa, Glycine max
  Coding DNA Sequence Number=SeqID_27196
MWSLSLSKIIGRPVRVTMFCENAQPYGINIGLKEHSNPVTPKAYTPKSPSGPLPPDSGPTPKIILAHRLYL

SEQ ID NO: 118882 - protein, 219 aa, Glycine max
  Coding DNA Sequence Number=SeqID_27197
MKEIEEENKRSLQAWKNELKDAIITDIFNGDKDSAPANFDLNVLGARVSTKESNAEIVVNPSGEVHVGRVTPPMGLYVQSQDCTKLVALGKIHDGPSTIHCVAYANDVVRVSVEKVIDGEAEVPLATSEIKYVRDAINTFIAWPLPLHSGITPDKVSNAAELNNDVPKHDPLRELIKTLVDIYDKPVEFVWDLTEFGIPNRNNIRRQMLEHSHTSIVDH

SEQ ID NO: 118883 - protein, 72 aa, Glycine max
  Coding DNA Sequence Number=SeqID_27198
  Subcellular localization annotation: CTP_CleavageSite=37; ConfidenceScore=5.17e-01
GDQSCGGVNDPHSSPCSGWVKSCLGIHSSCTIASLSSCARTVGRPPISGGGPGTDKSKLLAPHPGVQASIKH

SEQ ID NO: 118884 - protein, 119 aa, Glycine max
  Coding DNA Sequence Number=SeqID_27199
  Subcellular localization annotation: CTP_CleavageSite=28; ConfidenceScore=5.09e-01
MRVVRRRKSSRPSCHRKTLSQSFTTFLCAMIKSRHMIETSMRAGNSGVYGFLKPQSIQRSGQSQFESESYIKNWMQNSKRDVYLGAYLNGAHWQMVVILPKENVVIWFCSLHNVRVLWS

SEQ ID NO: 118885 - protein, 16 aa, Glycine max
  Coding DNA Sequence Number=SeqID_27200
AFVLGFYVFCFDATVH

SEQ ID NO: 118886 - protein, 200 aa, Glycine max
  Coding DNA Sequence Number=SeqID_27201
  Homolog annotation: Hit_ID=Q6WAY4; Match level="QueryCoverage=52%, HitCoverage=19%, E-value=7e-11, Identity=34%"; Hit description =Putative uncharacterized protein
MGSSQKPSLEKRFYQVKIKSLEVTSLRKLGQLMGQLQRQAFRKAYGKIWDLARVEVSMEPIASLSQYYDQPLRCFTFEDFQLVPTVKEFEEILGCPMGGRKPYLFSRFYPSTTRVAKVVKISAQELDRRLTLSSPFIMQGKPDRRILAMYDTSTGDVKRAAQELFVVHQLLASMEGRLLNGSLARRKEESGFYLHAKDVP

SEQ ID NO: 118887 - protein, 107 aa, Glycine max
  Coding DNA Sequence Number=SeqID_27202
MSCLAIITSISLVPVGVCHPDTNERPRGPGMPPTRHPLDPDKSNKALRFLALITGLCQSFGVPVTPSKVIRPPITQAFIEKYCRRRVMHIRPQTHRHHLGRPIPLDH

SEQ ID NO: 118888 - protein, 80 aa, Glycine max
  Coding DNA Sequence Number=SeqID_27203
  Subcellular localization annotation: CTP_CleavageSite=58; ConfidenceScore=5.48e-01
MGLLKVVQVGYAPLALVRSRNVVGCLRSFISGPRIGSSQKASELGMTSTTTGRSLVVEARSLVEGRWSEVATQSEELVVV

SEQ ID NO: 118889 - protein, 104 aa, Glycine max
  Coding DNA Sequence Number=SeqID_27204
MATMIKAMMSMKKIMEANAVIVAAISAVAKVNPMSPSGLKQMNHPTSNMVGKDLGSTGGPHDVQIQNKHAFPSYGLPLNYTPPNVAYTLNENLNNSTPILIENQ

SEQ ID NO: 118890 - protein, 67 aa, Glycine max
  Coding DNA Sequence Number=SeqID_27205
  Subcellular localization annotation: CTP_CleavageSite=34; ConfidenceScore=5.02e-01
MFAGIVPQTPSGPEEGQKGLGVANSKYGSLSVLRSARRPNKVIRPPTNQAFIKKYCVSRQAQGETPQ

SEQ ID NO: 118891 - protein, 60 aa, Glycine max
  Coding DNA Sequence Number=SeqID_27206
MDRKASGEVSKGEVPKPKENVGSGSEDKVMKAPGGDGSYISRKEFEKNPQGYFDDWSYNK

SEQ ID NO: 118892 - protein, 95 aa, Glycine max
  Coding DNA Sequence Number=SeqID_27207
MDESMLWHLRLHLWQDAQVIISKNILRAKAPLQLVHADIWGPSRVQGPSGKAKWAFPQNLENRSRGEFNGHIFINFCNDHGIKKELNVRHTPQQN

SEQ ID NO: 118893 - protein, 113 aa, Glycine max
  Coding DNA Sequence Number=SeqID_27208
MDKVDIFVPHPLVITSLLPLECGCKPLREVSYQEYESFDLIRQLKNPSTISCPWKILFARINRFFHSSLLQGCGNKTTMVTSEPYTVAMKGTMHKPQVNLGADQKFSPVDVFK

SEQ ID NO: 118894 - protein, 168 aa, Glycine max
  Coding DNA Sequence Number=SeqID_27209
MAPRKLASKRSRKEKVAEGTSSAPEYDSHRFRSAEHQQRFEAIKGWSFLQERRVQLRDDEYTDFQEEIVRRRWASLVTPMAKFDPDIVLEFYANAWPTEEGDFARTAAGRRVRIMRTNMTTLTPDMDDVCCSATSQPSDHNSDLPPVEVSAGVRRPDTDEHSRGSVDC

SEQ ID NO: 118895 - protein, 137 aa, Glycine max
  Coding DNA Sequence Number=SeqID_27210
GFLPLPGFLGCDSLCCVNVVLLGCWGSLGGLMGTRGWWVYARFVDVENLLCTIARPPPSTTCDGVYLEICRGGQETWGRQASSWQSTDKRKTRPQSKEACGGWPAEAKMVSGIWEMIEASGNRLPACVIDYTEEWVT

SEQ ID NO: 118896 - protein, 64 aa, Glycine max
  Coding DNA Sequence Number=SeqID_27211
MHEMAPKKLSTKRSRRDTAAERSSAAPEFDSHHFWSAEHQQCFEAIKGWSFHKERRVSSGRMSI

SEQ ID NO: 118897 - protein, 271 aa, Glycine max
  Coding DNA Sequence Number=SeqID_27212
MGSSQKPSLKKRFYQVKIKSLEVTSLGELGQLMGQLQRQAFRKAYGKIWDLARVEVSMEPIASLSQYYDQPLRCFTFEDFQLVLTVKEFEEILGMPTGRKEAISFLWEWGSRSTKEVFGGKGKGLGKSRRMGFLLLTSCAFDLWSCPLSDMEGLVDLVVIDAFLAFQHGKESPVVAILAMYDTFDRGCEKSGARIVCCALALYVWLVSHPFLQEGRPVYPLQGHRSCVEKGKANWDQLLANMEGRLLIGSLARRKEESGFYLHVKDVQMFP

SEQ ID NO: 118898 - protein, 65 aa, Glycine max
  Coding DNA Sequence Number=SeqID_27213
DDYEGYEAIAQRLERVLNLRIVTTGTELYDIMQDCLTIARGGPSADGTVRARQRPRHGPLIIFFV

SEQ ID NO: 118899 - protein, 99 aa, Glycine max
  Coding DNA Sequence Number=SeqID_27214
MTHRKSDGSIFAQLVRFRNIPFRNITERNKYRYEIRKFRTLRKRSPKKVGGVLSKKGGANSTQAHLGPPEDSSRRLLLLGEATLLAWASWVASFSPNFL

SEQ ID NO: 118900 - protein, 120 aa, Glycine max
  Coding DNA Sequence Number=SeqID_27215
MEISMIDVASGGALGDMTPAEARNLIEKMASNSQQFSARNDAIVIRGVHELALNQKSVPIARLCGLCSSIDQHTDLCPFVQQSEAIEQPEAYAANIYNRPPQPQQQNQPQQNNYDLSSNK

SEQ ID NO: 118901 - protein, 47 aa, Glycine max
  Coding DNA Sequence Number=SeqID_27216
MTQKILIFQLKYRYITISQTGLRNLIRLAMPKLMEADVQFAVFTGRV

SEQ ID NO: 118902 - protein, 110 aa, Glycine max
  Coding DNA Sequence Number=SeqID_27217
VTGCTICGEAYEIGQCTPTEENTQEIHYMGNQQREGPIQQGPNIFQRTTNLEETLTQFMQVTMSNHKSTESALKNLEVQVGQLAKQIADKSSNSFVANTKQNPKEECKVL

SEQ ID NO: 118903 - protein, 171 aa, Glycine max
  Coding DNA Sequence Number=SeqID_27218
PWDFPPGSRGLCQSFGVPVTPSKVICRPITRAFIEKYYTQRQVQGDVPQAADVPPPHQAGPAGLFDTEQYLRHLVRQQATNHRAHVQTHDCLYQMSLSLQSQGFTPFPCPTPDQFRAEVAWPGDWPEAQAAGAPAEAPAGAPAEAPDEVDEAREDEEMTDLLDFLGGSGAA

SEQ ID NO: 118904 - protein, 76 aa, Glycine max
  Coding DNA Sequence Number=SeqID_27219
MRIKIHETQCGPPWVHRMNRKAWFEQNRGGGCRPARPGELSSPRRARLLPPEATAFWRNILEGPSGPGCYLHPHFY

SEQ ID NO: 118905 - protein, 174 aa, Glycine max
  Coding DNA Sequence Number=SeqID_27220
LGGIDGDSVLRGTRIKATWEYVSSIEGGQLGMVELCVICGRGKSTCTIARPPPRTTCDGVVPGDMSRGSGDLGDVRRAPGSQPIKEQGPQSKEACVVAGTLWILSDICDMASGNRLPRETMGAPGNRLPACVIDYTEGWVTGNRLPVPRGSLGDPRRQHEVPISGHHSIHGYIF

SEQ ID NO: 118906 - protein, 198 aa, Glycine max
  Coding DNA Sequence Number=SeqID_27221
MSVHWVYDGRGHMTITRAPRNTGSKQSFTRLEGGHNNQFREWGKGMTISVGSLILAIAHGSYKRLCQLLFSLDLATFIAIAGSLATFFRDMVEEKANALTPTAPTPSPKAGYLPEYNKRKAKKRRKRRMQKKVGTRFVGSTPLSKRSVGIRLYRTELSSHTYNLRCSPVSLLSYSTALGTDARLSAFHRYGYPAYLTT

SEQ ID NO: 118907 - protein, 62 aa, Glycine max
  Coding DNA Sequence Number=SeqID_27222
MAIGWTLADLPGINPSICMPRILLEDYSKLVRFWRGWQIHIAPEDRHKTTFTVYSAHLPTPG

SEQ ID NO: 118908 - protein, 92 aa, Glycine max
  Coding DNA Sequence Number=SeqID_27223
MAQPPPRERTLREMAAPDFTYESLCIQYPDEDVPYALKTRLVHLLPKFHGLADVQEDHIFLKAFPHSLEGVAKDWLYYLAPRSITSWDDLKR

SEQ ID NO: 118909 - protein, 138 aa, Glycine max
  Coding DNA Sequence Number=SeqID_27224
MEKSDRKTFKDKKEKKAYITWEDNDMDSSKESENEVVNLSLMAKNYESKEEITSSNNNLSISYDELKDAFNDLHKESFKLAKLVSFSKKTISNLEKKDLKLNEELENLRTEVKTLKPIEANQSSTIKVIQDNNEASNS

SEQ ID NO: 118910 - protein, 75 aa, Glycine max
  Coding DNA Sequence Number=SeqID_27225
MSGFTRDSPQISTSPHQLDLAPYASEPYNAQWNAPGLLRDKHTLRLGRILGEMETNFVVDLGIAFVDNWAVGKEK

SEQ ID NO: 118911 - protein, 159 aa, Glycine max
  Coding DNA Sequence Number=SeqID_27226
MGEFVDGRWEWKLSWRRDFFDYEIQMAADFVDEIHSGHIHKCYDFKNHPFDPEKRRTTPGTTPSICSSCMWRSTPGCLMNDNSISHLPAVNDMVCMQRDSRNLNTLQYMFWGWSAMYIINIILDSSKEQLHGMNMKALNEYMLSGIIHVCDLWNFKNIF

SEQ ID NO: 118912 - protein, 61 aa, Glycine max
  Coding DNA Sequence Number=SeqID_27227
MAFFLSYLDYKAQNAQVSNGLRNGNVAHITDIFSRSQRQLHVASLRSFIKRLPREAFWGSL

SEQ ID NO: 118913 - protein, 172 aa, Glycine max
  Coding DNA Sequence Number=SeqID_27228
  Gene Ontology: Mol. function=NADH dehydrogenase (ubiquinone) activity; Cellular component=integral to membrane; Biological process=electron transport
  Homolog annotation: Hit_ID=Q5MA12; Match level="QueryCoverage=74%, HitCoverage=90%, E-value=6e-66, Identity=97%"; Hit description=NADH -ubiquinone oxidoreductase chain 1
  Pfam annotation: Domain name=NADHdh; Domain location=1-162; Score= -150.6; E_value=0.00019; Accession=PF00146.12; Description=NADH dehydrogenase
MELGANLYFPGACLAPTSKSNAGAEKEPAQPLPESFACVTPPSPMLSHRQRLGKRGRATCRETCTCGSGRGPRYTVLICVGPRNSSEIVMAQKQIWSGIPLFPVLVMFFISRLAETNRAPFDLPEAEAESVAGYNVEYARDAILNSPLLAEANVPGSRGLILTETRGGSLPT

SEQ ID NO: 118914 - protein, 98 aa, Glycine max
  Coding DNA Sequence Number=SeqID_27229
MEHNGMALNDYTKGKHQTKAQIEQQDDYGVYYNCSSVSRTAAKYVSPLSHGVSCPARKGEYRRVTRVRSPSVTWLSTCRAHHIGLHETNVVEVSAFLF

SEQ ID NO: 118915 - protein, 90 aa, Glycine max
  Coding DNA Sequence Number=SeqID_27230
VIIKNGEIVEAKLHDESRLIQRCFDDNKDDDKGDDKKLKEHFKTQEEKLKNTSRFRRKVEFKNQESRFKDQASRIKIKIQDSRFKNQEKT

SEQ ID NO: 118916 - protein, 340 aa, Glycine max
  Coding DNA Sequence Number=SeqID_27231
MAGLPQKYLEDKARGMANQGEWVPFMDVLALLIFGVVLFPNVDGLVGLAAIDAFLAYHHSKESPVVAVLADLFDTFDRRMDWDQLLAGIGSRTISWFPRWKEGKEGVLFLMWKIPKHSAGISAHKIPNYTKIHKAWETPLRKDQELRGIRNGIIGGYHEWLKVRIRGLDWLAKLKVVSEENFEAPEEDEEVQALKSELGKAKLAKEKFKLADTHVRKECAGLREENAITARALERETKRARKEEYGRNKFRGALWGSNSELKLRREERDQSRAHSMVLKEELMACSRSKRSLSQRLCETETNMLAIIAKYQEELGLATAHEHRIADEYAQVYAEKEARGR

SEQ ID NO: 118917 - protein, 68 aa, Glycine max
  Coding DNA Sequence Number=SeqID_27232
MVPSGVANCRSLPFGGRATRGLMGASSKKEKCAESPPTFIRGKRRKNRKGCFPCFYVFLNCDMEIRST

SEQ ID NO: 118918 - protein, 89 aa, Glycine max
  Coding DNA Sequence Number=SeqID_27233
APVASVSISCPSVQLLTGWCVTAKAPPDISAGKCSGHAARNHPHPPRLMRRYRARPIRHSGCATVGKGDRCGPLRYYASWRKGDVLQGD

SEQ ID NO: 118919 - protein, 83 aa, Glycine max
  Coding DNA Sequence Number=SeqID_27234
LCQFYGVPVAPSKVIRPPTNRAFIKKYCVPRQAQGETPQQPGDGRQRATDVPPSPLEFTSAHPQKAIRRPAQDVKEALLGGNL

SEQ ID NO: 118920 - protein, 142 aa, Glycine max
  Coding DNA Sequence Number=SeqID_27235
  Homolog annotation: Hit_ID=Q6WAY6; Match level="QueryCoverage=60%, HitCoverage=15%, E-value=1e-07, Identity=37%"; Hit description =Putative uncharacterized protein
MGTRGCISYNPNLAIRQLGYPMRGAPLEEELTPVISRGFNKTNMETLLKVRKAWEVVQKKDKELRGSNNGPSGGYREWLKAHVQGLDWLPSLRTAKREEVEAPEEDEEVQDLRIELEQAQTVKERFKSVALRIQKENAKLRD

SEQ ID NO: 118921 - protein, 154 aa, Glycine max
  Coding DNA Sequence Number=SeqID_27236
MLNEGSVGKLFCKNEKDNVQLLMCISQCSPTINHNNNPATSFQSTPPSHGTLSIDDSERCSKRHAVNNAKLAVYYPDEHQTPTNTTQHDQFVGYDSSDSSDDDVNMIQENIDIEYSLNDPTIDDLDDYDEQTFLSASSAYQNTGGTYIDIGDPI

SEQ ID NO: 118922 - protein, 227 aa, Glycine max
  Coding DNA Sequence Number=SeqID_27237
NGIIGGYHKWLRVRTQGLDWLPNLKIVRDDEVKASEESDEVQALKAKLERARVVKEKFKNSELKLRRGERNLMGQRHVLKDELKACLSGLLTTRGLEDEYAKISQHEELDRECGLDRLLKGSKNFPDCAKAKARLNARKFILALIMARKARSSPFWPCMTRSTGDVKRAAQELILSSCEGYPMRGVPSDESITPFIARGFSDHNARVLQGVCKAWMRREERTESLGK

SEQ ID NO: 118923 - protein, 346 aa, Glycine max
  Coding DNA Sequence Number=SeqID_27238
MSLQISSEEIARRHWTSLVTPMAKFDPDIVLEFYVNAWPTKEGVRDMRSWVSQFLGDLLVLEEGQECEFSQRGNKVDGFDEEAIAQLLCTLGQDFARTAAGRRVQIMRTNMTTLTQMWMTLLLSNVLPSDYNSDLPLPKCQLVYVILTRMSVHVAQLIVYAIYLFEGMPPTRHPLDLDKSNRALGFPTLITDLCQSFGVSVTPSKVIRPPITWAFIEKYCTPRQAQGDALQAADAPPPPHQADPVGSLGMERYLQHLVRQQAANHRGQVQIHECLYQLSLSQQGQGFAPFACPTPDQFKAEVAWPGDWPEAQAGEAPAGAPGDAEEARMDEEMTDLLGFLGGSGAT

SEQ ID NO: 118924 - protein, 85 aa, Glycine max
  Coding DNA Sequence Number=SeqID_27239
MADYRNLASAFSFSKNLHILHLYSLCAFSTLKHQSYTVQIDQEHFKVQKEIDFNNQESSFKIQVPRIKIKIQDSRFKNQEKTQSR

SEQ ID NO: 118925 - protein, 73 aa, Glycine max
  Coding DNA Sequence Number=SeqID_27240
MAPRKLPAKRSRKDKVAEGTSAAPEYDSHHFRSAKHHSISRPSKDGMPPTRHPLDPDKSNRALGFPALITGLC

SEQ ID NO: 118926 - protein, 43 aa, Glycine max
  Coding DNA Sequence Number=SeqID_27241
MEYLLVGDEQKRKTESKNAKKDDPRAANSSIPWGWLAQLAQAS

SEQ ID NO: 118927 - protein, 243 aa, Glycine max
  Coding DNA Sequence Number=SeqID_27242
MEFGSEYIEKAKPVGLPESRHDDRVGVKGSRGLHVITPSVEHLLQAHLYVLNNNNEVLPYILQHEATPMIVRTDDVLSREDYEYLEKKLMDEKRKKKQEEAAQSGSTEVMIDPPSPIRRHVKWKMARTKKIGHMTSEVTKEIAERIDSLEEHASQGSFVPHGHQDVLTAAIGQPEHAGHVCAVGVGVTIKQYFGPAQRTARSTSSIAPEELVQLTQQIKDQLEESITEKVTQQLMLSFSEMQS

SEQ ID NO: 118928 - protein, 267 aa, Glycine max
  Coding DNA Sequence Number=SeqID_27243
  Homolog annotation: Hit_ID=Q6WAY4; Match level="QueryCoverage=76%, HitCoverage=40%, E-value=3e-23, Identity=32%"; Hit description =Putative uncharacterized protein
MGSSQKPSLKKRFYQVKIKSLEVTSLRELGQLMGQLQRQAFCKAYGKIWDLARVEVSMEPIASLSQYYDQPLRCFTFEDFQLVPTVKEFEEILGCPLGGRKPYLFSGFYPSTTRVAKVVKISAQELDRVKQNRNGVVGVPRKCLEERAKALANQGEWASFFGILALLIFGGVLFPNMEGLVDLAAIDAFLVFHHGKESPVVAILPCMTRSTRDVKRAAQELFVVHRLSMCDWFRTFFSKKVGPSIRYKVNAPASKKERRIGTNSWLA

SEQ ID NO: 118929 - protein, 68 aa, Glycine max
  Coding DNA Sequence Number=SeqID_27244
MWGDCGSNAFKGYFDDAKEFKNQEKDSRVVSSFHESRVKNNQEQDSRLKIQESREDLIKISMKRFFQN

SEQ ID NO: 118930 - protein, 279 aa, Glycine max
  Coding DNA Sequence Number=SeqID_27245
MIMRGQDIYSSQDEATTSPSSSESEEAKGEESSEEIYPKEDGQPLVVKEKCKEVSVSSKRLAKKETHFIIKTNIKETFPLRKPPHFLFCKKTLASIATPLGLEFIPQVKKLLDEGLVRKSLNPCAFLVPKIGIIRHQVPKIGGMMNVLSGATLFVNTRTPIFPGIRKNHILRNQHHNSCKSLSEELRDYYEGRHRSHLRPHSHRREKDRKPQEANINLPYFHGKDNVEANLVWEIRVEQQLKKKSTSKSYGSHSYPKKDQGQGILGVTPSKPKDDKGKT

SEQ ID NO: 118931 - protein, 275 aa, Glycine max
  Coding DNA Sequence Number=SeqID_27246
  Gene Ontology: Mol. function=motor activity; Cellular component=cell projection
  Homolog annotation: Hit_ID=A8WK14; Match level="QueryCoverage=97%, HitCoverage=88%, E-value=4e-17, Identity=21%"; Hit description =Putative uncharacterized protein
RLYVLASRALHVLAFRRQHTLDFRGLRVLDFRGLYVLASRGLHVLPSRGLHVLASRGLHVLTSRGLYVLVFIGLHVLACRGLHVLTFRGLHALAFKGLRVLTFRGLRVLASRGLHVLTSRGLHVLASKGLQVLAFRGLHILDSRGLHVLASRRLHVPAFRGMHALAFRGLHVLAFRGLHVLNFRGLRVLSFRGLCILPSRGLHVLASKGLHVLASKGLQVLAFRGLHVLASRGLHVLASRRLHLPAFRELHAVAFRGLHVLAFRGLLIEVIPKSK

SEQ ID NO: 118932 - protein, 167 aa, Glycine max
  Coding DNA Sequence Number=SeqID_27247
MTSRKRKSSASRPQAQYDTRYTDNILGQNILLEINVQIYHIEFAEFKVELERRNPHKCLTNLQEGSIDVAIIKEFYANLYNLEDQSPKQARVRGNLIKIDADSLNDFLETAVVLDEGESLPTYSRFCRLRTNHQEIKARLCIPYKGFVLNAEGQPWNILIKDLTTLA

SEQ ID NO: 118933 - protein, 359 aa, Glycine max
  Coding DNA Sequence Number=SeqID_27248
  Homolog annotation: Hit_ID=Q84VI1; Match level="QueryCoverage=100%, HitCoverage=64%, E-value=1e-135, Identity=61%"; Hit description =Envelope-like protein
MPDVEKDVPTSSGPNDEVLSSPSKERSTEEDDQAAEETPAPRAPEPAPGDLIDLEEVESDEEPIANRLAPGIAERLQSRKGKTPIKRSGRIKTMAQKKSTPVTPATSRRSKVAIPSKKRKEISSSESDDDVELDVSTSKRAKKSGRKVPGNVPDAPLDNISFHSIGNVEKWKYVYQRRLALERELGRAAMDCKEIVDLIKAAGLLKTVTKLGDCYEGLVREFIVNIPSDISNRKSDDYQRVFVRGKHQIAKEITAKRVQHWPKKGKAFSREAKCEHSESFAVKLPIAFPTVLCGIMLSQHPNMLNYTDSVIKRESPLSLHYKLFEGTHVPDIVSTSGKAAASGAVSKDALIAELKDTCK

SEQ ID NO: 118934 - protein, 170 aa, Glycine max
  Coding DNA Sequence Number=SeqID_27249
  Gene Ontology: Biological process=transposition, DNA-mediated
  Homolog annotation: Hit_ID=Q6UUU1; Match level="QueryCoverage=41%, HitCoverage=46%, E-value=5e-17, Identity=69%"; Hit description =Putative uncharacterized protein
GHQGFIYLRSDLPSQWLLFLSAVPPVQLLTGWCVTAKAPPDISAGKCSGHAARRVPFAIQAAQLLGRAIGAGLFAITPAGERGMCCKAIKLGNARRECILAYYVGTDEGVSEVLHVAGEKRLHRCVSRICDTGYIPLRRSLTRYARSFDCGERKCLRTGRRFPGRCQEDT

SEQ ID NO: 118935 - protein, 122 aa, Glycine max
  Coding DNA Sequence Number=SeqID_27250
VPPVQLLTGWCVTGKKHPPDISAGKCSGRVPFAIQAAQLLGRAIGAGLFAITPAGERGMCCKAIKLGIRSRTVETKDGKKKKEVAVQGRMRKNAINSSGGEDNRHDGDDRHVFRVFEWNKLR

SEQ ID NO: 118936 - protein, 171 aa, Glycine max
  Coding DNA Sequence Number=SeqID_27251
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=99%, HitCoverage=30%, E-value=4e-79, Identity=67%"; Hit description =Photosystem I P700 chlorophyll a apoprotein A2
PAFNAGRSIWLPGWLNAVNENSNSLFLTIGPGDFLVHHAIALGLHTTTLILVKGALDARGSKLMPDKKDFGYSFPCDGPGRGGTCDISAWDAFYLAVFWMLNTIGWSGHGMFLFGHLVWATGFMFLISWRGYWHELNETLAWAHERTPLANLIDGEINSGSFPLVQARMVD

SEQ ID NO: 118937 - protein, 244 aa, Glycine max
  Coding DNA Sequence Number=SeqID_27252
MRGAPTEESLSPFLVIQRVHKAWRSPLRKDKELRGIRNGVIGGYHGWLRVHTRGLDWLSKLKVIDEENFEAPEEDEEVQVLKLELGKARLAKEKFKSAATHIQRECTELREENAATARALEQETKRARKEEHGREKFRGALWGSNNELKLQREERDRSWVHGMILKEELAACARSKRSLAQHLEATEQSMLAIIGQYKEELNQSVTHEQKLVEDFAQVYAEKEARGRVIDALHQKRLCGWIGSL

SEQ ID NO: 118938 - protein, 166 aa, Glycine max
  Coding DNA Sequence Number=SeqID_27253
MATDEPWNENQKARRKNTPKQSFEGLYRAAIVSSSSEEVKGIITGQRHDLEGRAKSETEGNMWAIIDKCKEKLNLAATHEQRLEDEYAKISAEREVRERVIDSLHQEATMWTDRFALTLNRSQELPPLLAKAKAVADTYSAPEEIHGLLSYCQHMIDLMDHMIRNR

SEQ ID NO: 118939 - protein, 374 aa, Glycine max
  Coding DNA Sequence Number=SeqID_27254
  Homolog annotation: Hit_ID=Q84VH5; Match level="QueryCoverage=100%, HitCoverage=62%, E-value=1e-177, Identity=78%"; Hit description =Envelope-like protein
DQATEETPAPRAPELAPGDLIDLEEVESDEEPIAKQLAPGIAERLQSRKGKTPITRSGRIKTIAQKKSTPVTPTTSRWSKVAIPSKKRKEISSSDSDDDVELDVPDIKKAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQTVLSEEKHQIAKEITSKQVQHWPKKGKLSAGKLSVKYAILHRIGTANWVPTNHTSTVATESFAVKLPIAFPTVLCGIMLSQHPNILNNIDSVKKRESALSLHYKLFEGTHVPDIVSTSGKAAASGAVTKDALIAELKDTCKVLEATIKATTEKKMELERLIKRLSD

SEQ ID NO: 118940 - protein, 80 aa, Glycine max
  Coding DNA Sequence Number=SeqID_27255
MMIKKDDDKGDDKKLKDQSENNSRVQDKNQEEFKTQEESLESRIKIQGSRSQESRSRFKTQDSRIKRRLNQDKYEKFSQN

SEQ ID NO: 118941 - protein, 149 aa, Glycine max
  Coding DNA Sequence Number=SeqID_27256
  Homolog annotation: Hit_ID=A5B939; Match level="QueryCoverage=23%, HitCoverage=22%, E-value=8e-07, Identity=74%"; Hit description =Putative uncharacterized protein
  Subcellular localization annotation: CTP_CleavageSite=44; ConfidenceScore=5.47e-01
SGRWNNVGKGSRQNGSVTSGKGLALRAGHGGPSPEPVGCRWTARAASAARAGRRVPVGGRIGNGPFGASSPGVEQSTQNCIAMVPADVDAVISARYLTHVKGEEIQDQADGFPLSLSTIQRANHSQVGTGLAESAGKEGDPGADSSPTL

SEQ ID NO: 118942 - protein, 79 aa, Glycine max
  Coding DNA Sequence Number=SeqID_27257
MASWREQLMQYEAAPIEKNRPQTTGRLEVRAHCTGKEEQLNIIKTLKIYGGEGVEFYPTDPRRAGTRHVASTQTSQYCQ

SEQ ID NO: 118943 - protein, 100 aa, Glycine max
  Coding DNA Sequence Number=SeqID_27258
MAVAKLHFEVCGGTTAKFVDGVDDLDLCSSGALGVEVALTEDFVEGGDDDIAKVGGLESGCKFHVPATHTTLERRTQIRRTLFQEVSPSTASEVSTTCLA

SEQ ID NO: 118944 - protein, 236 aa, Glycine max
  Coding DNA Sequence Number=SeqID_27259
MGGTYSDLEAERYKWSSEEFPQETALKYTPVSDKSKFSIFRLSVRPEKVLLRLADTLCHDHPVRLHMELTAERHNGYFNPRLVRVVVEGVNTLSDLDVNALGAHTHFSYSCVSRSCNYHVSKVSDMTWEVFHTYELSMKTLLRFYVNIECHKVTGLSAMFRGPFKFKVPAFVTESMIQRSTPVIQREVNGEPPKAINAFLESEFTGKQYILFQQEGKLGNSSTTQVVLWARSESHC

SEQ ID NO: 118945 - protein, 167 aa, Glycine max
  Coding DNA Sequence Number=SeqID_27260
  Gene Ontology: Mol. function=structural constituent of ribosome; Cellular component=ribonucleoprotein complex; Biological process =translation
  Homolog annotation: Hit_ID=Q9M4Y3; Match level="QueryCoverage=61%, HitCoverage=52%, E-value=4e-53, Identity=98%"; Hit description=30S ribosomal protein S10, chloroplast precursor
  Pfam annotation: Domain name=Ribosomal_S10; Domain location=70-165; Score=190.2; E_value=5.1e-54; Accession=PF00338.13; Description =Ribosomal protein S10pS20e
MTCGKVKSCMGYRERGREGLKELFIDEQGMYTWQFYYFVHSINVDSLIQYAVSLFFMSFFVILSMAPKQKIRIKLRSYWVPLIEDSCKQILDAARTTNAKTMGPVPLPTKKRIYCVLKSPHVHKDARFHFEIRTHQRLIDILYPTAQTIDSLMQLDLPAGVDVEVKL

SEQ ID NO: 118946 - protein, 54 aa, Glycine max
  Coding DNA Sequence Number=SeqID_27261
MVKLPRNVITHSLCVVVFDPVMILNLCSGEQMNRWMTMKNLMLEDTGTPCSDRM

SEQ ID NO: 118947 - protein, 105 aa, Glycine max
  Coding DNA Sequence Number=SeqID_27262
  Subcellular localization annotation: CTP_CleavageSite=57; ConfidenceScore=5.20e-01
MTYAVPVDSKKFIKNRSLSNPQALMKEPNLDTTISDSFCIKGSTSRNLTYTQSSGFRRNAERCTNSMECPSVRKQWDSIVPFKHSEYWNWKVECINYIERNQTNK

SEQ ID NO: 118948 - protein, 178 aa, Glycine max
  Coding DNA Sequence Number=SeqID_27263
  Homolog annotation: Hit_ID=A2Q4S5; Match level="QueryCoverage=47%, HitCoverage=13%, E-value=6e-07, Identity=39%"; Hit description=IMP dehydrogenase/GMP reductase, putative
MFMHTSHSSMLGALLAGYITLLQEHFSSVASVVPGEDYDERRPRACRWTSGKALSVFTYWRRLDRLTPNTVCWIPYGDHRSFRESEVISLFSSHLRWGPLMVIHRPERVYDSSTTSRLFRHTLLRLRCLLQKLMIDGCSLVSTLHLQGIPPRVPPVQQHEEFVEPNMYQQPIAAAAPY

SEQ ID NO: 118949 - protein, 115 aa, Glycine max
  Coding DNA Sequence Number=SeqID_27264
  Gene Ontology: Mol. function=transposase activity; Biological process= transposition, DNA-mediated
  Homolog annotation: Hit_ID=Q3E8N4; Match level="QueryCoverage=77%, HitCoverage=44%, E-value=4e-18, Identity=53%"; Hit description =Uncharacterized protein At5g35695.1
MAIDMHQDFILLFFLFFLIERIFGIFKSRFTIFKSAPPFLFKTQAKLVLACAALHNFLRKECRSDEFPVEPTDESSSSSSVLPNYEDNDHEPIVQTQEQEREDANIWRTNIGSDM

SEQ ID NO: 118950 - protein, 858 aa, Glycine max
  Coding DNA Sequence Number=SeqID_27265
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=78%, HitCoverage=44%, E-value=0.0, Identity=60%"; Hit description =Multidrug resistance-associated protein 3
  Pfam annotation: Domain name=ABC_membrane; Domain location=333-602; Score=75.1; E_value=2.3e-19; Accession=PF00664.14; Description=ABC transporter transmembrane region
  Pfam annotation: Domain name=ABC_tran; Domain location=676-831; Score= 76.2; E_value=1.1e-19; Accession=PF00005.18; Description=ABC transporter
  Pfam module annotation: Pfam domain module=ABC_membrane::ABC_tran; Domain location=333-602::676-831
MATVEWNSTVLYSAPVVAAVVEVVSLPEVEWIVVSSYPAWWRPLISEKYLEGYPWWACCVCDKEGRFMVARTSCHPGPNRVSQSLKERQVEFFKLCTNFHAWLIWFPSSTVVSGAFSVTGLSQEKLVTLLDLVLKVVAWGVGGVCMHDELFISRERRLPFFFRGWCVLYLFVSGYCFIVNIVLYEKHAALPIQCLGSDVSSVCVGLFFCYLGFFVKFEGGVRNSTLQESLLNGDSNDNDVFGTNETKGGDTVTPYSYAGIFSILTFSWVSPLIAGGKKKSLDLEDVPQLDKRDSLIGAFPIFSDKLEAYCGATNTLTTLKLVKSLVFSTWKEIIFTAILALVNTLATFVGPYLIDCFVQYLNGKRQFEKEGLVLVSAFCVAKLVECLTKRHWFFRLQQVGIRMQALLVTIIYNKALNLSCQSKQGQTTGEIINFMSVDAERVGEFSWHLHDLWLVVLQVLVGLLVLYKNLGLASIAGFVAILIVMWANIPLGSTQEKFHNKLMESRDERMKATSEILRNMRILKLQGWEMKFLSKITELRKIEQGCLKKVIYTLVLIISIFWCAPAFVSVVTFGTCMVIGITLESGKILSTLATFQILQEPIYNLPETISMMAQTKVSLDRIASFLRLDEMLSDVVKKLPPGSSDIAIEVVDGNFSWDSFSPNITLQNINLRVFHGMRVAVCGTVGSGKSTLLSCILGEVPKKSGILKVCGTKAYVAQSPWIQSSTIEDNILFGKDMERERYEKVLEACCLKKDLDILSFGDQTIIGERGINLSGGQKQRIQIARALYHDADIYLFDDVFSAVDAHTGSHLFKNAPTMWDRHRLKGALKPGVFTPKAYTPKSLLGPLPLDSGSTQKTF

SEQ ID NO: 118951 - protein, 459 aa, Glycine max
  Coding DNA Sequence Number=SeqID_27266
  Gene Ontology: Mol. function=nucleoside-triphosphatase activity; Cellular component=integral to membrane; Biological process=transport
  Homolog annotation: Hit_ID=Q9LK50; Match level="QueryCoverage=92%, HitCoverage=64%, E-value=1e-133, Identity=57%"; Hit description =Putative white-brown complex homolog protein 27
  Pfam annotation: Domain name=ABC2_membrane; Domain location=249-456; Score=44.8; E_value=3e-10; Accession=PF01061.15; Description=ABC-2 type transporter
  Pfam annotation: Domain name=ABC_tran; Domain location=1-141; Score =23.5; E_value=8.8e-09; Accession=PF00005.18; Description=ABC transporter
  Pfam module annotation: Pfam domain module=ABC2_membrane::ABC_tran; Domain location=249-456::1-141
IGFVIQEDVLYPQLTVEETLVFSALLRLPTHMSKQQKYAKVDTTIKELDLERCRHTKIVGGYLKGISGGERKRTCIGYEILVDHSLLLLDEPTSGLDSTAANKLLLTLLGLAEARRTIITTIHQPSSRIFHIFDKLLISEGYPVCYGKAKDTMEYFSSLRFTPQIPMNPAEFLLDLATGQVNDIRVPTDILQDQESSDPSKVVIEYLQLKYKTLLEPKEKEENHRGANTPKHFQLAIQVKKEWTLSWLDQFVILSRRTFKIRCKDYFDKLRLVQALGIALLLGLLWWKSSTNTEAQLRDQVIAMLLLFSRYKIDLLITIFIAGKADMYRLSVYYACSTLCDMVAHVLYPTFFMVILYFMAGFKRTVASFFLTLFTILLIVITSQGAGELFGAAIMSVQRAGTAPSLILLLFLLTGGYNVQDPAEFTYIWHCKLERWKKTSVDSSGHGLSLSVVSLLVPS

SEQ ID NO: 118952 - protein, 183 aa, Glycine max
  Coding DNA Sequence Number=SeqID_27267
  Homolog annotation: Hit_ID=O65579; Match level="QueryCoverage=87%, HitCoverage=35%, E-value=4e-16, Identity=41%"; Hit description =Putative uncharacterized protein M3E9.20
MEDANLNYAESNRVSILTVDKFSRRMVLQFLGFNHVICYASPALAAPIMPDIKEPEDQKHMMEIWLNSIVYAGVEMDTLFSGKRRALIPPSVGYVNENLQPMPEESRKQQGSQLHFVGIGGEKMQGWFSGQSSEEEAKPASSLLADWNSYASAQTSEDSSTFPFDIESAVRSANDTVSGTFSV

SEQ ID NO: 118953 - protein, 226 aa, Glycine max
  Coding DNA Sequence Number=SeqID_27268
  Gene Ontology: Mol. function=metal ion binding
  Homolog annotation: Hit_ID=A7Q9D3; Match level="QueryCoverage=84%, HitCoverage=56%, E-value=5e-69, Identity=67%"; Hit description =Chromosome chr19 scaffold_66, whole genome shotgun sequence
  Subcellular localization annotation: CTP_CleavageSite=58; ConfidenceScore=5.84e-01
MASFPSNSALEHSMASAQQNSNPHASSPSFMTRVAMRISRSRWFTFLRRVFHYQNGPRSNLGSNPFNSSTWMMLELIALLVQIASTTFTLAISKSEKPIWPMRVWIAGYDIGCVLNLLLLCGRYHQLHVTQGNNALSLSELEQQRNNEESRTSHLIDKCRSSLELFFAIWFVMGNVWAFDSRFGSFPQAPKLQGHLMIKSHNSQVGDIKGFIPTWTLPMTLKAVKD

SEQ ID NO: 118954 - protein, 31 aa, Glycine max
  Coding DNA Sequence Number=SeqID_27269
MGIWTNKQRSERKMTGGKRKPESVPPTGLND

SEQ ID NO: 118955 - protein, 503 aa, Glycine max
  Coding DNA Sequence Number=SeqID_27270
  Gene Ontology: Mol. function=transferase activity; Cellular component= integral to membrane
  Homolog annotation: Hit_ID=Q4VWQ6; Match level="QueryCoverage=89%, HitCoverage=89%, E-value=0.0, Identity=72%"; Hit description=Beta 1 ,2 xylosyltransferase
MNKRTTLLIRTLLFLFVLNSLYLSLYFTHKPSSSSEEEQEKSELEPDTYLTPFSHEPHFSKPWPIVPSHIPWTTTSARSHSCEAYFGNGFTRRRDVLLPRGGAGWFRCHHSDTLRNSVCEGGRLRMAPEKITMAKGGEDLAAVMGRTEDEEMPVFQNGAFQVDGGEVVVDRELLVDQEFLDEYVPRGGIDRHTMRELIAKIRIVRGKDFQCDEWIEEPTLLVTRFEYANLFHTVTDWYSAYVSSRVTGLPNRPHVVFVDGHCKAPLEETWKALFSSVRYAKSFSGSVCFRHAILSPLGYETAMFRGLSEHIDCHGAPAQELLQKPDDQKTARLSEFGEMVRAAFGLPLNIHRDGKSLAGHNVLFVRREDYLAHPRHSGKLESRLSNEQEVFDSLKSWTFNYKGCKINLVNGLFAHMSMKDQVQAVHDASVIIGAHGAGLTHIVSALPKTVILEIISSYYRRPHFAYISRWRGLEYHAINLAGSHADPGTVIKELANIMKSLGC

SEQ ID NO: 118956 - protein, 1521 aa, Glycine max
  Coding DNA Sequence Number=SeqID_27271
  Gene Ontology: Mol. function=glycerophosphodiester phosphodiesterase activity; Cellular component=anchored to membrane; Biological process=glycerol metabolic process
  Homolog annotation: Hit_ID=Q2WGN6; Match level="QueryCoverage=94%, HitCoverage=93%, E-value=0.0, Identity=54%"; Hit description =Putative glycerophosphoryl diester phosphodiesterase family protein
  Pfam annotation: Domain name=GDPD; Domain location=1096-1384; Score =55.7; E_value=1.6e-13; Accession=PF03009.8; Description =Glycerophosphoryl diester phosphodiesterase family
  Pfam annotation: Domain name=GDPD; Domain location=388-677; Score =57.3; E_value=5.3e-14; Accession=PF03009.8; Description =Glycerophosphoryl diester phosphodiesterase family
  Pfam module annotation: Pfam domain module=GDPD::GDPD; Domain location=1096-1384::388-677
  Subcellular localization annotation: CTP_CleavageSite=25; ConfidenceScore=5.21e-01
MWKPRAVPRAFSLLHLLFHSVLVLVSAQGSNRTTWNTLTGSENFGVGAENQLVEVGVDKLLSEFGSPPLVIARGGFSGIFPDSSEFAYNLAAVTSLKNLIVWCDVQLTKDGEGICIPNIKLENATNIDNVFQNRSKTYSVNGVQTSAYFAVDFTFEELYSKGDFTRSDKFDNNLFQILTVNDLVKNEAPPGLWLNIQHDAFYEQHNLSMKNFVLSVSRTVNVNYISSPEAGFLRTIRARINPRITKLVFRFLEKDEVDPSTNQTYGSLLKNLASIKTFASGILVPKGYIWPIDPSSLYLLPHTSLVSDAHKVGLEVFASDFLNDVPISYNYSYDPVAEYLNFIDNGNFSVDGVLSDFPLTPSEAIDCFAHVGLNATKKVNTLVISKYGASGDYPPCTDLAYEKAISDGVDVLDCPVQMSKGGIPFCLSSIDLIESTNVAQSNFSKLGKIIPEIKSGNGIFTFDLAWDDIKTLTPSMLNPYSINSLYRNPKYNKKGHFLTLSDFLNLPKGQTSLLGVVITIENAAYLARKQNLSVTEAVIDTLSKAGYDKPGAPKVMIQSTNSSVLLKFKEKTKYELVYKIDEIVGDAVDSAILDIKRFAHSVVVKKASVYPVSKFFVTGSTKIVPKFKSSNLSVYVETFRNEFVSQAWDFMSDATVEINTFVQDAEIDGVITDFPKTANRYRRNRCLSLGDSKPPYMEPVRVGSLLLAMDKYSLPPALAPAPPLTEAKVTEPPLPPLSKTAPSSPIAGTGQGAQPPQNAQSKSEWGSENFGAGAGNQLVEVGVGELLSDIGSPPLVIARGGSSGIFPDSSEYAYELAAQISLKNLIVWCDVQLTKDGEGICISNIKLENATDIDKIFENRSKTYSVNGVQTSAYFAVDYTLTELRSNVLLIQGDFARNPNFDDNFEILTVNEMITITPASGPWLNIQYDAFYAQHNLSMKNFVLSVSRTVNVSYISSPEAGFLRSIKAHINPRITKVVFRFLEKDEVDPSTNRTYGSLLKNLASIKTFASGILVPKGYIWPVDPTGLYLLPHTSLVSDAHKVGLEVFASDILNDIPISYNYSYDPVAEYLNFIDNGNFSVDGVLSDFPLTPSEAIASGDYPPCTDLAYEKAISDGVDVLDCPVQMSKDGIPFCLSSIDLIESTDVALSSFSKLGKIIPEIKSGNGIFTFDLAWDDIKSLAPSMLNPYSTSSLYRNPKSNKKGQFLTLLDFLNLTKAQTSLLGVVIIIENAAYLARKQNLSVTEAVIDTLSKAGYDKPGAPKVMIQSTNSSVLLKFKEKTKYELVYKIDEIIRDAVDSAISDIKRFAHSVVVKKASVYPDRKQFVTGSTKIVPKFKSSNLTVYVETFSNEFVSQAWDFMSDATVEINTFVKDAGIDGVITDFPKTANRYRIKLVFPSCPIQNYNGVLLSHLITDMIVTHPTAGNRCLNLGDRKPPYMKPVQLPGLLSKIDNFSLPPALAPVPPLTEAEVTEPPLPPLSKIAPSSPIAGTEPGAQPPRNAQAKVTVVFLLSTLTTVLVGSLLL

SEQ ID NO: 118957 - protein, 272 aa, Glycine max
  Coding DNA Sequence Number=SeqID_27272
  Gene Ontology: Mol. function=transporter activity; Cellular component= intracellular; Biological process=transport
  Homolog annotation: Hit_ID=A7Q9A8; Match level="QueryCoverage=98%, HitCoverage=89%, E-value=1e-102, Identity=63%"; Hit description =Chromosome chr19 scaffold_66, whole genome shotgun sequence
  Pfam annotation: Domain name=CRAL_TRIO; Domain location=37-211; Score= 15.9; E_value=1.6e-05; Accession=PF00650.11; Description=CRALTRIO domain
MGGGNQEAVKQLQTLMENVDDEQLKNTFQKPIPMDLYRAIRDSQLIGMSGYSKEGLPVIAVGVGLSTYDKASPTATRKHGRYIGTCVKVLDMTGLKFSALNQLRLLTAISTIDDLNYPEKTDTYYIVNVPYVFSACWKVVKPLLQERTRRKIQVLQGCGKEELLKVMDYASLPHFCRKEDSKSSKHHALGNIGNCFSFNHAFHQQLYNHIKQQSIIVESISPIRQGSFYVDIPEPDPDDAKIAKTIETEFHKLENQKNGFTNSLNGLRVNGH

SEQ ID NO: 118958 - protein, 417 aa, Glycine max
  Coding DNA Sequence Number=SeqID_27273
  Gene Ontology: Mol. function=metal ion binding; Biological process =defense response to fungus
  Homolog annotation: Hit_ID=A7P0H2; Match level="QueryCoverage=88%, HitCoverage=37%, E-value=1e-60, Identity=35%"; Hit description =Chromosome chr19 scaffold_4, whole genome shotgun sequence
MAMLMVGSAAGVVVGEVAAAAEKEKSESREKRSQKLGARRKGAAIRRVHWNVEKALANKFIDKPLTFRPKLLILTVPPETERLDEKRSPYDLVWDDKSFLLGKSFYLLGSVDANDRQIEQWNVKPPPLYLWSRPDWTDKHKVIAQEHGHFISQRELSRIKSFDKEKSPASHTMDDSYGFDIMPGHNILNSTDAPKDEGQTGCSPHGNVDRESQERLEYRVRKADKTSWKRKRTEENDGRLDYDLGDKSYRHMEPTSSSRMGEIRAAYSRTQNWPSFANPLYDSGITDVGEHRSSLPRDTAHSFKYRPYAKEDENYLKELDTRQQTRHYGIQNPNSVTSNYLSGSHHHMGPSYPACGLASESPYVMNTPAMQRYAPRPDELNHARMDPLGAAPPGYGSRMPGFAAGSHHVSSRQNSAD

SEQ ID NO: 118959 - protein, 244 aa, Glycine max
  Coding DNA Sequence Number=SeqID_27274
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=A7P0M4; Match level="QueryCoverage=84%, HitCoverage=41%, E-value=2e-79, Identity=61%"; Hit description =Chromosome chr19 scaffold_4, whole genome shotgun sequence
  Pfam annotation: Domain name=GATase; Domain location=9-187; Score =30.9; E_value=4.4e-08; Accession=PF00117.19; Description=Glutamine amidotransferase class-I
MDWSLKLLLLISSDAILLCRMDEALCSYIEKDRPFLGICLGLQLLFESSEENGPGFLIINSGGNSAQCTSSSIKGLGLIPGTVGRFDSSNGFRVPHIGWNALQITKDLGILDDVGNYHVYFVHSYRAMPSDDNNEWISSTCDYGDKFIASIRRGNVHAVQFHPEKSGGKQKPGEGKASKLAKRVRNLSKPVDIAGQYYKEGADEVSFLNITGFRDFPLGDLPMLQIIFDPLSAVVSMFHAPNAS

SEQ ID NO: 118960 - protein, 258 aa, Glycine max
  Coding DNA Sequence Number=SeqID_27275
MSHKEKKNVIEFLDEQAFYYDKEDEQWFKEKDDQWAKNIPCYKEDAVLNSVHFDFDMQDLDEFLMVLGTEDSSPERVPDPIIPVTPPISGRVQVPSPPRVHAPAPQRVYTFANLVSATSAPTARVPAPHESPEETFNGIASGQKFVPSKNPFQVASHAQKYFKPKNNPKKERKRKSIHDITLEDINTIVTPRIDQHNWVPPPPNFAAQPHEIRHAQPMQQFNQHNPFHQMQQFQHIMPSQMNIYGYSNNWPHDSEHAN

SEQ ID NO: 118961 - protein, 498 aa, Glycine max
  Coding DNA Sequence Number=SeqID_27276
  Gene Ontology: Mol. function=nucleotide binding; Cellular component =protein complex; Biological process=protein polymerization
  Homolog annotation: Hit_ID=A7P0I3; Match level="QueryCoverage=77%, HitCoverage=96%, E-value=1e-131, Identity=66%"; Hit description =Chromosome chr19 scaffold_4, whole genome shotgun sequence
  Pfam annotation: Domain name=ATP_synt_H; Domain location=436-495; Score=-6.3; E_value=0.013; Accession=PF05493.4; Description=ATP synthase subunit H
  Pfam annotation: Domain name=DUF1903; Domain location=9-67; Score= -13.7; E_value=0.071; Accession=PF08991.1; Description=Domain of unknown function (DUF1903)
  Pfam annotation: Domain name=Tubulin; Domain location=60-235; Score =267.9; E_value=2.1e-77; Accession=PF00091.16; Description =TubulinFtsZ family, GTPase domain
  Pfam annotation: Domain name=Tubulin_C; Domain location=237-354; Score=104.9; E_value=2.4e-28; Accession=PF03953.8; Description =TubulinFtsZ family, C-terminal domain
  Pfam module annotation: Pfam domain module=ATP_synt_H::DUF1903::Tubuli n::Tubulin_C; Domain location=436-495::9-67::60-235::237-354
  Subcellular localization annotation: CTP_CleavageSite=65; ConfidenceScore=5.59e-01
MAMLPLTNPTPIRHNALSSSSFVQRKCVSLIPRIRTCDSEPQRRRFASVTCCSFSTLDSAKIKVVGVGGGGNNAVNRMIGCGLHGVEFYAINTDAQALLHSSAENPIKIGELLTRGLGTGGNPLLGEQAAEESKEAIANALQGSDLVFVTAGMGGGTGSGAAPVVARIAKEAGYLTALEAIEKLQKNVDTLIVIPNDRLLDMADEQTPLQDAFRLADDVLRQGVQGISDIITIPGLVNVDFADVKAVMKDSGTAMLGVGVSSSKNRAEEAAEQATLAPLIGSSIQSATGVVYNITGGKDITLQEVNRVSQVVTSLADPSANIIFGAVVDDRYNGEIHVTIIATGFSQSFQKILLTDPRAAKLLDREPGGQESKAASPPLKSSNYPSTDGEGIRERIGGVGERGGYRGTIYISGGENSTLEEFVFSDRDLEGKRIDMGFLVTTLIFVVIGIIACLCTRICCNRGPSANLYAPSDSLSFFPILCSQCIDFDALAMRVVRV

SEQ ID NO: 118962 - protein, 224 aa, Glycine max
  Coding DNA Sequence Number=SeqID_27277
  Gene Ontology: Mol. function=methyltransferase activity; Cellular component=cytoplasm; Biological process=fatty acid biosynthetic process
  Homolog annotation: Hit_ID=A7P0J1; Match level="QueryCoverage=93%, HitCoverage=54%, E-value=7e-95, Identity=80%"; Hit description =Chromosome chr19 scaffold_4, whole genome shotgun sequence
  Pfam annotation: Domain name=Methyltransf_7; Domain location=1-223; Score=144.5; E_value=2.9e-40; Accession=PF03492.6; Description=SAM dependent carboxyl methyltransferase
MVLIIQHEFKYELRVPESVLDKRSSAHNKGRVFIHGASEITANAYKKQFQTDLATFLSSRAVELKRGGSMFLVCLGRTSVDPTDQGGAGLLFGTHFQDAWDDLVQEGLISGEKRDSFNIPVYAPSLQDFREVVEADGSFAINKLEVFKGGSPLVVNQPDDDGEVGRALANSCRSVSGVLVDAHIGDKLSEELFMRVERRATSHGKELLEQLQFFHIVASLSFAL

SEQ ID NO: 118963 - protein, 109 aa, Glycine max
  Coding DNA Sequence Number=SeqID_27278
MAVTNSENRLLDENTCGSLLEKLQEILDGASKSRALLLQSLSDAKLELSSLLLALGENSFMGMLSSLLLALGENSFMGMNPNRATRGGALESTRDATIANREHLSDYLE

SEQ ID NO: 118964 - protein, 98 aa, Glycine max
  Coding DNA Sequence Number=SeqID_27279
MSTQEWGVLGWKKEKIAVLEEQKKMNVVKAEHEPTIEADQLAFRQTNVTHEMQGKLNMNEMLEETKDSNIGNLDLGSDFQSNTGENSHDSDSQLENSI

SEQ ID NO: 118965 - protein, 342 aa, Glycine max
  Coding DNA Sequence Number=SeqID_27280
  Gene Ontology: Mol. function=aspartic-type endopeptidase activity; Cellular component=extracellular region; Biological process =proteolysis
  Homolog annotation: Hit_ID=A7P689; Match level="QueryCoverage=100%, HitCoverage=80%, E-value=4e-95, Identity=48%"; Hit description =Chromosome chr4 scaffold_6, whole genome shotgun sequence
  Pfam annotation: Domain name=Asp; Domain location=45-339; Score= -91.8; E_value=3.6e-08; Accession=PF00026.14; Description=Eukaryotic aspartyl protease
MNLDNERVKYIQSRLSKNLGRENTVKDLDSTTLPAESGSLIGSANYVVVVGLGTPKRDLSLVFDTGSDLTWTQCEPCAGSCYKQQDAIFDPSKSSSYTNITCTSSLCTQLTSDGIKSECSSSTDASCIYDAKYGDNSTSVGFLSQERLTITATDIVDDFLFGCGQDNEGLFNGSAGLMGLGRHPISIVQQTSSNYNKIFSYCLPATSSSLGHLTFGASAATNASLIYTPLSTISGDNSFYGLDIVSISVGGTKLPAVSSSTFSAGGSIIDSGTVITRLAPTVYAALRSAFRRVESEQQVCLAFAANGSDNDITVFGNVQQKTLEVVYDVKGGRIGFGAAGCK

SEQ ID NO: 118966 - protein, 304 aa, Glycine max
  Coding DNA Sequence Number=SeqID_27281
  Homolog annotation: Hit_ID=A7P0K4; Match level="QueryCoverage=100%, HitCoverage=69%, E-value=1e-102, Identity=64%"; Hit description =Chromosome chr19 scaffold_4, whole genome shotgun sequence
MQRSVKILSVFVGPCFVAECAYKIWWYASGASQIPFLGNVYVSDAVACILELWSWLYRTTVIFLVCVLFRLICHLQILRLRDFARFFHVDSDVASVMTEHLRIRRHLRIISHRFRAFILLALLLVTGSQLACLLVTTKHTQDMNIYKTGELALCSVTLLSALCILLRSATKITHKAQAITGLAAKWHVCATLDSFDGVVTEGETPMAPQSSHETVFPNVGTDGESETDEAGDEEDEIDTTKLIPSYAYSTISYQKRQALVNYFENNRAGITVYGFMLDRSTLHTIFGIEMSLVLWLLGKTIGFS

SEQ ID NO: 118967 - protein, 523 aa, Glycine max
  Coding DNA Sequence Number=SeqID_27282
  Gene Ontology: Mol. function=nucleic acid binding; Cellular component= intracellular
  Homolog annotation: Hit_ID=A7P676; Match level="QueryCoverage=95%, HitCoverage=95%, E-value=1e-144, Identity=56%"; Hit description =Chromosome chr4 scaffold_6, whole genome shotgun sequence
  Pfam annotation: Domain name=G-patch; Domain location=320-364; Score =59.3; E_value=1.4e-14; Accession=PF01585.14; Description=G-patch domain
MGSEEERVLENQLELQLQEQRDSLSAIDQALLSDPTDPELLALNLANGASLSRSREPRSESLLGDVHEELVQAIKDAEEGLLHLKRARLLQEADSVLHNTNIFTEEKVDPLDPTYVEPEPLEDKCYSVGSKCRFRHKDGRWYNGQVVQLDNSVAKVSFLTPTSENMLVSFVYPQAYFPIYVMADLHNLLLGLDVQLSALKKYVPTIWKQSLVGSSIWAVSTANAGTWREAELKSWDEKAGVGQVVFRDDGSSVKLGAEEMALSEHAEMSDIESDSSLDQSDSSDYEEEEESQGIGFLESTNLQRGIQTETATFATWENHTRGIASKMMANMGYREGMGLGVTGQGMLDPIAVKVLPPKQSLDHALESHKREENKEKQGKKKQSRGGKRKREKKFAEANRAAKEEEESASDVFALINNHLAMHNEAFGGGLMKKQQSKGSEEGKKVDRRALVAYEEEVKDLKIRVEKLEHIVNANRKEKAVYEGAMRKLNETRKALADAEAVHASASNSVTSKEKEKRWLKLRG

SEQ ID NO: 118968 - protein, 673 aa, Glycine max
  Coding DNA Sequence Number=SeqID_27283
  Gene Ontology: Mol. function=signal transducer activity; Cellular component=trans-Golgi network; Biological process=protein modification process
  Homolog annotation: Hit_ID=A7Q9A6; Match level="QueryCoverage=100%, HitCoverage=100%, E-value=0.0, Identity=55%"; Hit description =Chromosome chr19 scaffold_66, whole genome shotgun sequence
  Pfam annotation: Domain name=DUF827; Domain location=25-565; Score =510.2; E_value=2.5e-150; Accession=PF05701.2; Description=Plant protein of unknown function (DUF827)
MVAKIRQSATESPNPKPEVGEIDTSPPFQSVKDAVSLFGEGAFSDEKPIFKKAKPYSAEAQTEPVKPVEFWVGSRVLISESADPETQLHVAQKELNKLREQVKNAETTKAQALVELERAKRTVEDLTQKIKVISDSREIAIEATAAAKCQAKQLTEEKYGVPGGTNGAWKEELESAVKRYASVMTELDAAKQALSKTRQEYDSSLDEKMFAFKQAAEAGDALKENTERASELSKEISAVKESVEQAKLASIVAQQQQTMILAEKDVLRQSYKATLGQSEKKLLALKKEFSPELAKNLEMQLAETMNEIGTLQKEMENKRTSDLDSVKSVTLELDDAKESLQKVADEESSLRSLVESLKGELENLKREHSELKEKESETESIVGNLHVKLRKSKSELEACMARESKVRGASEEMILTLSQLTSETENARREAEDMKNRTAELKKEAEVTMLAFEEAEKKLKVALEEAEAAKAAEKNALDHITVLTERTTAARASTSESGAVITISKEEFDSLSHKVEESDKLADMKVAAAKAQVEAVKASENEALKRLETTQKEIEDMKTATQEALKKAEMAEAAKRAVESELRRWREREQKKAAEAASRILAETQVSTESSPQHYRIQKQNPPRTTVEVKRFEKEKVSVSKKALLPNISGIFQRKKNQVEGGSPSYLPGENPV

SEQ ID NO: 118969 - protein, 149 aa, Glycine max
  Coding DNA Sequence Number=SeqID_27284
MEKQMFPTKFLLVLTTIWFALSNFAFKASADDVTQTPITCLNCSKCEYPCQQQPSPPLPYVAPPPPQSPTPYGYSIYGAPPPPKEKEKDPSKCPPAAGVQCCTPPDPYVFSPPNPYTPVPYGEGQRSASMLLQVVVPLMMLCSSFIFLF

SEQ ID NO: 118970 - protein, 274 aa, Glycine max
  Coding DNA Sequence Number=SeqID_27285
MEDESPVRGRSLVAREVKGTGENRSEDELSISFPSSTSDSKRTKNILVSGGKEAKKTKKSGGSQQMDGVVGSGKGTKSGRGSKFAPITIHGYGWVSVESWKKFKSSFFRVHPNLAYGDLKNLFYKEDGKTPKFPFYWQCFPFKFKFRPHQLLLAQEVKDIKIIKEWSREMSFMKGYDYKNLNSLVVNDQMEVGKTKKRKCAKDSSKSDLMKKSTKSVKGPIKGNNAKVEVTHLDEPEVVDKGLEENKVVEGDAESLEKKMRGKKAEKEREMELA

SEQ ID NO: 118971 - protein, 123 aa, Glycine max
  Coding DNA Sequence Number=SeqID_27286
MEAMKDKMASMMEAMLSMKKIMEVNVSSDKHSFIPYALPSNYTPPNVAHTPNENADNSAPIPIESQQPQFDHAHVSQPMGETHEAPQDHNLVDFEPHLRYATEGQVVDGVPLPNTLGGPQYCP

SEQ ID NO: 118972 - protein, 86 aa, Glycine max
  Coding DNA Sequence Number=SeqID_27287
  Gene Ontology: Mol. function=nucleic acid binding; Cellular component= nucleus; Biological process=mRNA processing
  Homolog annotation: Hit_ID=A7QGU1; Match level="QueryCoverage=45%, HitCoverage=2%, E-value=4e-09, Identity=69%"; Hit description =Chromosome chr16 scaffold_94, whole genome shotgun sequence
MSAPIGGILVISANTIHYHSQSASCALALNIYAITLDSREDSITGVATYPSAGGRQEDSWVRLPWEEDARSRHQRLFEENVGKTEK

SEQ ID NO: 118973 - protein, 179 aa, Glycine max
  Coding DNA Sequence Number=SeqID_27288
MPPTRHPLDPDKSNMALGFPALMTGLCQSFGVPVTPSKVIRPPITRAFIEKYCTPRQAQGGDPQAPNAPLPPHQADPAGSFDTERYLRHLVRQQAANHRAHVQAHDCLYQLSLRLQGQGFAPFPCPTPDQFRAEVAWPEDWPKAQAGEAPAEAPGDVDEACMDEEMMDLLDFLGGSGAT

SEQ ID NO: 118974 - protein, 140 aa, Glycine max
  Coding DNA Sequence Number=SeqID_27289
MRLPGKESLLMKSPITINEILDVSISFLNDHLEETLGSTKIEEIHSKCINLAQCGARKKKVASARDFGWVRFMVSQDFGSRLVEWLDMIHVRVWFGSRIKRDAPHYFHDTNAKMMIWKFYAKLATHAPMWTLKCQIFMVM

SEQ ID NO: 118975 - protein, 70 aa, Glycine max
  Coding DNA Sequence Number=SeqID_27290
MAHQNPPYLAFCTLGKNEIKNKIQGYQRETNTNIYIFCNEHQGMKGMDEDKKVFKGCNGPKDKVGKKNME

SEQ ID NO: 118976 - protein, 105 aa, Glycine max
  Coding DNA Sequence Number=SeqID_27291
MGDQQETREQMKADMSALKEQMASMMEAMLGMRQLMEKNVATAAAVSSAAEADPTLLVGRGRNTLGHDGNPHLGYNQAAYPYGLPPNYSPPVLQDDAGPYCFSRP

SEQ ID NO: 118977 - protein, 159 aa, Glycine max
  Coding DNA Sequence Number=SeqID_27292
  Homolog annotation: Hit_ID=A5AK77; Match level="QueryCoverage=55%, HitCoverage=11%, E-value=2e-12, Identity=42%"; Hit description =Putative uncharacterized protein
MTRDNPGDLQPFEPEIDRTFHRLVRHSVHPGHSVHFEHSEHFVEGDSEYSDFEHSTTNFYTKNMAQPPPHERTLREMVAPDFTYESLCIQYPDEGVPYVLKTGLIHLLPKFHGLAGEDPYKHLKEFHIVCFTMKPPDVQEDLIFLKAFPHSQKGVAKDW

SEQ ID NO: 118978 - protein, 144 aa, Glycine max
  Coding DNA Sequence Number=SeqID_27293
  Homolog annotation: Hit_ID=B0H6W1; Match level="QueryCoverage=22%, HitCoverage=76%, E-value=4e-08, Identity=90%"; Hit description =Putative uncharacterized protein
  Subcellular localization annotation: CTP_CleavageSite=30; ConfidenceScore=5.41e-01
QSVWALKVTWILNVLGRKMNTKSQRVNTLNAGGRPNTCKSNGSTESLLSGDEWRTATLELRHGPDSYGRQQWGILHNGRKPDAAMPQEAPANSVPAAAVIRRVQALIGITGRKAHAAVCQVGCEIPGLNLGTAFETGRLESCRG

SEQ ID NO: 118979 - protein, 280 aa, Glycine max
  Coding DNA Sequence Number=SeqID_27294
  Pfam annotation: Domain name=zf-CCHC; Domain location=9-26; Score =21.5; E_value=0.00084; Accession=PF00098.14; Description=Zinc knuckle
MHTHDLYSMKCFKCLGRGHITSQCPTKKTMIMRGQDIYSSLDEATSSPSSSESEEAKGEESSEEIYPQEKEQPLMVKEECEVSVSSKRLAKKEMHFEIKTNIKVISPLRQPPHFLLCEKTLVTIATPLRLEFIPQVKELLDEGLVRKSLNPYALLVPKIGIIRHQIPKIGGMMNVLSGATLFCKITRAPNIFMICVHRDSLGSDQGVPMNPKRIKVIPEWPTPPTECRRKTERRRHFKEKMSLEEAHHHRRPWIRAWRKKEMNEGEREERSTKFCALNEL

SEQ ID NO: 118980 - protein, 121 aa, Glycine max
  Coding DNA Sequence Number=SeqID_27295
  Homolog annotation: Hit_ID=A7Q8B9; Match level="QueryCoverage=31%, HitCoverage=12%, E-value=1e-10, Identity=71%"; Hit description =Chromosome chr14 scaffold_63, whole genome shotgun sequence
MVGAGLKKDLTGVSRVECLSPMTKILAMVKKKGEQAPWRAQYNGVVAAFGKDPQNRPPEKESIDSLPIGWTVGAMIYFTGEVSAQLVELRSCNWVVAITEDRNMPLKDSTETKTGCQERRG

SEQ ID NO: 118981 - protein, 92 aa, Glycine max
  Coding DNA Sequence Number=SeqID_27296
MVAWPGTQPSLYREDEGPIAQVPQYVEDESSEATIPEPFVIAEEAEETHVRQVDAATPERSLEATSEPSAKGKEIPSPQLAADPSTPLQEMP

SEQ ID NO: 118982 - protein, 56 aa, Glycine max
  Coding DNA Sequence Number=SeqID_27297
MKTVKNDEDDENFHRIAYGSVTEVFGNFTEVLRKPRKPRKPFFKNVEELAAQLGIL

SEQ ID NO: 118983 - protein, 134 aa, Glycine max
  Coding DNA Sequence Number=SeqID_27298
  Homolog annotation: Hit_ID=A4W828; Match level="QueryCoverage=100%, HitCoverage=99%, E-value=1e-43, Identity=57%"; Hit description =Putative uncharacterized protein
  Pfam annotation: Domain name=CxxC_CxxC_SSSS; Domain location=100-132; Score=0.2; E_value=0.033; Accession=PF09723.1; Description=Putative regulatory protein (CxxC_Cxx
  Pfam annotation: Domain name=DUF1451; Domain location=11-134; Score =170.2; E_value=5.6e-48; Accession=PF07295.2; Description=Protein of unknown function (DUF1451)
  Pfam module annotation: Pfam domain module=CxxC_CxxC_SSSS::DUF1451; Domain location=100-132::11-134
MNNVAQEYRATVAALTQRLERGERDVDALVAEARSALLQKQTLTTAEVDEVMRAVRRDLHEFALSYQESSEALGDSVFLRDLRHHGVYQSGEVVGLGNLVCEKCGFTRAIYTPESLTRCPECGHDQFQRQPFEP

SEQ ID NO: 118984 - protein, 56 aa, Glycine max
  Coding DNA Sequence Number=SeqID_27299
MGSSLAMGCSSRFDVCVCGSCEGGVKGDEGWFCWSKEAVVVVVDMGVVEMMVVVEE

SEQ ID NO: 118985 - protein, 61 aa, Glycine max
  Coding DNA Sequence Number=SeqID_27300
MIEHVLAIKIAIPWVMGLNQARAFMKKVHQVKLKYGSNHLAKIGAKDGSGYITASSTAKHI

SEQ ID NO: 118986 - protein, 235 aa, Glycine max
  Coding DNA Sequence Number=SeqID_27301
MAPRKLPAKRSKKDTTGEGSSVAPQADMDFDKHRFRSAEYQWRHETIKGWSFLRERQAEGQQCEYSQRRRQVFGFDEDAIAQLLCIPRKDFTRTAGGRRVRIRHTSMTTLTQIWMMLLLSNILPSEHNSDLPLPKCQLVYAILTQVSVHVAQLIFDAIYHFAGVAPTRHPMDPEKSNRALGFPAITASASPTECPSPPARSSSHLLKGPSSRNTASPGRHRTRHRSNQRRTNNHL

SEQ ID NO: 118987 - protein, 93 aa, Glycine max
  Coding DNA Sequence Number=SeqID_27302
GCSPRRANLFREDISMALYGILGCLAAAFSVCPELGKGRRSVGRDPSLYLRPSLTLASHLKEVSLAIRELLKEVFSKKLLKEVFSRKLLKEAT

SEQ ID NO: 118988 - protein, 373 aa, Glycine max
  Coding DNA Sequence Number=SeqID_27303
  Gene Ontology: Mol. function=metal ion binding; Biological process =sporulation
  Homolog annotation: Hit_ID=A7ZJ91; Match level="QueryCoverage=51%, HitCoverage=77%, E-value=1e-101, Identity=91%"; Hit description=NIF3 family protein
  Pfam annotation: Domain name=AHS1; Domain location=193-371; Score =208.8; E_value=1.3e-59; Accession=PF02682.7; Description=Allophanate hydrolase subunit 1
  Pfam annotation: Domain name=NIF3; Domain location=1-197; Score =249.5; E_value=7.1e-72; Accession=PF01784.9; Description=NIF3 (NGG1p interacting factor 3)
  Pfam module annotation: Pfam domain module=AHS1::NIF3; Domain location=193-371::1-197
ALLDEAVRQEADAVIVHHGYFWKNESPIIRGMKRNRLKTLLANDINLYGYHLPLDAHPELGNNVQLARLLGITVMGEIEPLVPWGELAMPVPGLELASWIEARLGRRPLWCGDTGPDLVKRVAWCTGGGQGFIDSAARFGVDAFITGEVSEQTVHSAREQGLHFYAAGHHATERGGIRALSDWLTENTDLDRARCYLLGETAVVLELEPPVTLATQKRIWRLTQRLADMPEVVEGHSSEALEPDSRTIEIPVVYGGAGGPDLPIVAEHCGLTEKQVVELHASVDYVVWFLGFQPGFPYLGGLSPRLHTPRRAEPRLSVPAGTVAIGGEQTGIAGPVACRRYPPLYSAEGGGMLTLIRAGLYTSVQDAGRLACA

SEQ ID NO: 118989 - protein, 152 aa, Glycine max
  Coding DNA Sequence Number=SeqID_27304
MARGVHDIQRMWQSIDIVRERLTLVAFPYMNATITFHCEPLITCSQDLPGHSMPIGVCSKQTLVDFLDHVVRLFGIHASQESHVVVPFIYFRWVLFAFDKSLDIEIPRLTSRSSSTWQQCAGFPRHQNSMYGRSPCGVSWNMDAKVASASAI

SEQ ID NO: 118990 - protein, 90 aa, Glycine max
  Coding DNA Sequence Number=SeqID_27305
MACTHIPVKGFTRNSPQISSSPHQLDLAPYALEPYNAQWNAPGLLRDKHTLRSSRILGEMEVDEPWLGLWLPLNYQVDMGASQHRTLELG

SEQ ID NO: 118991 - protein, 60 aa, Glycine max
  Coding DNA Sequence Number=SeqID_27306
MQEVKHVTPTRLCKLPFTGKNPKRFDIPSGCSINELKDVIKQVASQGILPYGIHESQTVR

SEQ ID NO: 118992 - protein, 158 aa, Glycine max
  Coding DNA Sequence Number=SeqID_27307
  Homolog annotation: Hit_ID=A5BP26; Match level="QueryCoverage=60%, HitCoverage=10%, E-value=2e-09, Identity=36%"; Hit description =Putative uncharacterized protein
  Pfam annotation: Domain name=zf-CCHC; Domain location=10-27; Score =11.8; E_value=0.025; Accession=PF00098.14; Description=Zinc knuckle
  Pfam annotation: Domain name=zf-CCHC; Domain location=45-62; Score =11.7; E_value=0.026; Accession=PF00098.14; Description=Zinc knuckle
  Pfam module annotation: Pfam domain module=zf-CCHC::zf-CCHC; Domain location=10-27::45-62
KDISINAAKTVCDFCGRIGHVESTCYKKHGVPSNYDARNKSNGRKACTHCGKIGHTVDVCYRKHGYPPGYKPYSGRTTVNNVVAVESKATDDQAQHHESHEFVRFSPEQYKALLALIQEPSAGNTALTQPKQVASISSCTVNNPTNPGNEQPYEDWYS

SEQ ID NO: 118993 - protein, 104 aa, Glycine max
  Coding DNA Sequence Number=SeqID_27308
MWDQFHTCIQDSIENIIDVKADGNCGYCAIAALLGMGEDSWSLVHNHLHKELTSWSEEYINLLGVIERFEELKCSLLVDGLSMVRYHRKVDEYYRYVICHCFTI

SEQ ID NO: 118994 - protein, 143 aa, Glycine max
  Coding DNA Sequence Number=SeqID_27309
LAFVDHTAFCYHDPRAGSPRRHLTVIRTSASVIDEQRPMWSEFLIGGYVGARASLLSTLPHNLCHTDPEAGPITRRDKIWSFCTLVSSRGGGPDDTRRYLTVIRTLVSSRGGGPDDTRRYLTVIRTLVSSRGGGPDDTRRYLT

SEQ ID NO: 118995 - protein, 44 aa, Glycine max
  Coding DNA Sequence Number=SeqID_27310
MGVQIAPRPTWALQNIPPEGGNLAKVSTVLRRSSFVLHHSSIFN

SEQ ID NO: 118996 - protein, 214 aa, Glycine max
  Coding DNA Sequence Number=SeqID_27311
  Pfam annotation: Domain name=G-patch; Domain location=33-79; Score =26.6; E_value=9.3e-05; Accession=PF01585.14; Description=G-patch domain
MEAAEESLETAFQSFEVVSISSVDSFSGQACLSDAIVMMARVMLGNGYEPGRGLGKDNGGITSLINAKGNRGKYGLGYKPTQADIKRSIAGRKSGSQSSRLRQEGEGSPPCHISRSFISAGLGDEGQVVAIYEDDVPSTLDLVRPCPPNFRLGNWRVEERPGIYATSIIFDDESLEGTNTWDPPINFEQETNQTEDEENEDVGLPLEFRKDSRP

SEQ ID NO: 118997 - protein, 55 aa, Glycine max
  Coding DNA Sequence Number=SeqID_27312
MWGSTGAMLGQRKGKFFHTIYYASEVQNDAQGSENVVADHLSRLVNEEVTAKKLK

SEQ ID NO: 118998 - protein, 135 aa, Glycine max
  Coding DNA Sequence Number=SeqID_27313
MGGHEVRNLRVTDRSRKPHAVAIKPLPALLLSPHNVQIQNEHAFLPYGLPPNYTPPNVAYTLNENLNYSTPILIESQQPQTDQAHISQTMGETQEIPHHNLADFEPWLGYATEGQAVGGIPFENTLEGPQFRPQP

SEQ ID NO: 118999 - protein, 302 aa, Glycine max
  Coding DNA Sequence Number=SeqID_27314
  Homolog annotation: Hit_ID=Q6WAY6; Match level="QueryCoverage=91%, HitCoverage=58%, E-value=3e-19, Identity=26%"; Hit description =Putative uncharacterized protein
MGQLQRQAFCKAYGKIWDLARVEVSMEPIASLSQYYDQPLRCFTFEDFQLVPTVKEFEEILGCLLGGRKPYLFSRFYPSTTRVAKVVKISAQELDRVKQNRNGVVGVPRKFVLFPNMEGLVDLAVIDAFLTFHHGKESPVVAILAMYDTFDRGCEKSGARIVCCALALYVWLVHTFFSKKVGPSIRYKVTARRKNQDSIFMRRMSKCSLDGTRGCINYNPVLAIRQLGYPMRGVPSDKSITPFIARGFSDPNARDRELRGSSNGIIGGYHKWLRVRTQGLDWLPNLKTVRDNEVKASEESDE

SEQ ID NO: 119000 - protein, 266 aa, Glycine max
  Coding DNA Sequence Number=SeqID_27315
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIRLKKAYSMCIKVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 119001 - protein, 128 aa, Glycine max
  Coding DNA Sequence Number=SeqID_27316
MASMMEAMLGMRQLMEKNMATTAAVSSAAEADPTLLATAHNPPPNAVGRGRSTLGHNNNPYLGYNQVAYPYGLPPSYTPPFYPPIPVEGLAPNTLPQPNLTPQPIFLSTEGPPPAAEKEGNSISSRRD

SEQ ID NO: 119002 - protein, 85 aa, Glycine max
  Coding DNA Sequence Number=SeqID_27317
MEMQLKAKEKRRGETPSTREYVEAKLHGESKNNSGVQDKNQEEFKTQEENLTSRIKIQGSRSQESRSRFKTQDSRIKRRLNQDKY

SEQ ID NO: 119003 - protein, 55 aa, Glycine max
  Coding DNA Sequence Number=SeqID_27318
MTEFVPAKNSTESTMPTLVSTSERRTLGGKEEQKNLAFVSNDEGEEDEYDLILMK

SEQ ID NO: 119004 - protein, 105 aa, Glycine max
  Coding DNA Sequence Number=SeqID_27319
MRLPGKESLLMKFPITINEILDVSISFLNDHLEETPGSTKIEEITQSVSISHRVRIDILTLGQGYGESGFWLKACRMARHDTCQGLVWFKDKGMPHIISMTQMQK

SEQ ID NO: 119005 - protein, 264 aa, Glycine max
  Coding DNA Sequence Number=SeqID_27320
  Homolog annotation: Hit_ID=Q6WAY6; Match level="QueryCoverage=63%, HitCoverage=31%, E-value=1e-24, Identity=39%"; Hit description =Putative uncharacterized protein
MGTNQTGKRFYQVKVKSPDTTSIKELGRLMEPLQMQAFRKTYGKILELTIAEDVLSGERKPYLSSGCLPSLSRIATVVKDSARGLDRIKQTRNGIAGLPQRYLEDKARGMANQGDWVPFMDVLALLIFGVVLFPNVDGLVDLAAIDAFLAYHHSKESPVVAVLADLLDTFDRRCEKSSARIICCLPALCNRLGPALGRIGGRTISWFPRWKEGKEGVLFSCGGYPNIPLVGTRGCINYNPALAIRQLGYPMRGAPTEESMSPIL

SEQ ID NO: 119006 - protein, 95 aa, Glycine max
  Coding DNA Sequence Number=SeqID_27321
MEIPDNRKWMYQRLDANKHRTNEFSKGRFEFVQFVTSQDMFQMQGFMPIYYWWTNHGEELPQFPSVVLHGSYYESDGQREELNPYEQMIMDHAGP

SEQ ID NO: 119007 - protein, 223 aa, Glycine max
  Coding DNA Sequence Number=SeqID_27322
MDNNQEEINYIGLERDVDCLVVRGSLQRDDDCSQMQSHVDRPCRRIGQRRSTKKGLPQHRAGIGGDVTVAARGLDDAALAGAQARAASSAVSKVPSQTRLFLLGSLISEAYLPHGLFLTPRKCTPGAISHAHVGSASVLVGDIDDALDSEKGNHPTVEYYYQIMYFSSTSDEDMTKSKGKDPLEGLGGPMTRARARKAKEALQQVLSILFEYKPKFQGEKSKV

SEQ ID NO: 119008 - protein, 128 aa, Glycine max
  Coding DNA Sequence Number=SeqID_27323
  Gene Ontology: Biological process=transposition, DNA-mediated
  Homolog annotation: Hit_ID=Q1J7G7; Match level="QueryCoverage=23%, HitCoverage=42%, E-value=2e-10, Identity=100%"; Hit description =Transposase
MVKVGTSYVPINVSFSPKVGPGLPGINRDTRIYLFCESDLPSQWLLFLSAVPPVQLLTGWCVTAKAPPDISAGKCSGCATVGKGDRCGPLRYYASWRKGDVLQAIKLGNAREFDGRIDRPPSAATHFY

SEQ ID NO: 119009 - protein, 273 aa, Glycine max
  Coding DNA Sequence Number=SeqID_27324
  Homolog annotation: Hit_ID=Q84VH5; Match level="QueryCoverage=88%, HitCoverage=39%, E-value=1e-114, Identity=80%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKLPIAFLLYVWHYVESHPNILNNIDSVMKRESALSLHYKLFEGTHVPDIVSTSGKAADSGAVSKDALITELKNTCKVLEATIKATTEKKVELERLIKRLSDSGIDNGEAAEEEEEAAEEEEDAAEDTESDDDVGKTNP

SEQ ID NO: 119010 - protein, 104 aa, Glycine max
  Coding DNA Sequence Number=SeqID_27325
MTRAYFKLCMENRKMHGSHMSKHENKRDAYAMHDMNAFYGHESPENYLFLLAHLGAQCPMCTIKKVIWTFRLPVTKDETNIQCILEIKCGSDLIRTDFWSKNVG

SEQ ID NO: 119011 - protein, 149 aa, Glycine max
  Coding DNA Sequence Number=SeqID_27326
  Homolog annotation: Hit_ID=Q5W7C9; Match level="QueryCoverage=86%, HitCoverage=48%, E-value=6e-64, Identity=95%"; Hit description =Unknow protein
  Subcellular localization annotation: CTP_CleavageSite=19; ConfidenceScore=5.07e-01
MHHPVSAFPKAPLSFKRIRGMSSPGGILNALATALHGSIRTAPSIHRLRLGLLGYLIPFAPLAFVSQCQCRPSRVLSPLVFFPISTHFTAPPEIPSAPTVLQLGSFHRLSRVEPWDLTANLKSHLQTLYAQSFRITLASSVLPRLLAQS

SEQ ID NO: 119012 - protein, 51 aa, Glycine max
  Coding DNA Sequence Number=SeqID_27327
MTGDASKFTHISPKKSGHVTYGDNNKGRILGVGKVLSTSYLVLVNYVTKAI

SEQ ID NO: 119013 - protein, 103 aa, Glycine max
  Coding DNA Sequence Number=SeqID_27328
  Subcellular localization annotation: CTP_CleavageSite=41; ConfidenceScore=5.05e-01
AEAELDRSCQKLSGTSLSTSGKVVNTGKGQMKSPVTAKEFNAMGVKKYGHIRKLNGPTLNSRSRGKDFLNEAQFLKEACTGAEKRHEEGERSLSLKEKLVSEL

SEQ ID NO: 119014 - protein, 112 aa, Glycine max
  Coding DNA Sequence Number=SeqID_27329
  Subcellular localization annotation: CTP_CleavageSite=38; ConfidenceScore=5.01e-01
MAVVNPGKIYQSPFPRWYNPNATCAYMGDSPNIRTNPLASHRGSMVNMVEECGPRGLKRMEDVLSSRRFILEALCEAGMISLGGDKGDSCLIHLGASHDVETCLVAEELLQG

SEQ ID NO: 119015 - protein, 113 aa, Glycine max
  Coding DNA Sequence Number=SeqID_27330
KLGEKLATQLAQASRVASSRSNSLLEESSGGPKWAWEMAPRKLASKRSRKDKAAEGTSSAPEYDSHHFRSAEHQQRFEAIKGWSFLRERRVQLRDDEYTDFQEEIGRRWWASL

SEQ ID NO: 119016 - protein, 76 aa, Glycine max
  Coding DNA Sequence Number=SeqID_27331
MSLSGSVLFCKGQLSRPCLAKRPMASRKHKSIGSRPTVQYDKEILFFRCLDQIHRQCPGEKHLTREESRNISLLAR

SEQ ID NO: 119017 - protein, 103 aa, Glycine max
  Coding DNA Sequence Number=SeqID_27332
MGRRARFEFAHHGVIRTSQIFAYHIGRFICLRPDGSIGFTLATALIAATITALASIIFFMLIMAFIIVAICSFMASIFGLHLLLHLLCFTHYSSSSTSSERMQ

SEQ ID NO: 119018 - protein, 65 aa, Glycine max
  Coding DNA Sequence Number=SeqID_27333
MVKLSSGVYAWSSMERKRRRKNSVKEVILRNVMLGVEKPQEAQEKGRFRVFVSERRQHDSSGKYV

SEQ ID NO: 119019 - protein, 340 aa, Glycine max
  Coding DNA Sequence Number=SeqID_27334
  Homolog annotation: Hit_ID=Q84VH5; Match level="QueryCoverage=100%, HitCoverage=53%, E-value=1e-142, Identity=74%"; Hit description =Envelope-like protein
  Subcellular localization annotation: CTP_CleavageSite=21; ConfidenceScore=5.11e-01
MATSPKETSAPGSPSVPSSPSSTKAPSNQEQPEFHIQPIQMIPGQAPVPEKLVPKRQQGVKISENPSLATSPREVDPEMDKKIRSIVSSILKNASVPDADEDVPTSSTPDVSVPDADKDVPTSSTPNAEVLSSSSKERSTEEEDQATEETPAPAGTRTCSRKTTNRKGKTPITRSGRIKTMAQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPA

SEQ ID NO: 119020 - protein, 92 aa, Glycine max
  Coding DNA Sequence Number=SeqID_27335
MDKFDPEVVLDFYASAWPTEEGVRDMRSWVRGRLGVRVQLEEEQGRWVRRGGHCPAVMHTGAGFRPDRCQEEGADHAHQHDHLDPDVDDITA

SEQ ID NO: 119021 - protein, 48 aa, Glycine max
  Coding DNA Sequence Number=SeqID_27336
MVKYRAKSKTEMNRGTWGRAQMDARPMINRSLSRVQLRTIEKRYWEAT

SEQ ID NO: 119022 - protein, 142 aa, Glycine max
  Coding DNA Sequence Number=SeqID_27337
  Subcellular localization annotation: CTP_CleavageSite=22; ConfidenceScore=5.08e-01
MGDTSQKVRLKGGLSSKSRNSEASLQWGPSMATSPEGSAKPMVKVWDLARVEVSMEPIASLAQYYDQPLRCFIFGDFQLSPKVEEFEEILGCPLGGRKPYLFSGFYPSLARISKKVQISAQELDRQRQVENGVIGIPRNIWR

SEQ ID NO: 119023 - protein, 250 aa, Glycine max
  Coding DNA Sequence Number=SeqID_27338
  Homolog annotation: Hit_ID=A5BSR3; Match level="QueryCoverage=61%, HitCoverage=45%, E-value=3e-10, Identity=33%"; Hit description =Putative uncharacterized protein
KLLAEKTKKKLQEAAQSGSVDGVIDPPSPVRRHVKWKMARTKKIGEMTNKATKEIAEKINAMYHCVFSVHDSFEEQATQGSFVPHGRQDVLAAAIGHPEHPGRVHAAGAGVTIKQYFGSAPWTSHSASSLPPDELQQLTQQIRDQLEESITEKVTRQGLAVPPKPLVGPGPSGPRVSTKGSCVDPSGNDPETGDSDRCGLYIEADPVRLVAMGRVYEGSTLVHNTPLLSGQALHTFLAWPTHLVKSLSQQ

SEQ ID NO: 119024 - protein, 81 aa, Glycine max
  Coding DNA Sequence Number=SeqID_27339
VFCLCSVLLAVSSLCCLNSIFLGCCGSLGGNLDGEGNGGFMRAFVDVENLLCTIARPPPSTTCDGVVPGDMSRGSGDLGDV

SEQ ID NO: 119025 - protein, 89 aa, Glycine max
  Coding DNA Sequence Number=SeqID_27340
VQVIEVTSSEEDPEEDPEELPLEPAVDALDFLEGDEDPLPEVDSPEEVMSASEADSTEDSGPREMPPLWKKSESLRVGRPNLDLVVFGG

SEQ ID NO: 119026 - protein, 116 aa, Glycine max
  Coding DNA Sequence Number=SeqID_27341
IAPTKTPSEPEEVQQGPGVSSSGYGPLSVPQGARIAPARHPVDPKKSNRVLELSSSNYGSLSVLRRRNTTAALGWPVAGNRHIATTSRVHLSSSAKRLERCRRHMADQQATESKAK

SEQ ID NO: 119027 - protein, 85 aa, Glycine max
  Coding DNA Sequence Number=SeqID_27342
MTNYPPWLLSVAASTLDRKLVTKVQLGNGAVYESSAEVGFLSGAAGVIFGFNFPQDRSSAYALPAVLLSQWNQRLILSYITSTRY

SEQ ID NO: 119028 - protein, 361 aa, Glycine max
  Coding DNA Sequence Number=SeqID_27343
  Homolog annotation: Hit_ID=Q2HW90; Match level="QueryCoverage=92%, HitCoverage=65%, E-value=9e-40, Identity=34%"; Hit description =Putative uncharacterized protein
MGPLQRQAFRKVYGKILDLATAEVFTEAVVSLAQYYDQPLRCFTFGDFQMVPTIEEFEEILGCPLGGRKPYLFSGFLPSLSKIAAVIGDSAKELDRMKQTRNGIVGLPRKYLEGKARDMASQEKWGPFADILALLIFGVVLFPNVDGLVDLSAIDAFLAYHHSKESLVVAILADLFDTFDRRCEKNSARIVCCLPALCVWLISHLFQQDTRHPCPLQSYRSCAEKGRVDWDQHLAGIGGSAINWFPRWKEGKEGVLFSSGDYPNVPLLGTRGCINYNPALAIRQLGYPMRGAPTEESLSPLLVRDLGAQSLKVIQRVHKAWRSPLRKDKELRGIRNGVIGGYHGWLRVHTRGLDWLSKLKV

SEQ ID NO: 119029 - protein, 199 aa, Glycine max
  Coding DNA Sequence Number=SeqID_27344
  Homolog annotation: Hit_ID=Q2HW90; Match level="QueryCoverage=91%, HitCoverage=36%, E-value=7e-23, Identity=32%"; Hit description =Putative uncharacterized protein
MVEVSTEAIASLAQYYDQSLRCFTFGDFQLTPTMEEFEEILGCPLGGRKPYLFLGFYPSLARISKLVRISTQELDHGKQVENGVVGVPRKCLEAKVRTLASQDEWAPFMDVLTLLIFRVVLFPNVDGLVDRAAIDAFLAFYNRKESPVVAILADLYDTFDRRCEKNNARIICCTPALYVWLVSHLFRQEVRHVCPLKGH

SEQ ID NO: 119030 - protein, 99 aa, Glycine max
  Coding DNA Sequence Number=SeqID_27345
DRELRGSSNGIIGGYHKWLRVRTQGLDWLPNLKTVRDDEVKASEESDEVQALKAELERARVVEEKFKSIAIKLKPWNEEVKGIITGQRHDLEGRANGLP

SEQ ID NO: 119031 - protein, 91 aa, Glycine max
  Coding DNA Sequence Number=SeqID_27346
MTLRQHGSNRGSKRTSPREDALIPHDASSIGACRPRIFFINGFLCFLEDEWQRKWRRRERGEATSRRKMSLEEAHHHRRPWIKSLEEEGDE

SEQ ID NO: 119032 - protein, 53 aa, Glycine max
  Coding DNA Sequence Number=SeqID_27347
ARLTGALSKGGKMHGVATNVDKSGAFAPTYPPLERKSDLRSSFLSVNQAILLL

SEQ ID NO: 119033 - protein, 188 aa, Glycine max
  Coding DNA Sequence Number=SeqID_27348
  Gene Ontology: Mol. function=protein binding; Cellular component =extracellular region; Biological process=defense response to fungus
  Homolog annotation: Hit_ID=Q1SWI6; Match level="QueryCoverage=77%, HitCoverage=69%, E-value=6e-34, Identity=50%"; Hit description =Leucine-rich repeat, plant specific
  Pfam annotation: Domain name=LRRNT_2; Domain location=27-67; Score =49.3; E_value=1.3e-11; Accession=PF08263.3; Description=Leucine rich repeat N-terminal domain
  Pfam annotation: Domain name=LRR_1; Domain location=109-134; Score =10.0; E_value=4.3; Accession=PF00560.24; Description=Leucine Rich Repeat
  Pfam annotation: Domain name=LRR_1; Domain location=136-158; Score =13.9; E_value=0.62; Accession=PF00560.24; Description=Leucine Rich Repeat
  Pfam module annotation: Pfam domain module=LRRNT_2::LRR_1::LRR_1; Domain location=27-67::109-134::136-158
MNSSSIYILVFVQLWLLSLPCRESVCIPSERETLLKFKNNLIDPSNRLWSWNHNHTNCCHWYGVLCHNLTSHLLQLHLSSSDYAFYDEEAYRRWSFGGEISPCLADLKHLNYLDLSGNYFLGEGMSIPSFLGTMTSLTHLDLSHSGFYGMIPPQIGNLSNLVYLDLRSVANGTVPSQIGISLSFDILT

SEQ ID NO: 119034 - protein, 38 aa, Glycine max
  Coding DNA Sequence Number=SeqID_27349
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q2PMN2; Match level="QueryCoverage=94%, HitCoverage=7%, E-value=3e-12, Identity=100%"; Hit description =NAD(P)H-quinone oxidoreductase chain 4, chloroplast (EC 1.6.5.-) (NAD(P)H dehydrogenase, chain 4)
IPRLLYLDEMGGMAIPMPKIFTVFTILSMASLALPGMS

SEQ ID NO: 119035 - protein, 229 aa, Glycine max
  Coding DNA Sequence Number=SeqID_27350
  Gene Ontology: Mol. function=heat shock protein binding; Biological process=protein folding
  Homolog annotation: Hit_ID=O82368; Match level="QueryCoverage=72%, HitCoverage=53%, E-value=4e-30, Identity=43%"; Hit description =Uncharacterized protein At2g29880
MGDSQENNKGKSRDKDNYVSWTMEDTNELLHLLVDAMNRGLRDANGSLSKQNVERIILPQLNAKTKFPKTYSHYLSRMKWFRNQYNMMSTLMRNNSGFGWDPIGKTFTAHEDVWKDYLKSHPSHSKLRGKSMVDYEYLKIVVGGGVSSGNNSISVDPDDTDATTFEPENRIVGIEEFSYDPNSDTFITPNNYEPAYQPPSPNQPSPPSHPPLDSEVPIEKQNCHKRRRS

SEQ ID NO: 119036 - protein, 148 aa, Glycine max
  Coding DNA Sequence Number=SeqID_27351
DTRIYLFCEVISVTGIYSAQSASAVPPVQLLTGWCVTAKAPPDISAGKCSGHAARRVPFAIQAAQLLGRAIGAGLFAITPAGERGMCCKAIKLGNARVFPSHDVVKRRPEFDASWATMCSAMAASMRPIVDVEQEKSAIASQREHQML

SEQ ID NO: 119037 - protein, 122 aa, Glycine max
  Coding DNA Sequence Number=SeqID_27352
MARKARSSPFWPCMTRSTGDVKGAAQELFVVHWLSMCGWFHTLFSKKVGPSIRYKVTARCPNVLLMGTRGCINYNPVLAIRQLGYPMRGVPSDESITPFIARGFSDHNARVLQGVRKAWDAA

SEQ ID NO: 119038 - protein, 55 aa, Glycine max
  Coding DNA Sequence Number=SeqID_27353
MGIGMAWLHKTWRVLRELLFYCGHLLLEHHSGTGETLANTAEIGIVGARYAGWTN

SEQ ID NO: 119039 - protein, 44 aa, Glycine max
  Coding DNA Sequence Number=SeqID_27354
  Homolog annotation: Hit_ID=A5AMB1; Match level="QueryCoverage=93%, HitCoverage=26%, E-value=8e-07, Identity=56%"; Hit description =Putative uncharacterized protein
MKDSLKRSWYIDSGCFKHMTRDTSKFTHISPKNSGHETSGDNNK

SEQ ID NO: 119040 - protein, 44 aa, Glycine max
  Coding DNA Sequence Number=SeqID_27355
MILEDKLKACQRALDRRLQEDWAKDAREGPRVLMSLRVDFGPMN

SEQ ID NO: 119041 - protein, 92 aa, Glycine max
  Coding DNA Sequence Number=SeqID_27356
  Gene Ontology: Biological process=transposition, DNA-mediated
  Homolog annotation: Hit_ID=Q1J7G7; Match level="QueryCoverage=35%, HitCoverage=47%, E-value=1e-11, Identity=96%"; Hit description =Transposase
MVKVGTSYVPDQRLIFAKKLAQGFPGINRDTQDLFILRSDLPSQVLQWLLFLSAVPPVQLLTGWCVTAKAPPDISAGKCSGHAARNHHTRRA

SEQ ID NO: 119042 - protein, 123 aa, Glycine max
  Coding DNA Sequence Number=SeqID_27357
  Homolog annotation: Hit_ID=A0ST23; Match level="QueryCoverage=21%, HitCoverage=53%, E-value=1e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVQEKKAAP

SEQ ID NO: 119043 - protein, 147 aa, Glycine max
  Coding DNA Sequence Number=SeqID_27358
  Homolog annotation: Hit_ID=Q6UUU1; Match level="QueryCoverage=36%, HitCoverage=36%, E-value=2e-17, Identity=81%"; Hit description =Putative uncharacterized protein
MPFFVHGSIFWCPRRRGTTPIHPELGVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWAYERGRRFPGRCPGRYLTG

SEQ ID NO: 119044 - protein, 51 aa, Glycine max
  Coding DNA Sequence Number=SeqID_27359
  Subcellular localization annotation: CTP_CleavageSite=20; ConfidenceScore=5.03e-01
MGPKSTLRLMRTLGPSLASRAQSSWRLLSNVLAGFVSCGAENLYNNTKVLV

SEQ ID NO: 119045 - protein, 233 aa, Glycine max
  Coding DNA Sequence Number=SeqID_27360
  Homolog annotation: Hit_ID=Q2HW90; Match level="QueryCoverage=34%, HitCoverage=15%, E-value=1e-08, Identity=45%"; Hit description =Putative uncharacterized protein
MVSQEKWDPFADILALLIFGVVLFLNVDGLVDLAAIDAFLAYHHSKESPVVAILADLFDTFDRRCEKNSARIVCCLPALCVWLISHLFQQDTRHPCPLQSYRSCAEKGRVDWDQHLAGIGGSAINWFPRWKEGRAKSQGDTKSPQGVRSPLKKDKELRGIRNGVIGGYHGWLRIHTRELDWLSKLKVVDENFEAPEEDEEVQALKLELGKAGLAKEKFKSAATNIPERVHRVT

SEQ ID NO: 119046 - protein, 220 aa, Glycine max
  Coding DNA Sequence Number=SeqID_27361
MSIWQMGFICGIVFALRREMTMFLVFDCVFAVFDNVNVFALFEVGRFTPRASDGKVEYIGGEFDVWEDISADCLNAFILYDLVKACKKYSNIGECFWLIDKDLDFNHGLRSCTTDGDILHLVRDAFENENEINVYFHHEVDPILEEVPQMLYLECDPIRKAVENEDDLDDVPVAGHEEDVGAGEQTDAGEQMDAGKQRDGGEQRDTDAGEQTDGSEQTGY

SEQ ID NO: 119047 - protein, 272 aa, Glycine max
  Coding DNA Sequence Number=SeqID_27362
GAPTEESLSPFLVRDLGAQSLKVIQRVHKVWRSPLRKDKELRDIRNGVIGGYHGWLRVHTRGLDWLSKLKVIDEENFEAPEEDEEVRALKLELGKARLAKEKFKSAATHIRKECTELQEENAVTARALEQETKGTARRNMAERNFEEHCGVATMSSSSEERKDTGHGSKRSLAQHLEATEQSMLAIIGQYKEELNQSVTHEQELVEEFAQVYAEKEARGRVIDALHQEATIWMDRFTLTLNGSQDLPRLLAKAKAMAEVYTAPEEIHGLINY

SEQ ID NO: 119048 - protein, 39 aa, Glycine max
  Coding DNA Sequence Number=SeqID_27363
MDKLLFLGTHIRYHKKDNGKDEPPSERRFRSHFETPATD

SEQ ID NO: 119049 - protein, 51 aa, Glycine max
  Coding DNA Sequence Number=SeqID_27364
MAEINQGTDASGDGVTTDQSLPLPGAKQAENIAARQPSILCGCSFFYYCLF

SEQ ID NO: 119050 - protein, 86 aa, Glycine max
  Coding DNA Sequence Number=SeqID_27365
  Homolog annotation: Hit_ID=O64438; Match level="QueryCoverage=48%, HitCoverage=17%, E-value=1e-10, Identity=73%"; Hit description=ARG10
CFYSIAVGGLRCYENPKNKIVAIPAKEEEIRGAFFKNRESVISPNSNIRLMSIETALGTKGKCEVILELKKLELNIHYVTRIANCN

SEQ ID NO: 119051 - protein, 94 aa, Glycine max
  Coding DNA Sequence Number=SeqID_27366
  Gene Ontology: Mol. function=helicase activity; Biological process =protein amino acid phosphorylation
  Homolog annotation: Hit_ID=Q2R1R7; Match level="QueryCoverage=82%, HitCoverage=5%, E-value=8e-15, Identity=48%"; Hit description=AT hook motif-containing protein, putative
  Pfam annotation: Domain name=DUF889; Domain location=1-90; Score= -74.3; E_value=1.9e-06; Accession=PF05970.5; Description=Eukaryotic protein of unknown function (DUF889)
MEYLSSDYIEKSETIDSWHFQSITTEFLNSLNTSGLPNHRIKLKIDSPIMLLRNLDQTQGLCNAEIISGKNVGDNVYIPRMSMSPSQSPCLSSF

SEQ ID NO: 119052 - protein, 142 aa, Glycine max
  Coding DNA Sequence Number=SeqID_27367
  Homolog annotation: Hit_ID=Q2HW90; Match level="QueryCoverage=52%, HitCoverage=14%, E-value=3e-10, Identity=44%"; Hit description =Putative uncharacterized protein
MGQLQRQAFRKAYVKISAQELGNQIENGVVGVPRKCLEEKARALASQDEWAPFIDVLALLIFGVVLFPNVDGLVDLAAIDAFLAFYDSRESPIVTILADLYDTFDHRCEKSSARIACYTPALYVWLVSHLFRQGGRHVCPLK

SEQ ID NO: 119053 - protein, 99 aa, Glycine max
  Coding DNA Sequence Number=SeqID_27368
MLDLVLKGQAFFDGMPRGIPMIFSGVITAIWLAIKDCKRSSYVIGSGVNSGIGFGGKFLIALELSAGRVVVGAGTWGASLWMGALGYTGAEIGGVPGAS

SEQ ID NO: 119054 - protein, 280 aa, Glycine max
  Coding DNA Sequence Number=SeqID_27369
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDDSGSFEHKRQREPFVQKSNFVKSKQPVPFSKPSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 119055 - protein, 159 aa, Glycine max
  Coding DNA Sequence Number=SeqID_27370
MEPIASLAQYYDQPLRCFIFGGFQLSPMVEEFEEILGCPLGGRKPYLFSGFYPSLARISKKVQISAQELDRQRQVENGVVGILRKYLEPTYMTPSTEDVKKAMQGLFAVPQLSMWGWFHTFFSKGRPVYPLQGYRSCVEKERQIGTTLASMGASVMVPR

SEQ ID NO: 119056 - protein, 132 aa, Glycine max
  Coding DNA Sequence Number=SeqID_27371
MERKMIAIIVDTLPVFYYEKMVGYMPSSFADLVFVGERIEEAWANGENKKEGETHAVTTVPTWPNFAVAQQYQYSTNINPSHYPPPYQPRTPNHPQRPPLNQPQNPHVAHPRPNTTLNTNQNTNHGRNFPEK

SEQ ID NO: 119057 - protein, 94 aa, Glycine max
  Coding DNA Sequence Number=SeqID_27372
MKDNGSEIGRVIHEDIDVWQRKIVLGTGPIQVPIIHTHSYLPIFLRDRMFRASSFSVSALPGNTRDLEVIGAVQGQNSNRAYLGMTKQRCLGSL

SEQ ID NO: 119058 - protein, 151 aa, Glycine max
  Coding DNA Sequence Number=SeqID_27373
  Gene Ontology: Mol. function=transferase activity; Cellular component= cytoplasm; Biological process=glycolysis
  Homolog annotation: Hit_ID=Q5PNF2; Match level="QueryCoverage=100%, HitCoverage=47%, E-value=1e-61, Identity=74%"; Hit description =Glucokinase
  Pfam annotation: Domain name=Glucokinase; Domain location=6-151; Score=26.4; E_value=1.8e-15; Accession=PF02685.7; Description =Glucokinase
MTKYALVGDVGGTNARLALCEVETGAISQAKTFSTSDYDNLEAVIRHYLDEQKQDITDGCIAIACPITGDWVEMTNHDWAFSTRQMKESLGFTTLEIINDFTAVSMAIPMLTAQDVLQFGGKSPVQDKPIAIYGAGTGLGVSHLVHVDKRW

SEQ ID NO: 119059 - protein, 132 aa, Glycine max
  Coding DNA Sequence Number=SeqID_27374
  Homolog annotation: Hit_ID=Q69F85; Match level="QueryCoverage=35%, HitCoverage=2%, E-value=4e-07, Identity=55%"; Hit description=Gag -pol polyprotein
KFLDFMITHWGIEANPDKCTTILEMCNPNSIQEVQKLNNLKTSLPGFQEDHSHIANFELTQAMSTPTPISLSGTSTYYLNPTTQALLPESSSEFNIQYEPRGPMKTQFTTDFLTEFAGNNTTTSYGWTLYVG

SEQ ID NO: 119060 - protein, 93 aa, Glycine max
  Coding DNA Sequence Number=SeqID_27375
ALFLSAVPPVQLLTGWRVPFAIQAAQLLGRAIGAGLFAITPAGERGMCCKAIKLGHAMAVCVLALAECILAYYVGTDEGVSEVLHVAGEKAAP

SEQ ID NO: 119061 - protein, 89 aa, Glycine max
  Coding DNA Sequence Number=SeqID_27376
MAVRLLPAADHPQAAVVFRLAPAWDAVLLDESSISRGPDALAGGLIEARNQSWKPQGPVGLFRVHWVSCGPTDPSAGGDRHYDDWAECC

SEQ ID NO: 119062 - protein, 97 aa, Glycine max
  Coding DNA Sequence Number=SeqID_27377
PHGHAPQPRVVPHAPQTDIPHVLESGASSTSAEEPRHTVEVCDDIAERLERHLSQGVVTPGSSTHEVIEECLRLARSVTQHHLVYVRSRRRRRTDQT

SEQ ID NO: 119063 - protein, 62 aa, Glycine max
  Coding DNA Sequence Number=SeqID_27378
MEIYVSDRLEKSVCDDKKLKGQSKNEFKMFKMESRTLQHSRGKLISRIKNQDSRIKLPRIKL

SEQ ID NO: 119064 - protein, 119 aa, Glycine max
  Coding DNA Sequence Number=SeqID_27379
MMITKDDDIGDDKKLKDQSKNNSSESKFNQRTTQMSYRMSRHHASEHADYILTGNIKVAHKTLKSQTSQNNSSIPDLVENSCSLHVYIAVCVSGLQQLVLDKIYHSPEKSALKDLKDKV

SEQ ID NO: 119065 - protein, 398 aa, Glycine max
  Coding DNA Sequence Number=SeqID_27380
  Homolog annotation: Hit_ID=Q6WAY6; Match level="QueryCoverage=37%, HitCoverage=31%, E-value=2e-21, Identity=34%"; Hit description =Putative uncharacterized protein
IATVVKDSARGLDRIKQTRNSIAGLPRGYLEDKARGMANQGDWVTFMDVLALLIFGIVLFPNVDGLVDLAAIDAFLAYHHSKESPVVAVLADLFDTFDRRIDWDQLLAGIGGRTINWFPQWKEGKEGVLFSCGGYPNIPLVGTRGCINYNPALAIRQLGYPMRGAPMEESMSPLLLRGIRNGIIGGYHEWLKVHIRGLDWLAKLKVVSEESFEAPEEDEEVQALKSELGKAKLAKEKFKLAATHIRKECAGLREENAITARALEQETKRARKEEYGRNKFRGALWGNNSELKLRREERDQSRAHSMVLKEELVACSRSKRSLSQRLCETETNMLAIIAKYQEELGLATAHEHRIADEYAQVYAEKEARGRVIDSLHQEATMWMDRFALTLNGSQELPR

SEQ ID NO: 119066 - protein, 59 aa, Glycine max
  Coding DNA Sequence Number=SeqID_27381
MFDDNNDDTKGDDKKLKEEIKNKFKTQEENLKNTSRFKKKDKFKNQDSRIKLQESRFKI

SEQ ID NO: 119067 - protein, 53 aa, Glycine max
  Coding DNA Sequence Number=SeqID_27382
MVLLVGHSEAICPLPTHLKHFMFLVPVLDEEVEVLCLLPPTLDAADFLCGDVA

SEQ ID NO: 119068 - protein, 288 aa, Glycine max
  Coding DNA Sequence Number=SeqID_27383
  Gene Ontology: Cellular component=membrane; Biological process =nodulation
  Homolog annotation: Hit_ID=P08863; Match level="QueryCoverage=31%, HitCoverage=36%, E-value=9e-28, Identity=74%"; Hit description =Nodulin 26B precursor
  Pfam annotation: Domain name=Nodulin; Domain location=4-100; Score =53.3; E_value=8.2e-13; Accession=PF02451.6; Description=Nodulin
MGVMLITLFLFIAATVAEDADNIGEAIIPENPKFKKFVTDCTSHVAERCSSGSEALHGEGGTCLNAPNVATSPLAACLIPSMNQCVYPSGAESGTGQVKEETEGGKENRKKLLERFSSDIGYKLGKSKKGVPILLWGEACFKHLVAPFGTLLAGPHQGGKTHDDEGKEGMQAVNQSIALLCLWGPAFLEISYHLWDKNALLLRDVGKRMGWLLPLAMSIFLSAMDKKEECGGSLGGEIRQEGKGTNLTTSLYKNEACRYSYGDMNLHCTNVDLGSSRIKPSWKMRKID

SEQ ID NO: 119069 - protein, 86 aa, Glycine max
  Coding DNA Sequence Number=SeqID_27384
MDKWQRRSPQTRSPHCGCSHGSAGDFDTRRKKKNDRVQAQGERRRTIGFKRGLCNFRMSQHIMSSMLEMERLSRCQGNALKCDIRA

SEQ ID NO: 119070 - protein, 173 aa, Glycine max
  Coding DNA Sequence Number=SeqID_27385
MARRDKLWLFCTLLSSRGGGPDDMRRQNLVIPHPFAIQTQSCPMARRDKLWPFCTLLSSRGGGPDDMRRQNLVIPHPFVIQTQSCPIARRDKLWSFCTLLSSRGGGPDDMRRQNLVIPHPFAIQTQSCPMARRDKLWSFCTLLSSRGGGPDDTRRFTSSSVLTRSVILTFESR

SEQ ID NO: 119071 - protein, 63 aa, Glycine max
  Coding DNA Sequence Number=SeqID_27386
MKGNQQKVPSGVANCRNLPFGGRATRDSRDACSTKGIRAESPPTFIEENVGKTGKDAIYELFK

SEQ ID NO: 119072 - protein, 226 aa, Glycine max
  Coding DNA Sequence Number=SeqID_27387
MKDKSDEEEKLENQKKKTDSKALSSKAKGKEKEEKDSSKKIVKKENHFATKCDIKRALLLKQSFYLLLSRETSLSTAIPLELEVIPQVKELLDEGLVCKSLNPCALLVPKISIMRHQIPMIGGMMNVLSGATLFCKITHAPNIFMICVHRDSLGSDQGLPMDPKRIKVIPEWPTPPSVEEKIHEFQEPMDLRSNHFQGRGNEAILLPKGIGLKTPRRLGHRCKRRP

SEQ ID NO: 119073 - protein, 55 aa, Glycine max
  Coding DNA Sequence Number=SeqID_27388
MKRALINIHEFGITAFCTPGQNETKNKIQGYQRETNKNIHIFLNEHQGMKGMGNI

SEQ ID NO: 119074 - protein, 111 aa, Glycine max
  Coding DNA Sequence Number=SeqID_27389
  Subcellular localization annotation: CTP_CleavageSite=48; ConfidenceScore=5.62e-01
MPISPCKSISWSVSSRHGDRTHKTPSGPGKVQQGPGVSSSGYGPLSVLQGARTPPARLCQLVCVVPTWGSHPQDTQWTRKSPTGPWGFQLWLRASISPTGCPYPPGKVMSS

SEQ ID NO: 119075 - protein, 110 aa, Glycine max
  Coding DNA Sequence Number=SeqID_27390
  Homolog annotation: Hit_ID=A5B108; Match level="QueryCoverage=96%, HitCoverage=13%, E-value=9e-20, Identity=46%"; Hit description =Putative uncharacterized protein
MVVAEEREDEQLFVATCFATSNSSSDSLLIDSGCTNHMTNDLNLFKELDKTIVSKEKQIAFSSMTTNVELWHKRLGHFHLAGLLYMQKHALVKGVSMLEDKLADCMACQY

SEQ ID NO: 119076 - protein, 37 aa, Glycine max
  Coding DNA Sequence Number=SeqID_27391
MEEKVKLKINEGLYNGDFSAGLLVEDKGEEVRGGTIH

SEQ ID NO: 119077 - protein, 131 aa, Glycine max
  Coding DNA Sequence Number=SeqID_27392
MAKFDPDIVLEFYANAWLTEEGVRDMRSWVRGQWIPFDADAIGQLLGYPLVLEEGQECEYGQRRNRSNGFDEEAIAQLLCMGAYQGTLWTQIKSNRALGFPALITGTLPSRSGVPVTTSKVDSATHHPSFY

SEQ ID NO: 119078 - protein, 83 aa, Glycine max
  Coding DNA Sequence Number=SeqID_27393
MAYTHIPGHLTTAFKIAPCVASLVNVRIYTQFSSISASPHQLDLAPYASEPYHAQWNAPGLLRDKHTLRSSRISEKWRLMNLG

SEQ ID NO: 119079 - protein, 105 aa, Glycine max
  Coding DNA Sequence Number=SeqID_27394
  Subcellular localization annotation: CTP_CleavageSite=70; ConfidenceScore=5.78e-01
MHTQSFTNPQFLKIGLTHKKSPVESPTVATCPSRASGAGSRCAFQRRKDARSRHQRLFVENVRKPRKPVKMKILSSGVVFTFEEGRQKRGSCSYVPSIEEEIRPT

SEQ ID NO: 119080 - protein, 129 aa, Glycine max
  Coding DNA Sequence Number=SeqID_27395
  Homolog annotation: Hit_ID=O52175; Match level="QueryCoverage=63%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVMI

SEQ ID NO: 119081 - protein, 77 aa, Glycine max
  Coding DNA Sequence Number=SeqID_27396
MAVRLLPAAGHPNADVALPRTMPRRHELAGGNGRPVGPTEARNQSWKPQGPVGLLQVHWVSLWGEIGIAVTGQNVAK

SEQ ID NO: 119082 - protein, 77 aa, Glycine max
  Coding DNA Sequence Number=SeqID_27397
MKMKANKTRNELKVSDSNNYWLKTEERTRNERRTVKNGGKSSRICSRKCLGSVTEAPRLEFSSWRHVFHPKQLKCIA

SEQ ID NO: 119083 - protein, 249 aa, Glycine max
  Coding DNA Sequence Number=SeqID_27398
  Homolog annotation: Hit_ID=A5C169; Match level="QueryCoverage=67%, HitCoverage=14%, E-value=7e-07, Identity=26%"; Hit description =Putative uncharacterized protein
MVIDQSLFHDLTKLPSDGVPFKGTLNDDWKFDFSAHDARQLVCTNNADMIGRLLAGSLAFESRILHYLIVRILLPRSSNLAQVSEEDLIIMWAFHTGRQLDWAHLIRYRMHKALRLNAPLPYPRLFTLFFCHFQIPLDSEPYVPIKRSFLIGAAVIASFGYRKERDGSWGVPPADDEGHIPVEDNSTLLQRLMDKFDGLQTFVGDKFDAMELQVDMRFDAMESRITRVEEDVSFIRTCFDPPPPPPSSS

SEQ ID NO: 119084 - protein, 143 aa, Glycine max
  Coding DNA Sequence Number=SeqID_27399
MATAEALERETKKARKEEHESSWVKGMILKDELKAYLRSKRNLSQQLSETEGNMWAVIDECKEKLNLAATHEQRLEDEYAKISAESEARERVIDSWHQEATMWTDRFALTLNRSQELPRLLAKAKAMADTYSAPKKIHRLLSY

SEQ ID NO: 119085 - protein, 163 aa, Glycine max
  Coding DNA Sequence Number=SeqID_27400
MSRREKYFEEVEAQKESLVKEHESREKDKEQAQQQWEKYSTVENHQESILQINNHPHQQIDKKRRKGEHEETLSAILSLIINTSLEMIWNVLPDYMKFMEFLAKKRNCKEDRKPRAKRIFVHALSRESQALSAQPLHLRLIWSAELAKVELSQLQFDLDLAKR

SEQ ID NO: 119086 - protein, 117 aa, Glycine max
  Coding DNA Sequence Number=SeqID_27401
MNFAARKPIEFTPIPMSYADLLPYLLDNSMVAITPTKVHQPPFLREYDSNATCACHGEAPGHSIEHCRALKRKDFQTFTGIGCKPLVYLLKRPVLLSLDFQDHSIKDYSSCTLVGLP

SEQ ID NO: 119087 - protein, 60 aa, Glycine max
  Coding DNA Sequence Number=SeqID_27402
STQALPVALMIHDNSSDRTAFVPATHHSNFCPINFRWRANYPILTRGGSDINNNTGLIES

SEQ ID NO: 119088 - protein, 119 aa, Glycine max
  Coding DNA Sequence Number=SeqID_27403
MASTMGLVEDVSEVRNFDKDILMLPMKVSDTIDETTTTNTTLPVEPKKIPVLKEKIPLPPITLPSYMLVEEECHLQSSFFLLHATVIDLQVAKDSIDEEDPRPTSSTWCYIMWYQSIFI

SEQ ID NO: 119089 - protein, 95 aa, Glycine max
  Coding DNA Sequence Number=SeqID_27404
  Gene Ontology: Biological process=transposition, DNA-mediated
  Homolog annotation: Hit_ID=Q1J7G7; Match level="QueryCoverage=34%, HitCoverage=47%, E-value=1e-11, Identity=96%"; Hit description =Transposase
DLPSQVLQWLLFLSAVPPVQLLTGWCVTAKAPPDISAGKCSGHAARNHHTRPRLMRRYRARPIRHSGCATVGKGDRCGPLRYYASWRKGDVLQGD

SEQ ID NO: 119090 - protein, 138 aa, Glycine max
  Coding DNA Sequence Number=SeqID_27405
  Gene Ontology: Biological process=transposition, DNA-mediated
  Homolog annotation: Hit_ID=Q1J7G7; Match level="QueryCoverage=33%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPSHDVVKRRPVNCNTTHYRANWSSTAVAAALELVDPPGCRNSMVLLAGVEI

SEQ ID NO: 119091 - protein, 24 aa, Glycine max
  Coding DNA Sequence Number=SeqID_27406
EELRDYYNGRHKSHLRGNAFTLSE

SEQ ID NO: 119092 - protein, 257 aa, Glycine max
  Coding DNA Sequence Number=SeqID_27407
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPEFDVTGILTQLLPGELTDRYRFSLVDKNNVIRASTSLRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 119093 - protein, 115 aa, Glycine max
  Coding DNA Sequence Number=SeqID_27408
  Subcellular localization annotation: CTP_CleavageSite=54; ConfidenceScore=5.24e-01
MHMTQMQFTNTGAREIVPFLDTTFGQHGTQRMFLRRRHGPSVGLLKSPVESPTVATYPSAGGRRVTRGMRVPRKEYARSSHQRLFEENVGKTGKDAIYELLSGRLGSCIYARGRY

SEQ ID NO: 119094 - protein, 268 aa, Glycine max
  Coding DNA Sequence Number=SeqID_27409
  Homolog annotation: Hit_ID=A5ZYK7; Match level="QueryCoverage=22%, HitCoverage=86%, E-value=2e-18, Identity=77%"; Hit description =Putative uncharacterized protein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISFLGPDGDWPSSAKAEGSLTARPTRRAGTKVGLSDPTVPSGKGRRSTDKSYSRDNRLISPRAHIDGKVWHSMSALATWGCSMFQGLGCSPIKAVRELGSERRETVRSISGVGVRALRGPFPSTRGPGRTHLWCASYRAHEPPVAQPRQRWVLCPSGDGAKEVLRIQEK

SEQ ID NO: 119095 - protein, 178 aa, Glycine max
  Coding DNA Sequence Number=SeqID_27410
MDDLLLSNIQPSDHKSNLPLPKCQLVYAILTRMSIHVAQLIADAIYLFAGMAPTRHPLDPDKSNKVLGFPSLITGLCQSFGVPVAPSKVIRPPITRAFIEKYCMQRQAQGGAPQAADAPPPHQAGPAGSFDTEQYLRHLVRQQVANHRAHPPEPGFYFFSVPYSGSVQGRRRMARRLA

SEQ ID NO: 119096 - protein, 128 aa, Glycine max
  Coding DNA Sequence Number=SeqID_27411
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=70%, HitCoverage=75%, E-value=4e-18, Identity=61%"; Hit description=LacZ protein
  Subcellular localization annotation: CTP_CleavageSite=46; ConfidenceScore=5.14e-01
MTMITPSSKLTLTKGNKSCGRHRGGAPIRPIVSRITIHWPSFYNVVTGENPGVTQLNRLAAHPPFASWRNSEEARTDRPSQQLRSLNGEWDAPCSGALSAAGVVVTRSVTATLASADVRRCFLPLRTT

SEQ ID NO: 119097 - protein, 76 aa, Glycine max
  Coding DNA Sequence Number=SeqID_27412
MGVQIATEILIPMTDVVPDVTTSRFRTCRLYMTIYVSSIFGQDVLDIVSDIVDPAASILHLTFYLALCIVQPNLIP

SEQ ID NO: 119098 - protein, 111 aa, Glycine max
  Coding DNA Sequence Number=SeqID_27413
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFVDDLGDDKEGGIGVVGAPDG

SEQ ID NO: 119099 - protein, 100 aa, Glycine max
  Coding DNA Sequence Number=SeqID_27414
  Subcellular localization annotation: CTP_CleavageSite=74; ConfidenceScore=5.22e-01
FYGVPVAPNKVIKPPINQTFIKKYCAPQAGAVQDTTTAWGWPTAGNRRTAATSRVQRMEHFLRPVADQQATKSKAKSKQSTRSVTDKSSSVRLKTLKKRY

SEQ ID NO: 119100 - protein, 104 aa, Glycine max
  Coding DNA Sequence Number=SeqID_27415
MVGYTPSSFTDLVFASKKIEVGPKRGKFDHPTRTTEKTGANEEGEKQGETHAVTAIPIRPSFPPTQQCHYSANNKRAPPSHRPVIHKWLASLTYTTNCGIPTSQ

SEQ ID NO: 119101 - protein, 198 aa, Glycine max
  Coding DNA Sequence Number=SeqID_27416
  Homolog annotation: Hit_ID=A5AZ88; Match level="QueryCoverage=81%, HitCoverage=13%, E-value=8e-09, Identity=33%"; Hit description =Putative uncharacterized protein
MERSMIDAASGGALGDMTPAEARNLIEKMASNSQQFSARNDVIVIRGVHEVATNSSSSGETKKFEGKLDALVNLVTQLAMNQKFAPVARLYGLCSSADPHTDLCPSGQQSEAIEQPEAYVANIYNRPPQPQQQNQPQQNNYDLSSNRYNPGWRNHPNLRWSNHSQQQQQQQLYFQNVAGPSRPYVPPPIQQQQQQPQK

SEQ ID NO: 119102 - protein, 51 aa, Glycine max
  Coding DNA Sequence Number=SeqID_27417
MVTTTKGRILELVKRKPYITWVENDMESSEDSENEEINLCLMAKSYESDEE

SEQ ID NO: 119103 - protein, 146 aa, Glycine max
  Coding DNA Sequence Number=SeqID_27418
MPKVKRFRNPQKSAPQPQSPEVPTDNVPLSHVSTSEVPQEDETTRCHVGRDQSTQCWTIEAIDSEETIKKIKVKVRGVNSLPRELRIIVNFDDQGQTIGEAQALLAGFLGTLAADCKLFPMDYDRWSGPSGVPKAYFDYCFETILK

SEQ ID NO: 119104 - protein, 96 aa, Glycine max
  Coding DNA Sequence Number=SeqID_27419
MQCRPQLNGISFSNIGQQQNQMLVGNFYEQEIRAFNKALLGKWRWEMLQQSNKLWSKILDSKYGGWRSLVEGSRRNNESDEFYPPRWHYLEGGMRG

SEQ ID NO: 119105 - protein, 62 aa, Glycine max
  Coding DNA Sequence Number=SeqID_27420
MPFCGRAKAKLTGALSKGGKMCEVATNVYLWKTSEKPEGNRVKMKILSSGVVFTFEGRREMT

SEQ ID NO: 119106 - protein, 91 aa, Glycine max
  Coding DNA Sequence Number=SeqID_27421
MPAAFNIVATYPSAGGQRVTRGMRVPRKEYARSRHQRLFEENVGKTGKDAIYKLFSERFGSCIYARGKVLAPHTPVPKGRQPLIECAKHDF

SEQ ID NO: 119107 - protein, 113 aa, Glycine max
  Coding DNA Sequence Number=SeqID_27422
MVSRGIIPFEEHIVAVGTTSNNRFSKRKALDEGVATYPSAGGRRVTHGMRVPRKEYARSRHQRLFEENVGKTGKDAIYELLSERFGSCIYARGRVFPFAPTYSSIWDEKIRPT

SEQ ID NO: 119108 - protein, 90 aa, Glycine max
  Coding DNA Sequence Number=SeqID_27423
MKGKSFSFDPAEEEHTTYFTQVTPTEFKHKRLDHCHLERMLNMKKRKYEEKILDLSKITLAEVLHALQAQEQRRLMRQDRVVEGVSRQTS

SEQ ID NO: 119109 - protein, 233 aa, Glycine max
  Coding DNA Sequence Number=SeqID_27424
  Gene Ontology: Mol. function=unspecific monooxygenase activity
  Homolog annotation: Hit_ID=Q6I666; Match level="QueryCoverage=27%, HitCoverage=98%, E-value=1e-25, Identity=78%"; Hit description =Cytochrome P450 like_TBP
VCWGFGGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAATGFSTKRDDQLCESTGSSRTRLNYYCDTVISRMCRPSQTSPPDNVFRPDRPAEAALGSKKRGSAPLPIHGITPTYPTPLKSFHKVGLESSSTGSSFPADSAKPVPLAVVSLDSRQGQWESR

SEQ ID NO: 119110 - protein, 211 aa, Glycine max
  Coding DNA Sequence Number=SeqID_27425
  Gene Ontology: Mol. function=chloramphenicol O-acetyltransferase activity; Biological process=response to antibiotic
  Homolog annotation: Hit_ID=P62577; Match level="QueryCoverage=71%, HitCoverage=68%, E-value=1e-87, Identity=100%"; Hit description =Chloramphenicol acetyltransferase
  Pfam annotation: Domain name=CAT; Domain location=6-164; Score=289.5; E_value=6.8e-84; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVLMPLAIQFIMPFVMLPCRQMLMNYNSTAMSGRAGLQLGANCLPGTECQAWNETNAAITAE

SEQ ID NO: 119111 - protein, 88 aa, Glycine max
  Coding DNA Sequence Number=SeqID_27426
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
MVKVGTSYVPINRLIFAKSWPRASRYQQGHQDLFILRSDLPSQWLLFLSAVPPVQLLTGWCVTAKAPPDISAGKCSGHAARNHHTRRA

SEQ ID NO: 119112 - protein, 207 aa, Glycine max
  Coding DNA Sequence Number=SeqID_27427
MTTLTQIWMTLLLSNILPTDHNSDLPMPKCQLVYAILTRMSIHVAQLIADAIYIFAGMAPTRHPLDPHKSNRALGFPTLITGLCQSFGVPVAPTKVIRPPITRVFIEKYCTQRQGQGDAPQAAGAPPPPHQAGQAGAFDMEQYLRHLVRQQAANHRAHHAEPGLRFFFMPYSRPVQGRGSMARRLARGPSRRGAPGSSRRWRRSPRG

SEQ ID NO: 119113 - protein, 257 aa, Glycine max
  Coding DNA Sequence Number=SeqID_27428
  Gene Ontology: Mol. function=endonuclease activity
  Homolog annotation: Hit_ID=Q9AY32; Match level="QueryCoverage=22%, HitCoverage=86%, E-value=2e-22, Identity=94%"; Hit description=RRNA intron-encoded homing endonuclease
MDTPQDSDPMCCFGIGVMINRDSRGHSYFIVRDTVLVSTINDADQGSADVAFRTPLAPYEKSKSLGSGGSMVARLKLKGIDGRAPPGTESSFLILWVVVHGRSYVGERFVLWLFRYTRIRDRQPAKFELYVKRSSDRTLDVGPHARSFKFLMPYSTFDGLGSLAYHGGDRGKSGASSRARSWTLGWVDRSASGVHRSARPFCRRCAPVLNWPGRASGAVTLRIRVLKQAYALYTLAWIHHRILILCVAFGSEYDYRD

SEQ ID NO: 119114 - protein, 93 aa, Glycine max
  Coding DNA Sequence Number=SeqID_27429
MTTLTQIWMTLLLSNIPSTIPISPCGGITPTKTPSVPGEVQQGPGVSSSGYGPLDHACKTLGGPREVQQGLGVASSDYGPLSVLRSARHPQKG

SEQ ID NO: 119115 - protein, 54 aa, Glycine max
  Coding DNA Sequence Number=SeqID_27430
MEKNEETTMEEKEFNIHLGSTFQPAIQSPKLKFTIDTIIRKPKSSRKGSQSKTL

SEQ ID NO: 119116 - protein, 88 aa, Glycine max
  Coding DNA Sequence Number=SeqID_27431
LALLRPDPQELATKLCIPGRGFELNADGYPLKILRKKMTTLAQTWSALSFSNLIPTSHTSDVTLDRAKLIYGIIMKMDIDVLFFSPIS

SEQ ID NO: 119117 - protein, 259 aa, Glycine max
  Coding DNA Sequence Number=SeqID_27432
  Homolog annotation: Hit_ID=Q6WAY4; Match level="QueryCoverage=59%, HitCoverage=28%, E-value=1e-18, Identity=35%"; Hit description =Putative uncharacterized protein
ALHMGSVLIPTVNKPTEGPCRLLKNVRWGISLPLDVVSKKGTNSPDPRIPWEQIKPARVLPSQGQNPDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMANQGDWVPFMDVLALIIFGVVLFPNVDGLIDLAAIDAFLAYHHSKESPVVAVLADLFDTFDR

SEQ ID NO: 119118 - protein, 70 aa, Glycine max
  Coding DNA Sequence Number=SeqID_27433
  Subcellular localization annotation: CTP_CleavageSite=19; ConfidenceScore=5.22e-01
MGALSKGGKMCESPPTFICGKRRKNRRNPVKMKILSSGVVFTFEEGRQKRGLLLLRTLHRRGNQTDVILS

SEQ ID NO: 119119 - protein, 247 aa, Glycine max
  Coding DNA Sequence Number=SeqID_27434
  Homolog annotation: Hit_ID=A5C169; Match level="QueryCoverage=54%, HitCoverage=11%, E-value=4e-07, Identity=28%"; Hit description =Putative uncharacterized protein
  Subcellular localization annotation: CTP_CleavageSite=41; ConfidenceScore=5.25e-01
MGEPSKKRKGSSSTAAAAAHRRHGPSEAPTTPIHPSLSSPRSSTLFSSDDQRLCQGAPFEGTIVDDWKFDYSSHDARRMVCNDQAEMTGRLLAGSFTFDNRIMHYIIVRILLPRSSNLAQASEEDLILMWAFLTGRQIDWAYLVRYRMHKALRANAPLPYPQLVTLFLRHFQIPLDDEQFVQVKRSFAIGAGAVTSFGYRKDWNGQWLKKDAFPPQDERTPSPLPQRDDSALMNEVLSDYGSSFLCW

SEQ ID NO: 119120 - protein, 216 aa, Glycine max
  Coding DNA Sequence Number=SeqID_27435
MDEIDKVQEQMKADPEALKEKMATMVEAMMSIKEMVEVGAAYQTRARAKIMGEAEEVQEKMKADMEAMKEQMATMMEAMMSMKKIMEANAVIVAATSAVAKVNPMLPSGLKQMNHPTSNMVGKDLGSTDDPMMCKFKTSTPSRHMACLPNYTPPNVAYIPNEDVNNSTPILIKSQQPQSDHAHVSRPMEETHGMPHHNLADFEHWLGYATEGQAVG

SEQ ID NO: 119121 - protein, 82 aa, Glycine max
  Coding DNA Sequence Number=SeqID_27436
VDSRGSPLICTIARSPPSTTYDGVVPGDMSRGSGDLGDVRRAPGSQPIKEQRPQSKEVCVVAGQLWILSDIWNLASGNRLPR

SEQ ID NO: 119122 - protein, 98 aa, Glycine max
  Coding DNA Sequence Number=SeqID_27437
ELARTLQCTVDWILPTPTPYLLVEPVQVIEVTSSKEDPEEDPEELPPEPAVDALDFLEGEEDPLPEVDSPEDVMSASEADSTEESGPGGIATSRGSSS

SEQ ID NO: 119123 - protein, 189 aa, Glycine max
  Coding DNA Sequence Number=SeqID_27438
DVTDMTERLLAGSLAFESRILHYLIVQILLPRSSNLAQVSEEDIVIIHFQIPLDSEPYVPIKRSFLIGAVVIASFGYRKEHDGSWVKKGAQPADDEGNLPTEDSSSLLRKLLDKFDGFRLLLGTSLIPWNCKSTCGSMPWNQGSPKLKKMSPSSDQADVLMMPKDYMFLKVLFKTKKSKIFKMDDQDSL

SEQ ID NO: 119124 - protein, 217 aa, Glycine max
  Coding DNA Sequence Number=SeqID_27439
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=65%, E-value=1e-71, Identity=50%"; Hit description =Photosystem II P680 chlorophyll A apoprotein
  Pfam annotation: Domain name=PSII; Domain location=1-217; Score=94.0; E_value=4.8e-25; Accession=PF00421.10; Description=Photosystem II protein
MHTALLSGWAGSMALYELAVFDPSDPVLDPMWRQGMFVIPFMTRLGITNSWGGWNITGGTITNPGIWSYEGVACFGFGAFHVTGLYVLEYGVRSLWTNWKDTIRLFHLSVRPPQRLYKGLRMGNIETVLSSSIAAVFFAAFVVAGTMWYGSATTPIELFGPTRYQWDQGYFQQEIYRRVGAGLAENQSSMDNGDGIAVGWLGHPVFRDKEGHELFVR

SEQ ID NO: 119125 - protein, 97 aa, Glycine max
  Coding DNA Sequence Number=SeqID_27440
  Subcellular localization annotation: CTP_CleavageSite=42; ConfidenceScore=5.17e-01
MTHQDFQVQAIGQFAQATCAPEFGLPRPFNQRLLVCTWWGAVNTKRSGLSRIGCWTNSLSYLKKKGESSTTRDPRSLNPFSEIRRREEEVSPKRGRL

SEQ ID NO: 119126 - protein, 101 aa, Glycine max
  Coding DNA Sequence Number=SeqID_27441
MSYQNEETDKKKRSIALKASSSMQEANEEEDSDDEEDFSLFVKKFQKFVKKRRIERRQNFNNGRKSQEDSQVLRCYKCNQEKEINLLTKDYESDENISQED

SEQ ID NO: 119127 - protein, 195 aa, Glycine max
  Coding DNA Sequence Number=SeqID_27442
NTETFSSLTSYPELRRSEFLIGGYVGARASLLSTTPPFVAITQELVARGDTLRLSAPRHSVTPSVIDEQRPMWSSGLFRRCQHFPMETFQVSQVIQNYTLRSCDAHPFCHPEAAGPMTSKDQSCPMARRDQVWSFCTHDTRRYLTVIRTPLPFRHSRVRWHAETKFGHSAPMIRGDTLRLSAPFCHPEQMTSRDQ

SEQ ID NO: 119128 - protein, 260 aa, Glycine max
  Coding DNA Sequence Number=SeqID_27443
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSIAMKIVRKDLVPNGPGSVKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 119129 - protein, 116 aa, Glycine max
  Coding DNA Sequence Number=SeqID_27444
MNIVTDNFDIDRRGVEVFKLQFAYDQAYRYRRPRGGARYQLLFPLVRVNFELGVIMVIAVSFGETCRASCINESANARGEAVCVLGASGVYTGLLCGTDEVSVKVLHGGRRKKAAP

SEQ ID NO: 119130 - protein, 46 aa, Glycine max
  Coding DNA Sequence Number=SeqID_27445
  Subcellular localization annotation: CTP_CleavageSite=17; ConfidenceScore=5.18e-01
MGNYAKNFNRSSTFIVRSSFFFGLQPWSPFVSCTFILVSFTFHTPF

SEQ ID NO: 119131 - protein, 53 aa, Glycine max
  Coding DNA Sequence Number=SeqID_27446
MDEKCNQMQEKNQQMNEHAVKFGFRLTLLEQWMSGRHGGSHFEKHNWLEVEMK

SEQ ID NO: 119132 - protein, 74 aa, Glycine max
  Coding DNA Sequence Number=SeqID_27447
MADSFLGDISQQQLHPLRNKEEGDEHLFFNCSKTLPLWWESMFWVNLITIMPQNHRDHFLQHGIEVADGVRSKT

SEQ ID NO: 119133 - protein, 59 aa, Glycine max
  Coding DNA Sequence Number=SeqID_27448
MSETHHDHRFTSTPYVLMDPAYPSAGGRRGAHECVFHGRKMRGVATNVYSRKTSEKLEK

SEQ ID NO: 119134 - protein, 352 aa, Glycine max
  Coding DNA Sequence Number=SeqID_27449
MSHHSSSVNGEGTSHKDPLSRILDELSSPKLWKEKQERKEKGKKRVEEISQDERKKIREEERRKIMKEMKREKYASYSSHNSCKSLSKELGDYYEGRHRSHLRPHSHRREKERKPQEANISLSYFHGKDNVEANLDWEIRVNQQLKKKSTSKSYGSHSYPKKDQGQGILGVTPSIPKDDKGKAIEKQAPKARAKIYSSQDEATTSPSSSESEKAKGEESSEEIYPQEEGQPLMVKEKCKEVSVSSKSLAKKETHFTIKTNIKETFPLRQPPHFLFCKKALASIATPLGLEFIPQVKKLLDEGLFRKSLNPCALLVPKIGIIRHQVPKIGGIMNVLNGATLFCKITRTPNIFM

SEQ ID NO: 119135 - protein, 203 aa, Glycine max
  Coding DNA Sequence Number=SeqID_27450
  Homolog annotation: Hit_ID=A5ZYV5; Match level="QueryCoverage=32%, HitCoverage=67%, E-value=1e-16, Identity=72%"; Hit description =Putative uncharacterized protein
PKDGYRFKDARCPCFFRVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGKDPMKASLFPGIGFWAFPAQLKASQKVTEACKGFLGPDGDWPSSAKAEGSLTARPTRRAGTKVGLSDPTVPSGRAVAQRIKVTLGITG

SEQ ID NO: 119136 - protein, 171 aa, Glycine max
  Coding DNA Sequence Number=SeqID_27451
  Homolog annotation: Hit_ID=Q84VI1; Match level="QueryCoverage=100%, HitCoverage=25%, E-value=1e-51, Identity=66%"; Hit description =Envelope-like protein
MATSPKETAASGSPAVPSSPHQEQPEFNIQPIQIIPGQASVPEKLVPRRQQGAKIAENPSLATSPREVDTEMDKKIRSIVSSILKDASVPEADEDVPTSSTPNVSVPDVEKDVPTSSAPNAEAFPSPSEEESTEEEDQASEETPAPRAPEPAPGDLIDLEEVESDEEPIAN

SEQ ID NO: 119137 - protein, 101 aa, Glycine max
  Coding DNA Sequence Number=SeqID_27452
MTATRVRKECDKLRDVNMATTEALERETKRAKKEEWVQNKFRGALWGSNNGLKLRRAERDYFEKHVILWHHQNIQLDPLSTSMILEDKLKACQRSKKGLTE

SEQ ID NO: 119138 - protein, 223 aa, Glycine max
  Coding DNA Sequence Number=SeqID_27453
MWMDRFALTLNGSQDLPRLLAKAKAMAEVCMAPKETHRLINYCQHMIDLMAHKTIEDKATATASSTVWEVEPVLQPALNPGRDRNTAVFGRRYIPQAYPYGLPSDFTPRATPEDLSQAPTFEGQLPPYDDYPGQDDEEGDTHLGPLLHLKDPSPHELPQPNIVRHIPASPTPIKESVPFVEDKGKIEALEERLRAVEGLDNYPFSDLADLCLVPNIVIPPKFK

SEQ ID NO: 119139 - protein, 65 aa, Glycine max
  Coding DNA Sequence Number=SeqID_27454
MARVQIATKPTGAFQDVPPEGGCFWRKQPSSPGRAELAWASWVASISFLFLYIGGGGKNKNVQPS

SEQ ID NO: 119140 - protein, 120 aa, Glycine max
  Coding DNA Sequence Number=SeqID_27455
MHALLGSFNSGNWSDSKVLGSTGLSCCAITREWGTKSTLVPLDLEIEATLRRNRAERRRKLLQDKTVASILEEETHFSDSLSPDSPSSRESANQHSKTATTADEHDQRTTLEDYSSGFVP

SEQ ID NO: 119141 - protein, 91 aa, Glycine max
  Coding DNA Sequence Number=SeqID_27456
MSGFTRNSPQISASPHQLDLAPYASEPYHAQWNASGLLRDKHTLRSSRILREMEVDEPWLGLWLPLNYQVDMGASQHRTLELGWCSSLEVR

SEQ ID NO: 119142 - protein, 231 aa, Glycine max
  Coding DNA Sequence Number=SeqID_27457
  Homolog annotation: Hit_ID=A0ST23; Match level="QueryCoverage=10%, HitCoverage=51%, E-value=8e-07, Identity=100%"; Hit description =Putative reverse transcriptase
CSSGFCFYQLSLPVQLLTGWCVTAKARPDISAGKCSGHAARRVPFAIQAAQLLGRAIGAGLFAITPAGERGMCCKAIKLGNARVFPVTTLNSIVKHFIFCWNTKPKYTSGQLFGQWHQAYRYRRPRGGARYQLLFPLVRVNFELGVIMVIAVSFGKPVVPAALMNRPTRGERRFAYWALAECILAYYVGTDEGYIPLPRSLTRYARSFDCGERKWLTNGAEDFLGRCQEDT

SEQ ID NO: 119143 - protein, 32 aa, Glycine max
  Coding DNA Sequence Number=SeqID_27458
MGAKYLEVVKRGSHPNNGWSSDEIRELMKHWA

SEQ ID NO: 119144 - protein, 78 aa, Glycine max
  Coding DNA Sequence Number=SeqID_27459
MSRNSTDCLTMGVKFLKAIKRGSHAIKQWSPDEIRNVIRPINIPTSGTSAIALDRPWMTKGAGDDVSLLMLSCVESYR

SEQ ID NO: 119145 - protein, 269 aa, Glycine max
  Coding DNA Sequence Number=SeqID_27460
  Homolog annotation: Hit_ID=Q5W7C9; Match level="QueryCoverage=52%, HitCoverage=50%, E-value=4e-61, Identity=86%"; Hit description =Unknow protein
  Subcellular localization annotation: CTP_CleavageSite=71; ConfidenceScore=5.16e-01
GILNALATALHGSIRTAPSIHRLRLGLLGYLIPFAPLAFVSQCQCRPSRVLSPLVFFPISTHFTAPPEIPSAPTVLQLGSFHRLSRVEPWDLTANLKSHLQTLYAQSFRITLASSVLPRLLGTELADAYSPDTVIASSPEKKFMTLPVWLIILLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVK

SEQ ID NO: 119146 - protein, 288 aa, Glycine max
  Coding DNA Sequence Number=SeqID_27461
  Gene Ontology: Mol. function=o-succinylbenzoate-CoA ligase activity; Cellular component=integral to membrane; Biological process =menaquinone biosynthetic process
  Homolog annotation: Hit_ID=A8GGY7; Match level="QueryCoverage=99%, HitCoverage=62%, E-value=1e-126, Identity=77%"; Hit description=O -succinylbenzoate-CoA ligase
  Pfam annotation: Domain name=AMP-binding; Domain location=1-214; Score=-75.9; E_value=0.00034; Accession=PF00501.19; Description=AMP -binding enzyme
MDFQREDCWLLSLPLFHVSGQGIVWRWLAAGARLAVREMHPLAEALAGCTHASLVPTQLWRLLAQPLTGMTLKEVLLGGAMIPVELTERAEAAGIHCWCGYGLTELASTVCAKRADARPGVGLPLSGREVKLVDEEVWIRADSLALGYWCHGQLQPLADAQGWFATRDRGAMAEGELRILGRLDNLFFSGGEGVQPEDIERVLAAHPQISQAFVVPAADVEFGQRPVAVIDGDPSLSLAALLAWSQDKLANFQRPAALLPLPDELKNGGIKISRRQLQQWVAQRLSQA

SEQ ID NO: 119147 - protein, 460 aa, Glycine max
  Coding DNA Sequence Number=SeqID_27462
  Homolog annotation: Hit_ID=Q6WAY6; Match level="QueryCoverage=83%, HitCoverage=64%, E-value=7e-25, Identity=26%"; Hit description =Putative uncharacterized protein
MANQGDWVPFMDVLALLICGVVLFPNVDGLVDLAAIDAFLAYHHSKESPVVAVLADLFDTFDRRCEKSSARIICCLPALCVWLVSHLFQQDTRHPCPLLSHRSCTEKRRMDWDQLLAGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQQLRGIRNGIIGGLARKLKVVSEEILKHRKRRGSPSSQKQVRKGKTAKEKFKLAATHVRKECAGLREENAITARALEQETKRARKEEYGRNKFRGALWGSNSELKLRREERDQSRAHGMVLKEELMTCSRSKRSLSQRLCETETNMLAIIAKYEEELGLATAHEHRIADEYAQVYAEKEARGRVIDSLHREATMWVGRFALTLNGSQELPRLLAKAKAMADTYSAPEEIHGLLGYCQHMIDLMAHIIRNR

SEQ ID NO: 119148 - protein, 277 aa, Glycine max
  Coding DNA Sequence Number=SeqID_27463
MEESMSPFLVRDFGTQNFKAIQRIHKAWETPLRKDQELRGIRNGIIGDWLAKLKVLSKDSFEAPEEDKEVQALKNELGKAKLAKEKFKLAATHIRKEYAELREENATTTRALEQETKRARKESMAITNFAGALWGSNSELKLRREERDQSRVHSMVLKEKLVACSRSKRSLSQRLCETETNMLAIIAKYQEELSLATAHKHRVADEYAQVYAEKEARGRVIDSLHQEATMWMDQELPRLLAKAKAMADTYPAPEEIHGLLGYCQHMIDLMAHIIRNR

SEQ ID NO: 119149 - protein, 175 aa, Glycine max
  Coding DNA Sequence Number=SeqID_27464
  Gene Ontology: Mol. function=metallopeptidase activity; Cellular component=integral to membrane
  Homolog annotation: Hit_ID=A6TC98; Match level="QueryCoverage=100%, HitCoverage=60%, E-value=1e-80, Identity=85%"; Hit description =Putative uncharacterized protein ypfJ
  Pfam annotation: Domain name=Zn_peptidase; Domain location=1-175; Score=222.7; E_value=8.5e-64; Accession=PF04228.4; Description =Putative neutral zinc metallopeptidase
MRWQGRRESDNVEDRRSDSGSPLGGGGGGFRIPSGKGGIVLLIIVLVAGYYGVDLTGMLTGEPMPQQQTSTQRSISPKDDEAAKFTSVILATTEDTWGPIFEKMGRQYVQPKLVMYRGATRTGCGTGQSVMGPFYCPADSTVYIDLSFYDEMKNKLGADGDFAQGYVIAHEVGHH

SEQ ID NO: 119150 - protein, 157 aa, Glycine max
  Coding DNA Sequence Number=SeqID_27465
  Gene Ontology: Biological process=transposition, DNA-mediated
  Homolog annotation: Hit_ID=Q1J7G7; Match level="QueryCoverage=25%, HitCoverage=70%, E-value=9e-12, Identity=73%"; Hit description =Transposase
GTSYVPINVSIFRQKLAQGLPVLQWLLFLSAVPPVQLLTGWCVTAKAPPDISAGKCSGRVPFAIQAAQLLGRAIGAGLFAITPAGERGMCCKAIKLGNARVFPIGKPVVPAALMNRPTRGERRFAYWALAECILAYYVGTDEGVSEVLHVAGEKRLH

SEQ ID NO: 119151 - protein, 256 aa, Glycine max
  Coding DNA Sequence Number=SeqID_27466
MEDRALQHALEAERRLSVALFFAGGQRRCGLFDEGFQLLAQRGQIHRTCLKRFSRGRVAQQRQQQVLHGHKLVSVLTRPGESHVETEFQFLIEHKHLPNRLPYSGFFQRTKQRMLVLPCVPVHMDDFGFRHLGGKNTTDRLALIVDREHQLRCAFNIIRKELLQNVNHKFHRCVIVVVKYNFIHRRRFYRIDLFFFGQVFKFSQSLLLPIAAHLLCSALRYGGRFRLFKVGIVTILSSSASSRRTVTCAKKRANCD

SEQ ID NO: 119152 - protein, 170 aa, Glycine max
  Coding DNA Sequence Number=SeqID_27467
  Pfam annotation: Domain name=G-patch; Domain location=2-43; Score =25.2; E_value=0.00017; Accession=PF01585.14; Description=G-patch domain
MMVTRVMLGHGYEPGMGLGKNNGGRTGLVSTRGNRRKFGLGYKPTQADIRKNISERKNKGQGPWSGQRAKEAPPCHISRSFVSAGLRHEGQVATICDEDSPRRSNLVHPCPPGFHLGNSRVEEQPDVYATSIISDDESREGTNTGDPAVDFKQEASRTEDEEDEDVGHSP

SEQ ID NO: 119153 - protein, 163 aa, Glycine max
  Coding DNA Sequence Number=SeqID_27468
  Homolog annotation: Hit_ID=Q6UUU1; Match level="QueryCoverage=68%, HitCoverage=93%, E-value=5e-35, Identity=60%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCMAAFVSSTPDTQFRVGSSLQAGL

SEQ ID NO: 119154 - protein, 419 aa, Glycine max
  Coding DNA Sequence Number=SeqID_27469
  Homolog annotation: Hit_ID=Q6WAY6; Match level="QueryCoverage=24%, HitCoverage=17%, E-value=2e-10, Identity=41%"; Hit description =Putative uncharacterized protein
MVGDSARELDRRKQTRNGVVGLPWKYLEGKARDMAKQEEWVPFADILALLIFGVVLFPNVDGLVDLAAIDAFLAYHHSKESPVVAILADLFDTFDRRCEKISALIVCCLPALCVWLVSHLFQQDIRHPCPLQSYRSCVEKRRVDWDQYLARIRRAKSQGCTKSPQGVGSPLRKDKELRGIRNGIIGGYHEWLRVHRRGLDWFSKLKVVNEENFEAPEEDEEVQALKLELGKARLAKEKFKSAATNIRKECTELREENVATARALEHETKRAHKEEHGRGKFRGALWGSNNELKLRREERDQSRVHGMILKEELVACSRSKRSLAQHLEATEQSMLAIIGQYKKELNQSLTHEQKLVEDFAQAYTEKEARGRVIDALHQEATMWMDRFALTLNGSQDLPRLIAKAKAIAEVCTAPEEFTG

SEQ ID NO: 119155 - protein, 53 aa, Glycine max
  Coding DNA Sequence Number=SeqID_27470
MEGLLSGEFEAAENSSEQSDGLKPSNWGKSFIKVYTFNLSVALSNKSGPCFWL

SEQ ID NO: 119156 - protein, 111 aa, Glycine max
  Coding DNA Sequence Number=SeqID_27471
MSASDHAILRDKVHQPTKKSLLELSSQDALLAQNKLLSRKLEILTETLGCTVCGEAHESGHCIPIEEHTKEVHYMGNQQRQGYNQEGFLGFQQGLYNQQGQWISHAWQSIQ

SEQ ID NO: 119157 - protein, 101 aa, Glycine max
  Coding DNA Sequence Number=SeqID_27472
MDNHSGISARQRDSKVSMTDLVSAEDDGCGMTIICLRMSSGPPPLDDKRVQNDHNLSLRAIGHDWGQYDRDCGAADKSEALAPTYPPMRTQTYAVLDTCET

SEQ ID NO: 119158 - protein, 274 aa, Glycine max
  Coding DNA Sequence Number=SeqID_27473
  Gene Ontology: Biological process=transposition, DNA-mediated
  Homolog annotation: Hit_ID=Q1J7G7; Match level="QueryCoverage=10%, HitCoverage=42%, E-value=8e-10, Identity=100%"; Hit description =Transposase
GFPVSQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPSHDVVKRRPVNCNTTHYRANWSSTAVAAALELVDPPGCRNSIITMDIICYCDRTAHADICRIVSNLPFLAYGRTHFTMIFPKHKNVSKSGGARYQLLFPLVRVNFELGVIMVIAVSFGKPVVPAALMNRPTRGERRFAYWALAECILAYYVGTDEGVSEVLHVAGEKRLH

SEQ ID NO: 119159 - protein, 78 aa, Glycine max
  Coding DNA Sequence Number=SeqID_27474
MTEIKEGSSTKTSQSIPLELVGLGSSSSMDSFVSWKMNGSGMEKEERDETPFKEKMSLEEAHPHRRPWIRAWRKKGDE

SEQ ID NO: 119160 - protein, 131 aa, Glycine max
  Coding DNA Sequence Number=SeqID_27475
  Subcellular localization annotation: CTP_CleavageSite=34; ConfidenceScore=5.56e-01
MVVLLFCSSTIFAFPLTFAGCVGRSGGANTRPLRVMPLSPVILVTLADNELMSMASSFLSLGGTYLHGTAWLFRYGKGTGLATEGYRGFCEAASLVKYITKGLGLPKLLSSADYIYICCSSLPSSPTSSRP

SEQ ID NO: 119161 - protein, 117 aa, Glycine max
  Coding DNA Sequence Number=SeqID_27476
  Homolog annotation: Hit_ID=A5ATL8; Match level="QueryCoverage=34%, HitCoverage=32%, E-value=7e-14, Identity=92%"; Hit description =Putative uncharacterized protein
MPREGRRPTVRRQIPGLNPGQAVETTKLEYETKARGANGIRYPSSPSRKRWILGAVRIDPCNAVANALSIPPGDEEPLPGLDMPRILLKERGAFGNADTGGAWLSSARATAGDKPEE

SEQ ID NO: 119162 - protein, 165 aa, Glycine max
  Coding DNA Sequence Number=SeqID_27477
  Subcellular localization annotation: CTP_CleavageSite=26; ConfidenceScore=5.03e-01
ASQGSFVAYGRQVGATIKQYFGPAPRTSHRSSSMAPEDLKQLMQKIRDQLEESITEKGLALPPETEVGPSTACVSTKESCVDPSGNDPNTGRLYEGSTTVHNIPLRHDQVKVGAEEVTDVDVHIPVPTKEGAVGPAKPADRPNHDVDDLLYLMTLTIPQLFLKPL

SEQ ID NO: 119163 - protein, 70 aa, Glycine max
  Coding DNA Sequence Number=SeqID_27478
MQVKQVQLKIWWEQGRGQIYLDGSKSNNNVYNATAAGMDQNFLFQKVNLSNLISHYKYPNVVDLVRGMRK

SEQ ID NO: 119164 - protein, 79 aa, Glycine max
  Coding DNA Sequence Number=SeqID_27479
  Gene Ontology: Mol. function=nucleic acid binding
  Homolog annotation: Hit_ID=Q2A9Z4; Match level="QueryCoverage=88%, HitCoverage=13%, E-value=5e-09, Identity=42%"; Hit description=Zinc knuckle family protein
MTNEKYMFQSLSPMSSGVVIFGGNQKGMINYVGKVWHKKLGHASVRLISKLKKHSLVRGLPKLSYEDDSLVKLSRKGNK

SEQ ID NO: 119165 - protein, 75 aa, Glycine max
  Coding DNA Sequence Number=SeqID_27480
MGAPEKSGGMENWANQRYANNFAGAPRLEGGGTHETSSRQIKFMGAPKKSGRMENWRTALRNNFAGAPDSLVEDA

SEQ ID NO: 119166 - protein, 148 aa, Glycine max
  Coding DNA Sequence Number=SeqID_27481
GSVLSAVPPVQLLTGWCVTAKHRRTSALASVAAAQLLGRAIGAGLFAITPAGERGMCCKAIKLGNASVFPSHDVVKRRPVNCNTTHYRANWSSTAVAAALELSGKPVVPAALMNRPTRGRGGLRIGALAEGILAYYVGTDEGVSEVLH

SEQ ID NO: 119167 - protein, 272 aa, Glycine max
  Coding DNA Sequence Number=SeqID_27482
MAPRKLASKRSRKDKAAEGTSSAPEYDSHRFRSVEHQQRFEAIKGWSFLRERRVQLRDDEYTDFQEEIVRRQWASLVTPMAKFDPGIVLEFYANAWPIEEGVRDMRSWVRVLEEGQECEYGQRRNRTDGFDEEAIAQLLCIPGQDFARTAAGRRVRIMRTNMTTLTQIWMTLLLSNIQPSDHNSNLPLPKCQLVYAILTRMSIHVAQLIADAIYLFAGMAPTRHPLDPNKSNRALGFPALITGLCQSFGVPVAPSKLIRPPITRAFIEKYCT

SEQ ID NO: 119168 - protein, 123 aa, Glycine max
  Coding DNA Sequence Number=SeqID_27483
MMNVLSVATFFCKIGHAHNIFMIHVHRDSLGRNNQHKNIEKGVPMNPKRIKVTPEWPTPPSVEGRSPEYEEPRDLRSNPFQGGGNDAILSRKGIGRRLQVDWLEIQGRPRVLLSLRVDFEPMG

SEQ ID NO: 119169 - protein, 117 aa, Glycine max
  Coding DNA Sequence Number=SeqID_27484
MAVQGKSIQRRVQPKAKMLGRAKESAKLMCSRIIMAACACNLGRCSVVQAELGLGDLSWDHIRLIKDKGIPGQRDQSSGRDRLDKHDGLEVAEGVLVVDSPPPLLADLAVVFFFPWF

SEQ ID NO: 119170 - protein, 321 aa, Glycine max
  Coding DNA Sequence Number=SeqID_27485
  Gene Ontology: Mol. function=hydrolase activity; Cellular component =cytoplasm
  Homolog annotation: Hit_ID=A7NWE4; Match level="QueryCoverage=52%, HitCoverage=66%, E-value=5e-62, Identity=70%"; Hit description =Chromosome chr5 scaffold_2, whole genome shotgun sequence
  Pfam annotation: Domain name=DLH; Domain location=28-204; Score= -52.5; E_value=0.0012; Accession=PF01738.9; Description=Dienelactone hydrolase family
MSGPECCSNPPVLNPNAGAGHVEKLAGLNSYLSGSPNSIAILLISDIYGYEAPNLRNIADKVAAAGYYVVVPDFFHGDPYNPENASRSIPVWLKDHGTDKGSEAAKSIIEALKSKGVMAIGAAGFCWGECALFFIPTAKVVVELAKSRLIQAAVLLHPSFVSVDDIKVLPHFQNNHICLHVDLQCILHIADVLIRSRNGVGIIVDKEWKKDVVDVRRVGDRIIVLKLVVGQDTFNVISGYAPQVGLAEHFKVKFWEDLEGVLQDIPQGEKVFLGGDLNGHVGSVARGFEGVHGGFGLGEMNGEGKSILEFSEALDLSIANT

SEQ ID NO: 119171 - protein, 113 aa, Glycine max
  Coding DNA Sequence Number=SeqID_27486
MVAVNNDDIGGGDRGDINGGGGNNDVGGDNNDEVVVAINVNDVNDDNDDGGNSKVSDDDGTKWWRVVVTLIVIVMVAMLVIMVMSLTMVVVIAVLVVMVVATNYDGDNDDDSN

SEQ ID NO: 119172 - protein, 328 aa, Glycine max
  Coding DNA Sequence Number=SeqID_27487
  Homolog annotation: Hit_ID=A7NWF4; Match level="QueryCoverage=61%, HitCoverage=65%, E-value=1e-73, Identity=67%"; Hit description =Chromosome chr5 scaffold_2, whole genome shotgun sequence
  Pfam annotation: Domain name=DUF1749; Domain location=149-328; Score=- 81.1; E_value=4.2e-10; Accession=PF08538.1; Description=Protein of unknown function (DUF1749)
MGENKHTGVSERERKERGCKQREKLNSKNHHHRSVPLYIIKSPTTMHHATLVKIHVVIVVVVSVVVVMVMPRIFFRLGSRIPSLTLLLGPPSPQHGYNYNLDKAMNPSLTSSSTLSSSSSSWFSGIVRVGRSNSVKMSNNSAAAPSSDTAGPVVRKNQFRGVLFKYGPNPIQVAFKTGDFKRQVIFIGGLTDGFLATPLQLLVEFTLKDAKELDQLINYLINKEDSEGVALLGHSTGCQDIVHYMRTNFACSRAVRAAIFQAPVSDREYQATLPHTASMIDLAAKMISEGRGLELMPREADPSAPITAYRVRLRCTISIDSDDALFGN

SEQ ID NO: 119173 - protein, 54 aa, Glycine max
  Coding DNA Sequence Number=SeqID_27488
MLLGGSLPNRTWFVDCDRALSVTRGNDGINDSRFQDEGTVKNNNDSRFQDEDGK

SEQ ID NO: 119174 - protein, 165 aa, Glycine max
  Coding DNA Sequence Number=SeqID_27489
MAKLMDGAIGGAATILGGCHHRLELLKVDAAATVGIDRLDHVVKFVDGALEAEAVEHELELCGGDEAIFVTVVEIEGVAKLVGFAIDGGVRATKGGKLREADEAVAIGVEVFHDTMEVLRRDTGFERPEHVVELVGGDLVVAVGVKELLELLKRDAITHSVCNVT

SEQ ID NO: 119175 - protein, 71 aa, Glycine max
  Coding DNA Sequence Number=SeqID_27490
MASKESKFPPQSQKTQPGKEHVMNPLPQEESSLIDRCIISTEDEGLAQTHTNSHVGYYQVVSCIAGLSETT

SEQ ID NO: 119176 - protein, 113 aa, Glycine max
  Coding DNA Sequence Number=SeqID_27491
  Gene Ontology: Mol. function=deaminase activity; Cellular component =cellular_component; Biological process=purine ribonucleoside monophosphate biosynthetic process
  Homolog annotation: Hit_ID=A5C4M9; Match level="QueryCoverage=76%, HitCoverage=24%, E-value=2e-31, Identity=73%"; Hit description =Putative uncharacterized protein
MGKKNRANVPTLKLYWKVMLALEMRHFGVVGIDLSGNPAVGEWITYLLALKFAREQGLYVTLHCGEVSNSKEIHDMLDFLLQRIGHACFFKEEHWRRLKSSNIPGISLTPCFW

SEQ ID NO: 119177 - protein, 424 aa, Glycine max
  Coding DNA Sequence Number=SeqID_27492
  Homolog annotation: Hit_ID=A7QZN7; Match level="QueryCoverage=72%, HitCoverage=57%, E-value=2e-22, Identity=41%"; Hit description =Chromosome chr10 scaffold_282, whole genome shotgun sequence
  Subcellular localization annotation: CTP_CleavageSite=59; ConfidenceScore=5.84e-01
MNTRKHSIPSPRNFPSANTSPVNFRRSSPKTHLSARKLAARLWHLRFFNLESSPPRVKRSAQEVTRRDSRKLLGETKLIGGESLLLSELLRAQTCINRLNAEKLLWKRRELKKNQSMLEDLKDKLARERTSRERMESMNAKLVLELAQAKLYAKQFMVYYKEEKRKREIIEQVCNELAMQIGEGKAKLEGMEEERNMLHIAGLLREESIQMKLLDAKLSLEDKYNQMIQLIAHLQSFLSSRGDQQAAQSLNVEISCDFTKSNDVFHERLIQVEPYYPSSLIGPSSTVHIVSLDEDHSLNNNANQNIHGLGTEAECCENACYNHSDSLALQKSQDSKIVNCKGRFARNLVKTTFMSKGSGESGFRQWELLGQPKSAESVNPHITRGMKGCIEWPRGISKINSKVIPLEERVRKQKSQLQHILKPH

SEQ ID NO: 119178 - protein, 897 aa, Glycine max
  Coding DNA Sequence Number=SeqID_27493
  Gene Ontology: Mol. function=hydrolase activity, hydrolyzing O -glycosyl compounds; Cellular component=anchored to membrane; Biological process=carbohydrate metabolic process
  Homolog annotation: Hit_ID=O65399; Match level="QueryCoverage=36%, HitCoverage=80%, E-value=1e-165, Identity=85%"; Hit description =Putative glucan endo-1,3-beta-glucosidase 1 precursor (EC 3.2.1.39) ((1->3)-beta-glucan ...
  Homolog annotation: Hit description=endohydrolase 1) ((1->3)-beta -glucanase 1)
  Pfam annotation: Domain name=ACT; Domain location=302-385; Score =21.1; E_value=0.0042; Accession=PF01842.16; Description=ACT domain
  Pfam annotation: Domain name=Glyco_hydro_17; Domain location=444-765; Score=315.7; E_value=8.6e-92; Accession=PF00332.9; Description =Glycosyl hydrolases family 17
  Pfam annotation: Domain name=PDT; Domain location=115-292; Score =247.4; E_value=3.2e-71; Accession=PF00800.9; Description=Prephenate dehydratase
  Pfam annotation: Domain name=X8; Domain location=780-862; Score =158.0; E_value=2.5e-44; Accession=PF07983.4; Description=X8 domain
  Pfam module annotation: Pfam domain module=ACT::Glyco_hydro _17::PDT::X8; Domain location=302-385::444-765::115-292::780-862
MALKAVSIWGCYKPPPQLGVGVSNSHSTLIGNLRYDYDKCRKWECCCLGVLAQRATTAVEDEGPSVPPLVDSSGAADGVHQNESKGFHKDLNLLPKPLTAIDISSYPRDGSKVRVAYQGLPGAYSEDAALKAYPKCETVPCDNFEAAFKAVELWLVNKTVLPIENSVGGSVHRNYDLLLRHRLHIVGEVQLRVNHCLLGLPGVRKEELRAVVSHPQAFAQCETTLSDLGAVKIAARDTAAAAQTVASNCARDTGAIASSRAAEVYGLDILAERIQDDDENITRFLVLAREPIIPGTDRPHKTSIVFSLEEGPGVLFKALAVFAMRDINLSKIESRPLKQRSLRVVDHLNEGSATYFDYLFYIDIEASMAEPRAQYALGQLQLAHVISSTRAEAGMRKLSLGSFSMANSNLVIILYFSFFTFAEAEALHSQLKQQIQDQEKLPFVGVNIGTDVSNLPSASDLVAFLQLQKITHVRIYDANSDILKTLSGTKIRVIISVPNNQLLAIGSSNSTAASWIDRNVVAYYPQTLISGISVGDEVLTTVPSSAPLILPAVESLYNALVASNLHQHIKVSTPHAASIILDPFPPSQAYFNQSLVSVILPLLQFLSRTGSPLTMNLYPYYVFMQNKGVVPLDNALFKPLTPNKEMVDPNTLLHYTNVLDAMVDAAYFSMKNLNITDVAVLVTETGWPAKGDSKEPYATKDNADTYNSNLIRHVFDRTGTPLHPETTSSVFIYELFNEDLRAPPVSEANWGLFYGNTSPAYLLHVSGIGTFLANDTTNQTYCIAMDGFDSKTLQAALDWACGPGRANCSEIQPGETCFQPNNVKNHASYAFDSYYQKEGKAQGTCDFKGLAMITTTDPTYLSLIDSTFDVMQQESEQQDKGSGQLYYLKQCRREVEV

SEQ ID NO: 119179 - protein, 94 aa, Glycine max
  Coding DNA Sequence Number=SeqID_27494
MKSLKTLFLLAMLMALAVFVSGISPGSGEPKGKINRFLSDRVVLKCDKYPKMSPIVGNVERNVAMVRYVAKYIYEMDEHVCVTFGANARNNIFV

SEQ ID NO: 119180 - protein, 250 aa, Glycine max
  Coding DNA Sequence Number=SeqID_27495
  Gene Ontology: Mol. function=transferase activity, transferring glycosyl groups; Cellular component=cytosol; Biological process='de novo' pyrimidine base biosynthetic process
  Homolog annotation: Hit_ID=Q1RU71; Match level="QueryCoverage=99%, HitCoverage=58%, E-value=3e-91, Identity=68%"; Hit description =Phosphoribosyltransferase; Orotidine 5-phosphate decarboxylase
  Pfam annotation: Domain name=OMPdecase; Domain location=48-237; Score= 163.3; E_value=6.3e-46; Accession=PF00215.15; Description=Orotidine 5'-phosphate decarboxylase  HUMPS family
MENQKVAALAKVGKPATKVKALSFGERAKLSKNPIGKRLFEIMAEKESNLCLAADVGTAAELLEIAGKVGPEICLLKTHVDIFPDFTPDFGSMLLSIAEKHNFLIFEDRKFADIGNTVTMQYEGNTSTHGLTCFLNHAQGLPRGRGLLLLAEMSSAGNLAKGDYTTAALKIAENHSDFVIGFISVNPASWPGAPINPSFIQATPGVQMVVHDRGSDIIIVGRGIIKAVNPEEAAREYRLQGWNAYLAKCT

SEQ ID NO: 119181 - protein, 360 aa, Glycine max
  Coding DNA Sequence Number=SeqID_27496
  Gene Ontology: Mol. function=zinc ion binding; Cellular component =intracellular
  Homolog annotation: Hit_ID=A7R055; Match level="QueryCoverage=90%, HitCoverage=90%, E-value=1e-110, Identity=57%"; Hit description =Chromosome chr10 scaffold_297, whole genome shotgun sequence
  Pfam annotation: Domain name=Exo_endo_phos; Domain location=134-334; Score=15.5; E_value=0.00024; Accession=PF03372.14; Description =EndonucleaseExonucleasephosphatase family
  Subcellular localization annotation: CTP_CleavageSite=66; ConfidenceScore=5.16e-01
MSCWACKKCTFVNLPSQKGECEICFSPASPLSMGPSCSSSPPKWSCKACTFLNPYNNPSCEVCATRCSVLSLSNLTDLNDATDHDSSVGSVFFPLRTCNKRKAIDDDDSSEVINFKVKPSNITGDENIDTGKAFKILSYNVWFREDLELHKRMKAIGDLVQLHSPDFICFQLSKLPVKSFSNKPFSNSIMGRELCIAEVEAASGKPLVIATSHLESPCPAPPKWDQMYSKERVVQANEAINLLKKQPSVVFGGDMNWNDQQDGQYPLQDGWVDAWSQLRPNESGWTYDTKSNQMLTGNRTLQKRLDRFICQFTDFKITSVDMIGMEAIPVSKASQENLAGETIVMMFSLSAVAVSACNFV

SEQ ID NO: 119182 - protein, 874 aa, Glycine max
  Coding DNA Sequence Number=SeqID_27497
  Gene Ontology: Mol. function=metal ion binding; Cellular component =nucleus; Biological process=histone H3-K9 demethylation
  Homolog annotation: Hit_ID=A7QUK3; Match level="QueryCoverage=79%, HitCoverage=96%, E-value=0.0, Identity=60%"; Hit description =Chromosome chr10 scaffold_179, whole genome shotgun sequence
  Pfam annotation: Domain name=C1_4; Domain location=152-200; Score= -9.1; E_value=0.033; Accession=PF07975.3; Description=TFIIH C1-like domain
  Pfam annotation: Domain name=JmjC; Domain location=712-822; Score =45.6; E_value=1.8e-10; Accession=PF02373.13; Description=JmjC domain
  Pfam module annotation: Pfam domain module=C1_4::JmjC; Domain location=152-200::712-822
MIEFSRYSKHSGTVQRKADKIPEYGHKKQELKGEETMRCLKKINAVRLEARVTQGEQINQLAKDKILKCSKDFGTTKTKKVEEIYKCDNTKSKSCKKGHETQKLTVSNKKRKFEDDLLNDDFEDEEMLILLKSRTRRRRMNNVMDVGQNPRKCHQCMKKERTFFVPCTKCPKMYCMRCVNKYYPDMSVEEIASSCPFCRKNCNCNACLCSKGMIKTANRDISDYEKAQYLQYMIKLLLPFFEQICHEQSQEEQIEAKLLGKSSFEIEIHQSLCGDGERVYCDHCATSIIDLHRSCPNCSYELCLSCCQEIRDGSITPRAELKFPYVNRGYDYMHGGDPLPVPCDLETSEGHIEPSTVWKAKSDGSISCAPKELGGCGSAVLELRCIFPDGWISDLETKACNMLKLWEIKHTTLQQKAASSSYTFLRKEAIKEGINDNNIYCPDSSSTKNEGLLLFQKHWANGEPIIVRDVLKQGTGLSWEPMVMWRALCENMVSEISSKMSEVKAIDCLANCEVEIDTHTFFKGYTEGRTYRDLWPEMLKLKDWPPSDKFEDLLPRHCDEFIRSLPFQEYSDPRTGILNLAVKLPAHVLKPDMGPKTYIAYGIKEELGRGDSVTKLHCDMSDAVNILTHTAEVILTDEQHFTISKLKEAHRAQNEREQCAQERVADHLEDRPYKDNKEHIENKEVLEAKSMKKQPIEIDGNIFPNNVLERYTSPATENESMETGSALWDIFQREDSEKLETYLRKHSKEFRHTYCSPVEQVVHPIHDQCFYLTWEHKKKLKEELGVEPWTFEQKLGEAVFIPAGCPHQVRNLKSCTKVAVDFVSPENIHECLRLTKEFRQLPKNHKAREDKLEDYMVTCFILDGTDKEDDSLCR

SEQ ID NO: 119183 - protein, 433 aa, Glycine max
  Coding DNA Sequence Number=SeqID_27498
  Gene Ontology: Mol. function=Rho GDP-dissociation inhibitor activity; Cellular component=cytoplasm; Biological process=negative regulation of cell adhesion
  Homolog annotation: Hit_ID=Q705X3; Match level="QueryCoverage=56%, HitCoverage=99%, E-value=7e-90, Identity=70%"; Hit description=Rho GDP dissociation inhibitor 2
  Pfam annotation: Domain name=Rho_GDI; Domain location=211-433; Score =37.3; E_value=1.9e-11; Accession=PF02115.8; Description=RHO protein GDP dissociation inhibitor
MEAKLNYNRMMQAEQARKALEGALSGKKNEFDKWNKEIKRKEELGGGGDTGGGGWFGWGKRFGWSNDDNFWQEAKQAILTILGLVLVYLLVAKGDVLLAVIFNPLLYALRGVRNGFGFISSKVLKNTSTSNQPDFGGLSQKKAYQHTSAMENVVRKWGGGSCKKLASIWVLAPLMSLAIGVVSNCKSNMGFDDNKGKEVPEMQHSGKTVHVHEDESGDERGTSLSRHMSEGSIAATEDEDEDVERRIDLGPQCTLKEQLEKDKDDESLRRWKEQLLGSVDMTSVGDHLDLKQESSQSLEPEVKILSLAIKAAGREDIVLPIPESGNPSGLWFTLKEGSRYSLMFTFQVSHNIVSGLKYTNTVWKTGLKVDSTKEMIGTFSPQAEPYTHEMPEETTPSGLLARGQYSARSKFVDDDNKLYLEINYTFDIRKEWH

SEQ ID NO: 119184 - protein, 198 aa, Glycine max
  Coding DNA Sequence Number=SeqID_27499
  Gene Ontology: Mol. function=metal ion binding
  Homolog annotation: Hit_ID=Q2HTH7; Match level="QueryCoverage=100%, HitCoverage=70%, E-value=2e-51, Identity=54%"; Hit description=Zinc finger, RING-type
  Pfam annotation: Domain name=zf-C3HC4; Domain location=150-187; Score= 35.5; E_value=1.9e-07; Accession=PF00097.16; Description=Zinc finger, C3HC4 type (RING finger)
MSQLGLILQESLRTEREARTILGLLTEQMDSVGRGQRRRRTLKERLRFTGIGCCGATWVFRPIVRDEGGGAQAQQQPQETNAGQDPNHTGPEHVGPSQSSSGMNLAAALAAERQFREGEGTPLRVSLMRLLEETEGGDAAVEAVGNDWVCCVCMGRKKGAAFIPCGHTFCRVCSRELWLNRGTCPLCNRSILEILDIF

SEQ ID NO: 119185 - protein, 286 aa, Glycine max
  Coding DNA Sequence Number=SeqID_27500
  Gene Ontology: Mol. function=sequence-specific DNA binding; Cellular component=nucleus; Biological process=regulation of transcription, DNA-dependent
  Homolog annotation: Hit_ID=A7J0W0; Match level="QueryCoverage=93%, HitCoverage=74%, E-value=1e-141, Identity=91%"; Hit description=KNT1
  Pfam annotation: Domain name=ELK; Domain location=168-189; Score =35.2; E_value=2.4e-07; Accession=PF03789.4; Description=ELK domain
  Pfam annotation: Domain name=Homeobox; Domain location=199-250; Score= 3.8; E_value=0.0046; Accession=PF00046.20; Description=Homeobox domain
  Pfam annotation: Domain name=KNOX1; Domain location=31-75; Score =89.8; E_value=8.9e-24; Accession=PF03790.4; Description=KNOX1 domain
  Pfam annotation: Domain name=KNOX2; Domain location=80-131; Score =109.8; E_value=8.5e-30; Accession=PF03791.4; Description=KNOX2 domain
  Pfam module annotation: Pfam domain module=ELK::Homeobox::KNOX1::KNOX2 ; Domain location=168-189::199-250::31-75::80-131
MEGISSRVMGFGENTSSSGIPNNNYGGSSSSAIKAKIMAHPHYHRLLAAYVNCQKVGAPPEVMGRLEEACASAAVTMAGGTASIGEDPELDQFMEAYCEMLIKYEQELSKPFKEAMLFLQRIECQFKSLTISSSLDTTACNEAIDRNGSSDDVDVQTNIIDPQAEDQELKGQLLRKYRGYLGSLKQEFTKKRKKGKLPKEARQQLLEWWSRHYKWPYPSESQKLALAESTGLDQKQINNWFINQRKRHWKPSEDMQFVVVDPSHPHYYMENVLGNPFPMNLSHTML

SEQ ID NO: 119186 - protein, 246 aa, Glycine max
  Coding DNA Sequence Number=SeqID_27501
  Homolog annotation: Hit_ID=A7R101; Match level="QueryCoverage=82%, HitCoverage=100%, E-value=1e-36, Identity=44%"; Hit description =Chromosome undetermined scaffold_332, whole genome shotgun sequence
  Subcellular localization annotation: CTP_CleavageSite=82; ConfidenceScore=5.17e-01
MQESYTDRSSTIITGQGENPNEKNQNNNKSSSTLSFLLFVFSLTMKKLYRKGTVHPSPSPSPPTISDHLSFLPAAILTLTLSLSPKDQEVLAYLISCSSSSSSTTNFSGNHRRNPKVVVDGDHPPVFNCSCFRCYMSYWVRWNSSPNHQLIHEIIDTFEDSLAHTTKPSRKDKRNKRGSKTKPSELTRSEFPSSPPESVPESSSSSAGAGEVEAGQGGDGGGDEEKGSVRRFVSFIGERIWGAWAQ

SEQ ID NO: 119187 - protein, 336 aa, Glycine max
  Coding DNA Sequence Number=SeqID_27502
  Gene Ontology: Mol. function=nucleic acid binding; Cellular component= nucleus; Biological process=transcription from RNA polymerase I promoter
  Homolog annotation: Hit_ID=A9PEA5; Match level="QueryCoverage=99%, HitCoverage=100%, E-value=1e-111, Identity=58%"; Hit description =Putative uncharacterized protein
  Pfam annotation: Domain name=DEK_C; Domain location=3-57; Score=60.2; E_value=6.9e-15; Accession=PF08766.2; Description=DEK C terminal domain
  Pfam annotation: Domain name=SWIB; Domain location=143-218; Score =139.7; E_value=8.1e-39; Accession=PF02201.9; Description=SWIBMDM2 domain
  Pfam annotation: Domain name=SWIB; Domain location=252-329; Score =90.7; E_value=4.6e-24; Accession=PF02201.9; Description=SWIBMDM2 domain
  Pfam module annotation: Pfam domain module=DEK_C::SWIB::SWIB; Domain location=3-57::143-218::252-329
MVTDQDIAKGVESLLRHSDPNSITTVNGVVQQLEAKLGLDLSHKASFIRDQIDHLLRSQPQTFAPHPPPLHKDYFAPHTQLHFPTTHFAPHFALHDEINFLQHPHPPPPRKVETFPPQNVAPPQVPKESVQTGSKRRGGAGGLNKVCGVSPELQAVVGEPAMPRTEIVRQLWAYIKKNNLQDPGNKRKIICDDALRLVFETDCTDMFKMNQLLAKHIIPLGPTTFNFVAPEESQAKRVKVDTEIKTESAEPAPSTVAISEALAKFLGTEGREMQQSEAIRLVWEYIKLHHLEDPLNSMVILCDAKLQELLGCESISALGIPEMLARHHLFKQSDTR

SEQ ID NO: 119188 - protein, 106 aa, Glycine max
  Coding DNA Sequence Number=SeqID_27503
MVELYGLAHMPYFECYTNHVNTKHDPHLNNMLKIHQCNAFFADVDHLRKQGITRLQVKGLVEASHFAKHVECVAHYVVFCKGLEEHAKYGLREEFGTSENMEEKAK

SEQ ID NO: 119189 - protein, 343 aa, Glycine max
  Coding DNA Sequence Number=SeqID_27504
  Gene Ontology: Mol. function=lipid transporter activity; Cellular component=small nuclear ribonucleoprotein complex; Biological process=nucleolus organization and biogenesis
  Homolog annotation: Hit_ID=Q2QM87; Match level="QueryCoverage=62%, HitCoverage=49%, E-value=1e-28, Identity=38%"; Hit description=SRP40, C-terminal domain containing protein, expressed
  Pfam annotation: Domain name=SRP40_C; Domain location=167-264; Score =134.0; E_value=4.2e-37; Accession=PF05022.3; Description=SRP40, C -terminal domain
MARYDGVNSKNKEEGKSKEKKKKKSKLVSESLATNVEDDQLESVATAKENKEKDDVSTDAKVINGSETEKKSKSKMKKKDNRSDEGDAIEQIGDPNETVSKEENIEANKEITHEEKKDSKKRKRSISEENGQQVADIKADEETKRRKIENLNESKEQTNGNLEKAGEKSSVQSSQKKQQKGSVEKKPVNAAFQRVQVDKIQFADERLQDNSYWAKDGAENGYGAKAAEILDQVRGRGFRHEKTKKKRGSYRGGQIDLQSHSTQSESCCGYEICDGGECYIQKTLLGSGKQVDFHLLTNVTEATLQNYEGTGSKLAVKRQKYGFYNCVSYMVELLASIAFTETK

SEQ ID NO: 119190 - protein, 124 aa, Glycine max
  Coding DNA Sequence Number=SeqID_27505
MGVCVGIVDKTGKWKMREKWEFELNETRRRKARGMKEEQGKSAQLRIPTSVMYGTIQQHIESSSHPMCLLTNQKSLSIPSLPPQLCSFQYAFDTSVHGLQSNLKRNSNSFRMDWIGIASRRNYH

SEQ ID NO: 119191 - protein, 71 aa, Glycine max
  Coding DNA Sequence Number=SeqID_27506
MKSGTSTGIQKEKGEGDWFDSGPNHTDIGVVVPCPCVTQDKTEQNNAKGRLGAMHILMAFPLCPNLKHYLT

SEQ ID NO: 119192 - protein, 279 aa, Glycine max
  Coding DNA Sequence Number=SeqID_27507
  Gene Ontology: Mol. function=sequence-specific DNA binding; Cellular component=intracellular; Biological process=regulation of transcription, DNA-dependent
  Homolog annotation: Hit_ID=Q8LJQ5; Match level="QueryCoverage=72%, HitCoverage=87%, E-value=5e-74, Identity=75%"; Hit description=LEC1 -like protein
  Pfam annotation: Domain name=CBFD_NFYB_HMF; Domain location=107-172; Score=125.9; E_value=1.2e-34; Accession=PF00808.14; Description =Histone-like transcription factor (CBFNF-Y) and archaeal histone
  Pfam annotation: Domain name=Histone; Domain location=101-175; Score =2.4; E_value=0.08; Accession=PF00125.15; Description=Core histone H2AH2BH3H4
  Pfam module annotation: Pfam domain module=CBFD_NFYB_HMF::Histone; Domain location=107-172::101-175
METGGFHGYRKLPNTTADDFIFLIRFPIIRPNLSVRCEVSLPPYLGGFSKAHKYYSYQESKQGKLKVSSLRLKLSVSDMNMRQQVASSDHSAATGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLGVATAFVPPPYHHHNGYFGAAMPMGTYVREAPPNTASSHHHHHHHHHHARGISNAHEPNARSI

SEQ ID NO: 119193 - protein, 137 aa, Glycine max
  Coding DNA Sequence Number=SeqID_27508
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=45%, HitCoverage=49%, E-value=1e-25, Identity=91%"; Hit description =Putative uncharacterized protein
MSEKDEESNRKIELHCKPGGSTSSRAAATAVELQFKPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 119194 - protein, 1645 aa, Glycine max
  Coding DNA Sequence Number=SeqID_27509
  Gene Ontology: Mol. function=binding; Cellular component =mitochondrion; Biological process=metabolic process
  Homolog annotation: Hit_ID=A2Q1R4; Match level="QueryCoverage=60%, HitCoverage=63%, E-value=0.0, Identity=47%"; Hit description=HEAT
  Pfam annotation: Domain name=ACP_syn_III_C; Domain location=1553 -1644; Score=-30.6; E_value=0.022; Accession=PF08541.1; Description=3- Oxoacyl-[acyl-carrier-protein (ACP)
  Pfam annotation: Domain name=C2; Domain location=1069-1143; Score =41.4; E_value=3.2e-09; Accession=PF00168.21; Description=C2 domain
  Pfam annotation: Domain name=Thiolase_C; Domain location=1522-1644; Score=215.4; E_value=1.4e-61; Accession=PF02803.9; Description =Thiolase, C-terminal domain
  Pfam annotation: Domain name=Thiolase_N; Domain location=1212-1469; Score=370.6; E_value=2.6e-108; Accession=PF00108.14; Description =Thiolase, N-terminal domain
  Pfam module annotation: Pfam domain module=ACP_syn_III_C::C2::Thiolase _C::Thiolase_N; Domain location=1553-1644::1069-1143::1522-1644::1212- 1469
MANWNCELRVIVSVKCKSFHMLKLLGECLAIVKALQAQCAQSSNLALQWVARFSPLLLRGSEEELVNLLKDDNDTIQEGVLNVLAKAGGTIREQLAVTSSSVDLILERLCLEGSRRQAKYAVHALAAITKDDGLKMSLGVMVMLLPCDLEVSGSNPGDSLYAFSDKAAYKLVDMLEDKTHLPAVLQSLGCIAQTAMPVYETRENEIVEFILNKILKSDSKEDNMKTSWDDKSDLCMLKIYGIKAFVKSYLPVKDAHIRPNIDSLLDILRNILLYGEISKDLKSSSVDMAHLKLASAKAVLRLSRLWDHKIPVDLFHLTLRVSEISFPQAKKIFLSKIHQYIKDRLLDAKYGCAFLFNIFGSKPDEFAEDKQNLFDIIQMYHQLKARQLSVQSDANSLITYPEYILPYLVHALAHNSCPNVDDCEDVGAYDDIYRQLHLILSMLLQREEDAKSEVTTDKEKELISTITSIFLSIKHSEDMVDTSKSKNSHALCELGLAITKRLVQKDVDLQGLSHLVSLPPLLYKASEKEGDDTLVTEVKSWLADESSLTHFESLELEMVQSQSAEDEASKEDEKDGNEIPLRKMLKNIKSQGTSGKKVKRNKSVPAETKKAENDFDILNMVREINVDNLETPTNFEPSNGHDHSLSKKELKDPESATGKKRKARETTPAPVPKRRRSSSAHGKLRLSTSISKASRRVSGEDSPQPKLLLDEEVNPDADSKTMQRKMVKGSEKDLSLSSLKRKVKGSDSYHNDELNKHDELDMMSPDSTQLSDKTVGNNNKSSTGSAKKGKRKSISGLAKCMTKEGEIDTEDLIGCRIKVWWPTDKKFYGGTIKSYDPLKGKHVILYDDGDVEILRLEKERWELIDKGRKSIKVSGGSDEEFNGGFNEITTKEKKSNKNTKSVSRGKRLKKEKNFHYRKETNEEKQDYSERLSEDRESVPQGSSEEKEVDESSGALRQNINGEEESDSEGHHDNSDAGSNPREMEKSHLEPSKSPHDDDNKTIPEISDDVPLVNNSAVASLIVNGSVGRGRKAQGKNNEQFSYCYLSVKNAAELMLWYKYSIMDEQLRILKVIVVQGKKLVIRDSRAVTLMLLSSWGIRVIHCCLNPVWNEELNFTVTEPLGVLNLEVFDKDFLKADDKMGNSYLNLQPLNSAARLRDILKVSSGETTLRKVTPDSENCLARESSINCVNDIKRPSFLISDARSPSMSTCVKSRDVCIVGVARTPIGGLLGTLSSLSATELGSIAIKTALKRANVDPSLVQEVFFGNVLSANLGQAPARQAALGAGIPTSVICTTINKVCASGMKATMLAALTIQFGLNDVVVAGGMESMSNAPKYIAEARKGSRYGHDTIIDGMVKDGLWDVYNNFGMGVCAELCADQHVITRDEQDSYAIRSFERGISAQNAGHFAWEIVPVEVSTGRGRASKIVDKDEGLGKFDAAKLRKLRPSFKEVGGSVTAGNASSIRVVSSRCKKFANKLILMPCNSYGSKLHALLLIMDWFIGLTSDGAAALVLVSEEKARELGLHVIAKIKGYGDAAKAPELFTTAPSLAIPKAISNAGLDASQIDYYEINEAFSVVALANQKLLGLDPEKVNAHGGAVSLGHPLGCSGARILVTLLGVLRQKRGKYGVAAICNGGGGASALVLELM

SEQ ID NO: 119195 - protein, 188 aa, Glycine max
  Coding DNA Sequence Number=SeqID_27510
  Gene Ontology: Mol. function=structural constituent of ribosome; Cellular component=ribonucleoprotein complex; Biological process =translation
  Homolog annotation: Hit_ID=Q08112; Match level="QueryCoverage=70%, HitCoverage=87%, E-value=7e-67, Identity=93%"; Hit description=40S ribosomal protein S15-1
  Pfam annotation: Domain name=Ribosomal_S19; Domain location=96-177; Score=169.7; E_value=7.9e-48; Accession=PF00203.12; Description =Ribosomal protein S19
MGFWGSKGYGSPINVELGAHQSAFYLFILLFEAKTLAAGENDVEVDAAAAAGAAQPKKRTFKKFSFRGVDLDALLDMSTDELVKMFSARARRRFQRGLTRKPMALIKKLRKAKREAPAGEKPEPVRTHLRNMIIVPEMIGSIIGVYNGKTFNQVEIKPEMIGHYLAEFSISYKPVKHGRPGIGATHSS

SEQ ID NO: 119196 - protein, 674 aa, Glycine max
  Coding DNA Sequence Number=SeqID_27511
  Gene Ontology: Mol. function=transferase activity, transferring hexosyl groups; Cellular component=Golgi apparatus; Biological process=carbohydrate biosynthetic process
  Homolog annotation: Hit_ID=A2Q5F4; Match level="QueryCoverage=100%, HitCoverage=100%, E-value=0.0, Identity=77%"; Hit description =Glycosyl transferase, family 8
  Pfam annotation: Domain name=Glyco_transf_8; Domain location=336-648; Score=391.5; E_value=1.3e-114; Accession=PF01501.11; Description =Glycosyl transferase family 8
MVVTRNIVLLLLSITFVAPIVLFTDRLGTFKYPFAEQEFIEAVTAFVSAADSGHLNLLPQESSTVFKEPIGLVYTEDTSNTENLLHGLHFAKPGEHVSARVLSATNDEGQTKGENPIKLVTDGINQGNQNSYMVKADTTGDSVNGEDAIDVDDNDGKLAKSSDLVSETTVSVSLMNTSWTRLDTKQEQEHIKSSSQVTQKEPILSEADKHNDQTPPDARVQQLKDQLIQARVYLSLQAVRSNPHLTRELRLRVKEVSRTLGDASKDSDLPRNANERMKAMEQTLMKGRQIQNDCAAAVKKLRAMLHSTEEQLHVHKKQTLFLTQLTAKTLPKGLHCLPLRLTTEYYSLNTSQQQFRNQQKLEDPRLYHYAIFSDNILATAVVVNSTVAHAKDTSKHVFHIVTDRLNYAAMRMWFLVNPPQKATIQVQNIEDFTWLNSSYSPVLKQLGSPSMIDFYFKTHRASSDSNLKFRNPKYLSILNHLRFYLPEIFPKLNKVLFLDDDIVVQKDLTGLWSIDLKGNVNGAVETCGERFHRFDRYLNFSNPLIAKNFDPRACGWAYGMNVFDLVQWKRQNITDVYHKWQKMNHDRQLWKLGTLPPGLITFWKRTFQLHRSWHVLGLGYNPNINQKEIERAAVIHYNGNMKPWLEISIPKFRGYWTKYVDYNLVYLRECNINP

SEQ ID NO: 119197 - protein, 207 aa, Glycine max
  Coding DNA Sequence Number=SeqID_27512
MWGKLRGSNSMSDEIPHPNCDIEVYGCSSPLTFFLNEAAKNGGKANNFTGMEKWRSCGGTRGLAAISVLQKGAAVNEIQRGVVALSQRGIERRRVREKTIKEACNNDDKHIQFLERKDTSLKSRWNQIHPTIQKFISCYKQALNQKISGSLEKDIMDFASKIYKQDIDAYSSSSNPKTPIKVDEYHTTTLISRPIGQKATKRKSKEK

SEQ ID NO: 119198 - protein, 184 aa, Glycine max
  Coding DNA Sequence Number=SeqID_27513
  Gene Ontology: Mol. function=transferase activity; Cellular component= cytoplasm; Biological process=aromatic amino acid family metabolic process
  Homolog annotation: Hit_ID=Q84VH0; Match level="QueryCoverage=76%, HitCoverage=64%, E-value=7e-45, Identity=64%"; Hit description =Glutathione S-transferase Z1
  Pfam annotation: Domain name=GST_N; Domain location=31-106; Score =54.7; E_value=3.1e-13; Accession=PF02798.11; Description=Glutathione S-transferase, N-terminal domain
MYLYNDIIEESEVKERVGGSATDTEIEMEEKKLKLYSYWISSCSFRVRFALNLKGLPYDYLAVTSFSDPEFLKLNPIGFVPVLVDGDSVIVDSLAIIMSHIQYLEDKYPDPPLLPRDIHQRAINFQAATIVSSSIQPFQNYTVVKYIEEKVGTDEKLPWTQSVIGKGFMGEFKLKYQCFISSPS

SEQ ID NO: 119199 - protein, 135 aa, Glycine max
  Coding DNA Sequence Number=SeqID_27514
  Homolog annotation: Hit_ID=A7QCF3; Match level="QueryCoverage=73%, HitCoverage=32%, E-value=7e-38, Identity=80%"; Hit description =Chromosome undetermined scaffold_77, whole genome shotgun sequence
  Pfam annotation: Domain name=DUF901; Domain location=1-129; Score= -13.8; E_value=3.3e-07; Accession=PF05991.2; Description=Protein of unknown function (DUF901)
MVLVAKSKKQTQDSESTPPIITSNVKQNLRFLKLWKVAALKEDGCPKVWVVTSDHCHQQAAHGAIYTAADFQGAFIWSCKALVTEIKASQKEVERMLQEQRSTSFQGRLLKHNLDAEVVDALKDLRLKLSENELK

SEQ ID NO: 119200 - protein, 615 aa, Glycine max
  Coding DNA Sequence Number=SeqID_27515
  Gene Ontology: Mol. function=transporter activity; Cellular component= integral to membrane; Biological process=auxin mediated signaling pathway
  Homolog annotation: Hit_ID=Q84YG8; Match level="QueryCoverage=100%, HitCoverage=96%, E-value=0.0, Identity=84%"; Hit description=Auxin efflux carrier protein
  Pfam annotation: Domain name=Mem_trans; Domain location=9-615; Score =630.1; E_value=1.9e-186; Accession=PF03547.9; Description=Membrane transport protein
MITGKDIYDVFAAIVPLYVAMILAYGSVRWWKIFTPDQCSGINRFVAVFAVPLLSFHFISSNDPYAMNYHFIAADCLQKVVILGALFLWNTFTKHGSLDWTITLFSLSTLPNTLVMGIPLLKAMYGDFSGSLMVQIVVLQSVIWYTLMLFMFEYRGAKLLITEQFPETAGSITSFRVDSDVVSLNGREPLQTDAEIGEDGKLHVVVKRSAASSMISSFNKSHLTSMTPRASNLTGVEIYSVQSSREPTPRGSSFNQTDFYAMFASKAPSPKHGYTNSFQSNNGGIGDVYSLQSSKGATPRTSNFEEEMLKMHKKRGGRSMSGELFNGGLVSSNYPPPNPMFSGSTSAAGGPKKKDSSGGGGAVAPNKELHMFVWSSSASPVSEGNLRHAVNRAASTDFGTVDPSKAVPHETVASKAVHELIENMSPGRRGSGEREPEMDEGAKIPASGSPYTCQKKVDMEDGNANKNQQMPPASVMTRLILIMVWRKLIRNPNTYSSLLGLTWSLISFRWHIEMPTIVKGSISILSDAGLGMAMFSLGLFMALQPKIIACGKSVAAFSMAVRFLTGPAVIAATSIGIGLRGVLLHVAIVQAALPQGIVPFVFAKEYNLHADILST

SEQ ID NO: 119201 - protein, 322 aa, Glycine max
  Coding DNA Sequence Number=SeqID_27516
  Gene Ontology: Mol. function=sequence-specific DNA binding; Cellular component=nucleus; Biological process=regulation of transcription, DNA-dependent
  Homolog annotation: Hit_ID=A9PGX1; Match level="QueryCoverage=100%, HitCoverage=99%, E-value=1e-31, Identity=35%"; Hit description =Putative uncharacterized protein
  Pfam annotation: Domain name=GATA; Domain location=184-219; Score =74.0; E_value=4.9e-19; Accession=PF00320.18; Description=GATA zinc finger
MIPAYRHSVSSVMPLDLNEDQNHEFFSPTHHPSSSFSSLSSYPILFNPPNQDQEARSYYWEPTKQYLPSHEEETEKIIPSSGSWDHSVAESEHNKATVWKKAEERNENLESVAAEDGSLKWMPAKMRIMRKMLVSDQTDTYTNSDNNTTHKFDDQKQQLSSPLGTDNSSSNNYSNHSNNTVRVCSDCHTTKTPLWRSGPRGPKSLCNACGIRQRKARRAMAAAAASASGNGTVIVEAKKSVKGRNKLQKKKEKKTRTEGAAQMKKKRKLGVGSAKASQSRNKFGFEDLTLRLRKNLAMHQVFPQDEKEAAILLMALSYGLVH

SEQ ID NO: 119202 - protein, 96 aa, Glycine max
  Coding DNA Sequence Number=SeqID_27517
  Homolog annotation: Hit_ID=A2Q1D9; Match level="QueryCoverage=88%, HitCoverage=57%, E-value=1e-20, Identity=57%"; Hit description =Catalytic , putative
MTSTFVGGIDYRVTEESLKDRLNIIMLEECLNIDNECRVFTVHGGADTIIPVVAAHEFAKVLPNQKLQIIEGADHQAELASLVVYVIKETLQISLL

SEQ ID NO: 119203 - protein, 202 aa, Glycine max
  Coding DNA Sequence Number=SeqID_27518
  Gene Ontology: Mol. function=protein binding
  Homolog annotation: Hit_ID=A7PE48; Match level="QueryCoverage=96%, HitCoverage=40%, E-value=1e-48, Identity=52%"; Hit description =Chromosome chr11 scaffold_13, whole genome shotgun sequence
MWIITGSEDGTTRIWELLGTYVSVAYLPHLLDCKSGKCTQVIDPARDLKLKGSASWVGCVALDASESWLACSSGRNISLWNLPASECISKIPTRACVQDMLFDNNQILTVGTDPLLNRFDMNGTILSQIQCAPSSSFSISLHPAGVSSNMLMDSLLLCALFDILGALPHYSFQVMAVGGYGCLVDVISQFGSHMCTFHCQCF

SEQ ID NO: 119204 - protein, 459 aa, Glycine max
  Coding DNA Sequence Number=SeqID_27519
  Gene Ontology: Mol. function=protein serine/threonine kinase activity; Cellular component=ubiquitin ligase complex; Biological process=protein amino acid phosphorylation
  Homolog annotation: Hit_ID=A7PE40; Match level="QueryCoverage=96%, HitCoverage=93%, E-value=3e-89, Identity=42%"; Hit description =Chromosome chr11 scaffold_13, whole genome shotgun sequence
  Pfam annotation: Domain name=Sec8_exocyst; Domain location=220-361; Score=-41.4; E_value=0.079; Accession=PF04048.5; Description=Sec8 exocyst complex component specific domain
  Pfam annotation: Domain name=Usp; Domain location=5-158; Score=52.4; E_value=1.5e-12; Accession=PF00582.17; Description=Universal stress protein family
  Pfam module annotation: Pfam domain module=Sec8_exocyst::Usp; Domain location=220-361::5-158
MSTPSRRSVAVAVSGGSKGSRRAVQWAADNLVPQADRFILVHVIPRITSIATPTGEYIPISEADADVFAASVLDAKLKSEQIFVPFKKLCDSNTMETVLLEDDNAAEALLSFISESGSQILVLGSDSSNFITRKLKGPGIPTTILRCAPDSCDVYIVARDRIISKLADFSSSRSHETSPRYFLSTKVNKEDNGIGREMSGISSSSNEPKILRNFRFLSISERSYIGLQSSSRRNSFENSTKNEEQNSENCGDDIETISLHSFDSIASAQREQLVMQEEVERLQLELQNTITMYKQVCEELVQAQNQALLLSSESLEETKIVNASLKREEILRKFAAEEKTKYLKVMKELEEAKNKFSKESYERQMAELDVLRESIERQRIVDTLLSNDRRYRKYTMDEIKLATNFFAEDLIIGEGGYGKVYKCNLDHTPVAVKVLHQDAINKKEEFLKEVLLVLEFSSL

SEQ ID NO: 119205 - protein, 195 aa, Glycine max
  Coding DNA Sequence Number=SeqID_27520
  Gene Ontology: Mol. function=aspartic-type endopeptidase activity; Cellular component=small subunit processome; Biological process=DNA integration
  Homolog annotation: Hit_ID=A5CB76; Match level="QueryCoverage=81%, HitCoverage=57%, E-value=9e-31, Identity=41%"; Hit description =Putative uncharacterized protein
ELWFLGQGYHDHLEKGANAVPNDKRLEWEKLDFQLCVVLWQSVEPDVLEILRSFKTCCSLWKKDQEIFANDIQSLFDATMKVTTLKQTSHDMIAHIVEKLKRFLVADSLEEVNKKLDKFYMVLILRSLHSDFDHVHDQVLAGDQVPSMDSLITRLLRVPHVLKDENLADVVETSAMVAPRGRGRGRNNRGGRSGR

SEQ ID NO: 119206 - protein, 515 aa, Glycine max
  Coding DNA Sequence Number=SeqID_27521
  Gene Ontology: Mol. function=pyridoxal phosphate binding; Cellular component=chloroplast; Biological process=threonine biosynthetic process
  Homolog annotation: Hit_ID=Q2Q021; Match level="QueryCoverage=100%, HitCoverage=100%, E-value=0.0, Identity=97%"; Hit description =Threonine synthase
  Pfam annotation: Domain name=PALP; Domain location=151-460; Score =241.6; E_value=1.7e-69; Accession=PF00291.16; Description=Pyridoxal -phosphate dependent enzyme
  Subcellular localization annotation: CTP_CleavageSite=26; ConfidenceScore=5.64e-01
MLSSLLNPSFTTTLPIHSILIPNNRRASTVVSCTSSHLTTNNHSHVSSPPNIKDEARRRPAAENDFTAKYVPFNAGFDSPETYSLDEIVYRSRSGGLLDVQHDMEALGRFDGAYWRALFDSRVGKTTWPYGSGVWSKKEWVLPEIDPDDIVSAFEGNSNLFWAERFGKQFVGMNDLWVKHCGISHTGSFKDLGMTVLVSQVNRLRKMNRPVVGVGCASTGDTSAALSAYCASAGIPSIVFLPANKISTAQLIQPVSNGSLVLSINTDFDGCMKLIREITAELPIYLANSLNSLRLEGQKTAAIEILQQFNWEVPDWVIVPGGNLGNIYAFYKGFKMCKELGLVERIPRLVCAQAANANPLYLHYKNGFKDFNAVKAETTFASAIQIGDPVSIDRAVHALRNTEGIVEEATEEELMDAMVQADSTGMFICPHTGVALAALIKLRNRGVIGAGERVVVVSTAHGLKFAQSKIDYHSGLIPGMGRYANPLVSVKADFGSVMDVLKDFLHNKSPDFNKS

SEQ ID NO: 119207 - protein, 377 aa, Glycine max
  Coding DNA Sequence Number=SeqID_27522
  Gene Ontology: Mol. function=protein binding
  Homolog annotation: Hit_ID=Q6AWY8; Match level="QueryCoverage=99%, HitCoverage=98%, E-value=3e-53, Identity=36%"; Hit description =Growth-regulating factor 1
  Pfam annotation: Domain name=QLQ; Domain location=12-48; Score=66.6; E_value=8.4e-17; Accession=PF08880.2; Description=QLQ
  Pfam annotation: Domain name=WRC; Domain location=76-121; Score=97.9; E_value=3.2e-26; Accession=PF08879.1; Description=WRC
  Pfam module annotation: Pfam domain module=QLQ::WRC; Domain location =12-48::76-121
MMNGRNVDTNRFPFTPSQWQELEHQALIYKYMASGISIPPDLLFTIKRTTHLDSSRLLPQHFGWNYLPMGLGRKIDPEPGRCRRTDGKKWRCSKEAYPDSKYCERHMHRGKNRSRKPVEVLKTTPMTAATNTDASTPTTILSITKNSPVLFPTTHSLSHDTYHHHHHHHSHPQQHSSHSFLYHSSRPSSGGVSLSFQDNSAPLFLDTASCSQNNNNTDCRYVYGLKEEVDEHAFFTEPSGTMRSFSASSMEDSWQLTPLTISSSSSSKQRSCSGLSNDSNEYSYLQLQSLSGNNSKHPQQDQGCYISGSDIKCETFMKLGKEEPQKTVHRFFDEWPPKSRGSWLDLDDKSSTTQLSISIPTSTHDFATFSSTTQRDG

SEQ ID NO: 119208 - protein, 208 aa, Glycine max
  Coding DNA Sequence Number=SeqID_27523
  Gene Ontology: Mol. function=transcription factor activity; Cellular component=nucleus; Biological process=regulation of transcription, DNA-dependent
  Homolog annotation: Hit_ID=A5AJT3; Match level="QueryCoverage=67%, HitCoverage=77%, E-value=2e-38, Identity=59%"; Hit description =Putative uncharacterized protein
  Pfam annotation: Domain name=CBFB_NFYA; Domain location=68-124; Score= 131.7; E_value=2.1e-36; Accession=PF02045.6; Description=CCAAT -binding transcription factor (CBF-BNF-YA) subunit B
MIRRMGCFSYLLDIVIPFQAHTSYPCGDPYFGSSIVAYGPQAINQQMVPQMLGLASTRIALPVDLAEDGPIYVNAKQYHGILRRRQSRAKLEAQNKLIKSRKPYLHESRHRHALNRVRGSGGRFLSAKQLPQSNAELVTDAYQKKDASEAENHPSSTGENASITFTAISALTSMSSNSVNFPNMAGSSQCSGGLTFGAGALQCTSVGR

SEQ ID NO: 119209 - protein, 450 aa, Glycine max
  Coding DNA Sequence Number=SeqID_27524
  Gene Ontology: Mol. function=nucleotide binding; Cellular component =Golgi apparatus; Biological process=regulation of transcription, DNA- dependent
  Homolog annotation: Hit_ID=A7PDX8; Match level="QueryCoverage=88%, HitCoverage=98%, E-value=1e-140, Identity=63%"; Hit description =Chromosome chr11 scaffold_13, whole genome shotgun sequence
  Pfam annotation: Domain name=DUF246; Domain location=237-449; Score =43.5; E_value=3.7e-17; Accession=PF03138.5; Description=Plant protein family
  Subcellular localization annotation: CTP_CleavageSite=74; ConfidenceScore=5.74e-01
MAIFSESNHHHNTSDGVSQRVNSPRFSGPMTRRAHSFKRNNSSNNSNNTATTTSHGGGGGSGGVEIELQINSPRSEEASEGVPVGKHSHHHVTQRVHVRGLLKKPLASIVEDLGLRERKKIGHWMFLVFCGVCLFMGVLKICATGWLGSAIEITQSNKELSDSIPSLTLMDKSSLGYAYRGGASDVERTLKTVATGVDGSHTAMTEDSGIWSKPNSDNFTKCIDLPKLDAKTNGYIFVNANGGLNQMRFGVRLCSFLMICDMVAVAKIVKATLVLPSLDHTSYWADDSGFKDLFDWKHFINMLKDDVHIVEKLPPAYAGIEPFPKTPISWSKVHYYKTEVLPLLKQHKVMYFTHTDSRLDNNDIPRSIQKLRCRVNYRALKYSAPIEELGNTLMEKKGLGEGDMIQLEDMGFESHIGSAIFCCGIYKFLGALAAKLQTSMNGDIDIAMFA

SEQ ID NO: 119210 - protein, 241 aa, Glycine max
  Coding DNA Sequence Number=SeqID_27525
  Gene Ontology: Mol. function=N-acetyltransferase activity; Biological process=metabolic process
  Homolog annotation: Hit_ID=A7PDX5; Match level="QueryCoverage=84%, HitCoverage=81%, E-value=2e-45, Identity=48%"; Hit description =Chromosome chr11 scaffold_13, whole genome shotgun sequence
  Subcellular localization annotation: CTP_CleavageSite=25; ConfidenceScore=5.44e-01
MPSISSTIQAPQFHSSFFRPYPKCLAMTIDTDFLNTKKKQVSFQLSSLITPPVSTVRFCDLNFGRLQPSDEELGPHKRFEFGNFVAREALLEEEYWSAACLRAEEWANRTDKLYGTRNFAEQVGVDANSFVEFNAIKKRCKELQDGHSSTCIITVRKPQKNVKLPIIESVVGTLDLNIIYLRRGETFPGIDRTASSRYGYIANLCVAKSLYRKGVASKMLYFAVESAKSTGNVRVTFTTNV

SEQ ID NO: 119211 - protein, 390 aa, Glycine max
  Coding DNA Sequence Number=SeqID_27526
  Gene Ontology: Mol. function=hydrolase activity, acting on glycosyl bonds; Biological process=cell wall organization and biogenesis
  Homolog annotation: Hit_ID=A7PDT4; Match level="QueryCoverage=36%, HitCoverage=29%, E-value=4e-56, Identity=72%"; Hit description =Chromosome chr11 scaffold_13, whole genome shotgun sequence
MVETSTLGHFHHQRLDLRRWVPAFFTSHKTLLTLLWIAAFASVFLWQRNIVGGFLVYGGIPGRPMPMLRPMAFNLTDFGGVGDGVTLNTEAFERAVSAVSKFGKKGGAQLNVPPGRWLTAPFNLTSHMTLFLAEDAVILGIDTPSLSYAGKGYQRPTATIVAARLGEGRQKNWRDAPDVYSFYFTRFPEDVGEKELWFKGVDDVWKLEKQLGNLIIGGLKMHANLPKHGRVGKPIEKFHKEDQYKQGLQGDMQVDRVNERVRAITAQTPAKGGKQQNCTQQQTLSVSYATPVTMGSKTIEKRWSPTAIQAMKKPSQSSIRLTISMEERKWFSSAWVGRLRNLLMFDRLEEEFLWDGGEDIWPKYLGDDMVLLLGLSDEKAEKRWDYEYNH

SEQ ID NO: 119212 - protein, 229 aa, Glycine max
  Coding DNA Sequence Number=SeqID_27527
  Gene Ontology: Mol. function=protein binding
  Homolog annotation: Hit_ID=A5AJ46; Match level="QueryCoverage=88%, HitCoverage=99%, E-value=2e-72, Identity=69%"; Hit description =Putative uncharacterized protein
  Pfam annotation: Domain name=DUF567; Domain location=34-218; Score =132.1; E_value=1.6e-36; Accession=PF04525.3; Description=Protein of unknown function (DUF567)
MTSRRQRREVVVVDEGDEVDREKDHMIAKTNTIMPIIGKLYCSSSETVLVVRRRPHVVNGGGFVVMDCSAQRVVFRVDGCGVRGKKGDLILREGDGDALLLMRRMGGMVEALSIYKKWKCYSLDYEGSRKLVFSLREPNSCLVKNNAIRIFTRNRGRDFKISGCFPDKCCSIVDSKGNEVAQVGMMKEVEELIESKDLYHVVVNPGMDQAFVFGVIAVLDYIYGESTHR

SEQ ID NO: 119213 - protein, 771 aa, Glycine max
  Coding DNA Sequence Number=SeqID_27528
  Gene Ontology: Mol. function=serine-type endopeptidase inhibitor activity; Cellular component=cell surface; Biological process =hyaluronan metabolic process
  Homolog annotation: Hit_ID=A7PDU4; Match level="QueryCoverage=100%, HitCoverage=99%, E-value=0.0, Identity=55%"; Hit description =Chromosome chr11 scaffold_13, whole genome shotgun sequence
  Pfam annotation: Domain name=VWA; Domain location=326-487; Score =62.1; E_value=1.8e-15; Accession=PF00092.19; Description=von Willebrand factor type A domain
  Subcellular localization annotation: CTP_CleavageSite=46; ConfidenceScore=5.06e-01
MAQDFSKAVDDGLKLSKRIYFGKDRAVAPPKPPPPMTRSATAFLPSAPMVYAVISDPGIVDNPDIPSYQPHVYGRCDPPALIPLQMNAIQMEADCYHETAFITVSGTWRLHCVMGSRSCDCRIAVPVSHQGSILGVEVSVSRKSYSTQLVVMEDDNGNQNASPPQNGGFLIPDIFTLTIPQIDGGSNLSIKVRWSQKIVFSKGQFSLNVPFTFPDFVNPAGKKISKREKIQINVDAVTGGELLCKTLSHPLKEVRRHVGSMGFLYDSDVLSWSKVDFSFSYAVSSSHITGGVLLESASVHDFDQREMFYMYLSTGDIQSDKVFKKDIIFIIDISGSMRGKLIEDTKNALLTALSKLNQADSFNIIAFNGETYLFSKTMELASGDAVERATEWINTNFVAGGGTNISHPLNTAIEMLSNIQSSVPIIFLVTDGTVEDERQICAMVKNRMINGESICPRIYTFGIGSFCNHYFLRMLAMIGRGQYDAALDVGEVIIQKKSVARLKHMLNELEPLHRQLVGTKNEMDLIEPRMLTLFGKASSLILANIKMDTLDDLDDLEVYPPHIPDLSSEGPLILSGRYRGNFPKTLKIEGILADFSNFVVDMKIQNAKDIPVQKGAGELFSAYISARDQIEHLTAQAWLMENKQLEQKVAKLSLQTGFMSEYTRMIILETDHLKKVKESAGTKEASKKSHPQYEAPVQGQRMILLPHLGIGFGNLTATAENTPPGFESKFPECCTRINNQCATALTQLCIGLGCFGCITCCSDICCSGNEG

SEQ ID NO: 119214 - protein, 748 aa, Glycine max
  Coding DNA Sequence Number=SeqID_27529
  Gene Ontology: Mol. function=serine-type endopeptidase activity; Cellular component=cell wall; Biological process=proteolysis
  Homolog annotation: Hit_ID=Q4U4M3; Match level="QueryCoverage=57%, HitCoverage=76%, E-value=0.0, Identity=79%"; Hit description =Subtilisin-like protease
  Pfam annotation: Domain name=DUF1034; Domain location=332-445; Score =87.3; E_value=4.9e-23; Accession=PF06280.3; Description=Domain of Unknown Function (DUF1034)
  Pfam annotation: Domain name=Oxysterol_BP; Domain location=374-746; Score=-50.6; E_value=1.6e-06; Accession=PF01237.9; Description =Oxysterol-binding protein
  Pfam annotation: Domain name=PA; Domain location=6-119; Score=36.7; E_ value=8.4e-08; Accession=PF02225.13; Description=PA domain
  Pfam annotation: Domain name=Peptidase_S8; Domain location=2-298; Score=-67.8; E_value=0.004; Accession=PF00082.13; Description =Subtilase family
  Pfam module annotation: Pfam domain module=DUF1034::Oxysterol _BP::PA::Peptidase_S8; Domain location=332-445::374-746::6-119::2-298
MACTASTHLNETYTLVAANDVLLDSSLMKYSPTDCQRPELLNKNLIKGNILLCGYSFNFVVGTASIKKVSETAKALGAVGFVLCVENISLGTKFNPVPVGLPGILIIDVSNSKSRVTVEVEEVFVEKRRSMELIDYYNITTPRDWTGRVKSFEGKGKIGDGLMPILHKSAPQVALFSARGPNIKDFSFQEADLLKPDILAPGSLIWAAWCPNGTDEPNYVGEAFAMISGTSMAAPHIAGIAALIKQKHPHWSPAAIKSALMTTSTTLDRAGDPLLAQQTSESEAMRLVKATPFDYGSGHVDPTAALDPGLIFDAGYEDYIGFLCTTPSIDVHEIRNYTHTPCNTSMGKPSNLNTPSITISHLVRTQVVTRTVTNVAEEETYVITARMEPAVAIEVNPPAMTIKAGASRQFLVSLTVRSVTGRYSFGEVLMKGSRGHKLPPVFNFPKSQLQCYGESVYCTSSNLLSQCNSGQSPLDRFTSVVAWSISTTRPTSFGVAPYNSTLGETHHVSKGNLNVLVEQVSLNPPVSALHATDEKENIEMIWCQQPVPKFRAQVHGKRLLKLQNHGETYEMNSPHLSIRILPVPGIDWVGNVNIRCPETGFGGSRKLIKGKILDSSLLKVLFEVDGHWDKIVRVKDTNSGEVRVIYDAKEAISGLKTPIIKDVESVWPTESALVWSELSQAIMNKDWERAREAKQDVEERQRNMLRDRAMKGETWFPKNFRVSYSKDTWEWDCSPTHKWVPEAPIIAQ

SEQ ID NO: 119215 - protein, 807 aa, Glycine max
  Coding DNA Sequence Number=SeqID_27530
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=96%, HitCoverage=97%, E-value=0.0, Identity=69%"; Hit description=Beta -galactosidase
  Pfam annotation: Domain name=Gal_Lectin; Domain location=730-807; Score=114.3; E_value=3.8e-31; Accession=PF02140.9; Description =Galactose binding lectin domain
  Pfam annotation: Domain name=Glyco_hydro_35; Domain location=35-341; Score=618.8; E_value=4.9e-183; Accession=PF01301.10; Description =Glycosyl hydrolases family 35
  Pfam annotation: Domain name=Glyco_hydro_42; Domain location=56-344; Score=-247.3; E_value=0.025; Accession=PF02449.6; Description=Beta -galactosidase
  Pfam module annotation: Pfam domain module=Gal_Lectin::Glyco_hydro _35::Glyco_hydro_42; Domain location=730-807::35-341::56-344
MATPKSFISLIVCFCLVIFSFIGTHAVDVSHDGRAIKIDGKRRVLISGSIHYPRSTPEMWPELIQKAKEGGLDAIETYVFWNAHEPSRRVYDFSGNNDIIRFLKTIQESGLYGVLRIGPYVCAEWNYGGIPVWVHNLPDVEIRTANSVFMNEMQNFTTLIVDMLKKEKLFASQGGPIILTQIENEYGNVISQYGDAGKAYMNWCANMAESLKVGVPWIMCQESDAPQPMINTCNGWYCDNFEPNSFNSPKMWTENWIGWFKNWGGRDPHRTAEDVAFAVARFFQTGGTFQNYYMYHGGTNFGRTAGGPYITTSYDYDAPLDEYGNIAQPKWGHLKELHSALKAMEEALTSGNVSETDLGNSVKVTIYATNGSSSCFLSNTNTTADATLTFRGNNYTVPAWSVSILPDCQHEEYNTAKWVWRSENIDKALHGKSNVSAHRLLDQKDAANDASDYLWYMTKLHVKHDDPVWSENMTLRINGSGHVIHAFVNGEYIDSHWATYGIHNDKFEPKIKLKHGTNTISLLSVTVGLQNYGAFFDTWHAGLVGPIELVSVKGEETIIKNLSSHKWSYKIGLHGWDHKLFSDDSPFAAQSKWESEKLPTNRMLTWYKTTFKAPLGTDPVVVDLQGMGKGYAWVNGKNIGRIWPSYNAEEDGCSDEPCDYRGEYSDSKCVTNCGKPTQRWYHVPRSYLKDGANTLVLFAELGGNPSLVNFQTVVVGNVCANAYENKTLELSCQGRKISAIKFASFGDPKGVCGAFTNGSCESKSNALPIVQKACVGKEACSIDLSEKTFGATACGNLAKRLAVEAVC

SEQ ID NO: 119216 - protein, 443 aa, Glycine max
  Coding DNA Sequence Number=SeqID_27531
  Gene Ontology: Mol. function=binding; Cellular component=integral to membrane
  Homolog annotation: Hit_ID=A7R0A8; Match level="QueryCoverage=97%, HitCoverage=38%, E-value=1e-138, Identity=59%"; Hit description =Chromosome undetermined scaffold_301, whole genome shotgun sequence
MESIEMEEAAFGIDESNDDLCSSILSRFANSTDETHQHLCAVIGAMSQELKDNNQPSTPFAYFCAARVSLDKFTSEPNPPSHVIDALLTILSLALPRVPLELLKKQNSQQGEPFSELLLRVLRSPSSASETALVSGLKCLSRLLIARESVDWSDVSPLFNVLLGFLTDSRPKVRRQSHLCHRDVLLNFQNSSLLASASEGVTNLLERFILLVGGAKANAGEGAKEAQQILYILDALKECLPFLSRKSKTSVLNYFKYLLDLHQPLVTRRITDGLNFLCHYPTSEVSPEALLELLNSLARSIESNKMSGDRLTFTARLLDAGMNKVYSLNRQICVVKLPVVLNALKDILASEHEEAIYAATDALKSMINSCIDESLIKQGVDQISLSESNESRKSAPTIIEKICATIESLLDYHYTAVWDRVFQIVSAMFHKLGACVDEIILKR

SEQ ID NO: 119217 - protein, 303 aa, Glycine max
  Coding DNA Sequence Number=SeqID_27532
  Gene Ontology: Mol. function=pectinesterase activity; Cellular component=cell wall; Biological process=cell wall modification
  Homolog annotation: Hit_ID=A7PDR3; Match level="QueryCoverage=32%, HitCoverage=24%, E-value=5e-27, Identity=60%"; Hit description =Chromosome chr11 scaffold_13, whole genome shotgun sequence
  Pfam annotation: Domain name=Nep1; Domain location=172-298; Score= -58.9; E_value=0.0092; Accession=PF03587.5; Description=Nep1 ribosome biogenesis protein
  Pfam annotation: Domain name=Pectinesterase; Domain location=75-265; Score=-188.1; E_value=2.2e-07; Accession=PF01095.10; Description =Pectinesterase
  Pfam module annotation: Pfam domain module=Nep1::Pectinesterase; Domain location=172-298::75-265
MAAFYGVWWRCALPITGNSVTEKKEEGISVFSEACPLTRLGHMGNGYIFCCTYTRTPPCLSSKHLFFLDVGAVRVVRVRRNGAGDFTTVTDAVNSIPSGNKRRVVVWIGMGEYRENVTVDRSKPFVTFYGERNGTDNDNDRDIMPIITYDATALRYGTVDSATVAVDADYFVAVNLASSHKILPPVKAFTNSFAGELLKAGIISNPDNNEVIWRITTNLSSIVSTLPANCKAIAGSHSQGSMNFGDYIRAASDEQIYVFVVGQIDTQSQSYIDDFVKVSDYDLVASQCLSRVISAMETKWGIS

SEQ ID NO: 119218 - protein, 494 aa, Glycine max
  Coding DNA Sequence Number=SeqID_27533
  Gene Ontology: Mol. function=metal ion binding; Cellular component =actin cortical patch; Biological process=actin filament organization
  Homolog annotation: Hit_ID=A7PDQ2; Match level="QueryCoverage=82%, HitCoverage=99%, E-value=0.0, Identity=81%"; Hit description =Chromosome chr11 scaffold_13, whole genome shotgun sequence
  Pfam annotation: Domain name=DUF500; Domain location=350-492; Score =233.2; E_value=6.1e-67; Accession=PF04366.3; Description=Family of unknown function (DUF500)
  Pfam annotation: Domain name=FYVE; Domain location=169-237; Score =88.1; E_value=2.8e-23; Accession=PF01363.12; Description=FYVE zinc finger
  Pfam module annotation: Pfam domain module=DUF500::FYVE; Domain location=350-492::169-237
MASSDGRVTYSSLSKLENENTHFGYDDMNHHGESVWSEPMPGTPCGQLGPTFSNKESLYQFPSEDDDLFDGGYESGDDARGIVPSNRPPEVNLKNVLSGIFAILTGRTKVPSITANQQLPSSNVSFLDSGKNGDVFLDSSVYTPSAPPLCLPNGSDYSSYKEVLEADPPEWLPDSSTTVCMQCSAPFTALTRGRHHCRFCGGIFCRTCTKGRCLMPVGFRERNPQRVCDACYDRLDPLQGVLINTISNAAQGAKHDVMDWTCARGWINLPIGLSMEHEIYKASNTLRNYCQVAKSNPEKSIPLTVLKSAKGLAILTVAKAGALVSYKLGTGLVVARRSDGSWSAPSAIFSLGLGWGAQIGGELMDFIVVLRDMKAVKTFCSHMHFSLGAGCSAAAGPVGRVLEADIRAGDRGSGMCYTYSCSKANNTECCKTVGAFVGVSLEGNIVATRMDANLRFYGDPYLTTSDILLGMVDRPKAAQPMYASLQELYSCLRF

SEQ ID NO: 119219 - protein, 560 aa, Glycine max
  Coding DNA Sequence Number=SeqID_27534
  Gene Ontology: Mol. function=enzyme inhibitor activity; Cellular component=cell wall; Biological process=cell wall modification
  Homolog annotation: Hit_ID=A2Q3Z8; Match level="QueryCoverage=74%, HitCoverage=85%, E-value=1e-150, Identity=62%"; Hit description =Pectinesterase; Pectinesterase inhibitor
  Pfam annotation: Domain name=PMEI; Domain location=114-250; Score =44.3; E_value=4.2e-10; Accession=PF04043.6; Description=Plant invertasepectin methylesterase inhibitor
  Pfam annotation: Domain name=Pectinesterase; Domain location=286-551; Score=426.2; E_value=4.8e-125; Accession=PF01095.10; Description =Pectinesterase
  Pfam module annotation: Pfam domain module=PMEI::Pectinesterase; Domain location=114-250::286-551
  Subcellular localization annotation: CTP_CleavageSite=40; ConfidenceScore=5.63e-01
MAIIPSPKIFLLLLAFFFSHAIPAKSSNASTTTTLHANLSSSNRTNPFPEVSSFNSSKLSISININPYIINTLLNSLQAAISGATKLSDLSTNAGNNIINNKIGAVQDCRELQQSTLASLKRSLSTHFLNINPNIINTLLKSLQAAISGATKLSDLLNNAGNNIIDNKIGAVQDCRELQQSTLASLKRSLSGIRSQDSKKLVDARTYLSAALTNKDTCLESIDSASGTLKPVVVNSVISSYKDVSESLSMLPKPERKASKGHKNRRLLWLSMKNRRRLLQSNDGGELVVAADGTGNFSFITEAINFAPNDSAGRTVIYVKEGTYEENVEIPSYKTNIVLFGDGKDVTVITGNRSVVDGWTTFRSATLTVSGEGFLARDIAFENKAGPEKLQAVALRVNADFTAFYRCAMYGYQDTLYVHSFRQFYRECDIFGTIDYIFGNAAVVLHASKIITRMPMPGQFTVITAQSRDSPDEDTGISIQNCSILATTDLYSNSGSVKSYLGRPWRGIFSSPTLINLLTQWGGKSGLVIKAWTLCIMEISEFIIGDAWLGSTSFPYDDGI

SEQ ID NO: 119220 - protein, 1789 aa, Glycine max
  Coding DNA Sequence Number=SeqID_27535
  Gene Ontology: Mol. function=phosphatidylinositol phosphate kinase activity; Cellular component=mitochondrion; Biological process =phosphatidylinositol metabolic process
  Homolog annotation: Hit_ID=A7PDP8; Match level="QueryCoverage=100%, HitCoverage=99%, E-value=0.0, Identity=62%"; Hit description =Chromosome chr11 scaffold_13, whole genome shotgun sequence
  Pfam annotation: Domain name=Cpn60_TCP1; Domain location=364-743; Score=-237.5; E_value=0.00071; Accession=PF00118.15; Description=TCP- 1cpn60 chaperonin family
  Pfam annotation: Domain name=FYVE; Domain location=31-103; Score =69.2; E_value=1.3e-17; Accession=PF01363.12; Description=FYVE zinc finger
  Pfam annotation: Domain name=PIP5K; Domain location=1528-1763; Score =183.5; E_value=5.5e-52; Accession=PF01504.9; Description =Phosphatidylinositol-4-phosphate 5-Kinase
  Pfam module annotation: Pfam domain module=Cpn60_TCP1::FYVE::PIP5K; Domain location=364-743::31-103::1528-1763
MGTPDKKVSDFVDVVRSWIPRRAEPPNVSRDFWMPDQSCRVCYECDSQFTIFNRRHHCRICGRVFCAKCTANSVPVPSDEPNTGREDLERIRVCNYCFKQWEQVATVDNNGSADLSATPCLSPSPSTTSLVSTKSSCTCHSSSSTAGSVPYTTGPYQRVPYSPHQSSQMNQITDEQENLNSGRSANPSESVGNVTSNQFGYCFSRSDDEDDDYGAYHSDTESRHYSHAHDYDDPVNIHGVDHVYGPHQMHPDEDNIQEKSSSCLTQSQNLDLEGVAGIQAPGKEDDEPDHADGCETSPYHEESNYAEPVDFENNGQLWIPPEPEDEEDDREAVLFDDDEDEGTTGGGEWGYLRSSTSFGSGECRSRDKTTEDHRKAMKTVVEGHFRALVAQLLQVENLTTCDEDGKETWLDIITALSWEAATLLKPDTSRGGGMDPGGYVKVKCIACGHRNESMVVKGVVCKKNVAHRRMTAKIDKPRFLILGGALEYQRVSNQLSSVDTLLQQEMDHLKMAVARIDAHHPNVLLVEKSVSRYAQEYLLAKDISLVLNIKKPLLERIARCTGAQIVPSIDHLTSQKLGYCETFHVDKFFEEHGSAGQGGKKSTKTLMFFEGCPKPLGCTILLKGANGDELKKVKHVIQYGIFAAYHLALETSFLADEGASPLEFPLKSPITVALPDKPSSTVRSISTIPGFSVLTARESQGAKPFKEVPKSNDIYKTERTPSSCSESTERLLVGDSIHMHEVSGGITQLALDMPSSNCNSFVSNTSSKENDKKCPKEFFQYRPDERRETMLNNGLISNSFGTFESSQQDGNSHLRAAALFANQGANPEPPNVKHDTNNFNNNNDHDDMIHSKEDFPPSTSDHQSILVFLSTRCVWKGTVCERSHLVRIKYYGSSDKPLGRFLRDQLLDPSYTCCSCELPSEAHVHCYTHRQGSLTICVKKLEFALPGEREGKIWMWHRCLKCPRIHGFPPATRRIVMSDAAWGLSFGKFLELSFSNHAAASRVASCGHSLHRDCLRFYGFGKMVACFRYASIHLHSVYLPPSKLEFNYDSQDWLQKEANELHNKAEILFSEVCNTLHQISEKVSGPVLQEGGNRVSDFRNLIAELKGMLQYEKEEFEGKAGQPVIDILELNKLRRHILIHSYVWDQRLIYASNLSKIILQENLKSLNHREKLLGSREKVVEADVATRPARGHSSCDSFLLETKPDGNLNLENTSHLSHPVVKSEDKGKDTNHDKVDLSLSGGANINDKSDSVEFGGAVRKALSEGESSSEGHPTNSSLKENGCLPPDAAAVAVHSPVANIVTSKSNSNIYTANIGGVEAGCTNYSKLLSKGLDTTWKGIPFANVFGSFNKTSSFNTEKLVEYNPVHILSFRELERQTGARLLLPAGTNDTIVPVYDDEPTSVIAYVLVSMDYHMQMLEYDRPKDSGDSSISLPLFDSTSLLSLNSFDETITNTYRSLGSFEENVLSTSGSRSLPAGDPFSYTKDLHARVSFTDDSSLGKVKYTVTCYYAKRFEALRRTCCPSELDFVRSLSRCKKWGAQGGKSNVFFAKTLDDRFIIKQVTKTELESFTKFAPAYFKYLSESISTGSPTCLAKILGIYQVTSKHLKGGKETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLETWVKTSGILGGPKNTSPTVISPQQYKKRFRKAMSLYFLMVPDQWSPPELHPSGSQSDICDENA

SEQ ID NO: 119221 - protein, 272 aa, Glycine max
  Coding DNA Sequence Number=SeqID_27536
  Gene Ontology: Mol. function=metal ion binding
  Homolog annotation: Hit_ID=A7QR01; Match level="QueryCoverage=68%, HitCoverage=75%, E-value=2e-53, Identity=52%"; Hit description =Chromosome undetermined scaffold_147, whole genome shotgun sequence
  Pfam annotation: Domain name=FYVE; Domain location=2-43; Score=5.3; E_ value=0.00021; Accession=PF01363.12; Description=FYVE zinc finger
MHHCRSCGRTLCNEHSSNQMALPQFGLYSNVRVCADCFNNLRSGKDEPQTSSDGVNSVTDTISKLDINANVDSKSILTAETKLLSGIKECKCGMPLCICEAPTPSSDAFPQQGSSMFNVGHVTNGTSDRPQIDYEVTGEGLREAIKNSDVAAVKKLLNEGVDANYRDKQGLSLLHLQNCGMQNLTDCFLFRRNTFRLCTSYLAIQNAKEDGGRWSSGPKHLNNLLLLSVFFLCSPPKESFKYYHCLKLLCYQNKKFRLLYNCDRGVQFILAD

SEQ ID NO: 119222 - protein, 347 aa, Glycine max
  Coding DNA Sequence Number=SeqID_27537
  Homolog annotation: Hit_ID=A7PDN7; Match level="QueryCoverage=58%, HitCoverage=68%, E-value=2e-71, Identity=62%"; Hit description =Chromosome chr11 scaffold_13, whole genome shotgun sequence
MFRLRSCEGPVRYLYQQTRHHLHHNNNIMAYLVGYDPCSHLSKAFSQYPSLASSDRGSYLSFRFLHNLVYADVFGVSRSIAFGPRSCSFDTSGSCSSTNSDRIFVRAKARSRGFASNCRQPMLADLEQRNFVRSDESDATLVKVDNGSINGCPAKPPCFNDHRLSQKLVVAVDVDEVLGNFVSALNKFIADRYSSNYSVSEYHVYEFCKIWNCSRDEADIRVHEFFKTPYFKSGIHPLPGAQMALQKLSRFCSLSVVTYAFGIELSSNCKRIFSALTNWRSLNAKVLIDDNPRYAIECADVGIRVLLFDYENSYPWCKNESVDQHPLVTRVKNWEEVEQQLMSLIAS

SEQ ID NO: 119223 - protein, 552 aa, Glycine max
  Coding DNA Sequence Number=SeqID_27538
  Gene Ontology: Mol. function=phosphatidylinositol binding; Cellular component=Golgi apparatus; Biological process=clathrin cage assembly
  Homolog annotation: Hit_ID=Q9LVD8; Match level="QueryCoverage=87%, HitCoverage=88%, E-value=1e-163, Identity=59%"; Hit description =Putative clathrin assembly protein At5g57200
  Pfam annotation: Domain name=ANTH; Domain location=29-288; Score =324.3; E_value=2.2e-94; Accession=PF07651.7; Description=ANTH domain
  Pfam annotation: Domain name=ENTH; Domain location=29-157; Score =16.2; E_value=9.6e-07; Accession=PF01417.11; Description=ENTH domain
  Pfam module annotation: Pfam domain module=ANTH::ENTH; Domain location=29-288::29-157
MGTFQTLRKAYGALKDSTTVGLAKVNSEYKELDIAIVKATSHVEYPPKERHVRKIFYATSAHQPRADVAYCIHTLAKRLSKTRNWIVAIKTLIVIHRILREGDPTFKDDLTAYVRRGRFLQISNFKDDSSALAWDCSAWVRTYALFLEERLECFRILRYDIEAERLTKPSPTITQGHSRTRMLTSEGLLEQLPALQQLLYRLIGCEPEGLALRNHLIQYALALFFDMPKYDAVKALRIYKRAGQQAENLADFYEYCKRLDLARNFQFPTLRLPPASFLATMEEYIKEAPLTATKRLEYHENDQSPQSEAEPKESEEAEASEQPDEEVNEEELVDKDETQPKEEEAELPPLISTDDLLGLNEINPKAQELEESNALALAIVPPGGHYSNNLALTNISGTSGWELALVTTPSNHTSQAPDRRMAGGFDKLLLDSLYEDENARRQLQLRNAGYGYEGMDTHNPFDHYNQQDPFAMSNNIAPPANVQMAFMAQQQQQMMFQQQQQYNTMMVPYQYPQTQYNQQMPVMGSANPFSDPLSVPSYTYSSMHHQGNYHLM

SEQ ID NO: 119224 - protein, 373 aa, Glycine max
  Coding DNA Sequence Number=SeqID_27539
  Gene Ontology: Mol. function=hydrolase activity; Cellular component =cellulose and pectin-containing cell wall; Biological process =negative regulation of Wnt receptor signaling pathway
  Homolog annotation: Hit_ID=A7PRH0; Match level="QueryCoverage=94%, HitCoverage=97%, E-value=1e-146, Identity=62%"; Hit description =Chromosome chr14 scaffold_27, whole genome shotgun sequence
  Pfam annotation: Domain name=PAE; Domain location=36-356; Score =697.1; E_value=1.3e-206; Accession=PF03283.4; Description =Pectinacetylesterase
MCQRSMSGGGMKLLRMFVFVGLVIVKWVEGFEDANVTDLGMQYVSGRGFYRPLMVGFTHINGAAAKGAVCLDGSLPGYHFHRGYGSGSNSWLIQLEGGGWCGTVKNCLYSKKTRHGSSFFMEKQIPFIGILSNKAEENPDFFSWNRIKIRYCDGASFSGDSQNAGAGLYFRGQRIWQAAMEDLMSKGMRYAKQALLSGCSAGGLATIIHCDEFRELFPRTTRVKCLSDAGLFLDSVDVSGRRSLRNLFGGVVTLQGVQRSLPRSCTSRLNPILCYFPQHLIAGVRTPLFLLNAAYDTWQIQASLAPPSADYHWNWYECRKNYARCSAPQIQYLQAVTGIAESVGNWYFDRVSVQAIGCPYPCDKTCHNLVFKR

SEQ ID NO: 119225 - protein, 770 aa, Glycine max
  Coding DNA Sequence Number=SeqID_27540
  Gene Ontology: Mol. function=metal ion binding; Cellular component =integral to membrane; Biological process=lipid metabolic process
  Homolog annotation: Hit_ID=A7NW04; Match level="QueryCoverage=47%, HitCoverage=100%, E-value=1e-111, Identity=57%"; Hit description =Chromosome chr5 scaffold_2, whole genome shotgun sequence
  Pfam annotation: Domain name=Asp; Domain location=70-367; Score =348.5; E_value=1.1e-101; Accession=PF00026.14; Description =Eukaryotic aspartyl protease
  Pfam annotation: Domain name=DER1; Domain location=480-681; Score= -80.9; E_value=0.026; Accession=PF04511.6; Description=Der1-like family
  Pfam annotation: Domain name=Rhomboid; Domain location=518-673; Score= 69.4; E_value=1.2e-17; Accession=PF01694.13; Description=Rhomboid family
  Pfam annotation: Domain name=zf-RanBP; Domain location=709-739; Score= 15.3; E_value=0.014; Accession=PF00641.9; Description=Zn-finger in Ran binding protein and others
  Pfam module annotation: Pfam domain module=Asp::DER1::Rhomboid::zf -RanBP; Domain location=70-367::480-681::518-673::709-739
MGFKYLLVVTCVCAWFGSLVVTTSSGDGLMRVSLKRRSLDISSLNSAKIKEVVNHLKADGVYLKNYLDAQYFGEIGIGSPPQSFRVVFDTGSSNLWVPSAKCVLSFLFGKCPGTPCKIPYGRGHIPGFISQDNIRVGDIIIKDQQFAEITKEGPLAFLAMHFDGILGLGFQNKSVGQVTPVWYNMIEQGHVSQKIFSLWLNQDPVAKVGGEIVFGGIDWRHFKGDHTYVPLTQKDYWQIEVGDILIANNPTGLCEGGCAAIIDSGTSLIAGPTKIVTQINRAIGAEGYVSYECKNIIHNYGDSIWEYIISGYMLRIEEGCNTVCYGGFVPLDVPAPQGPLWVLGDLFLGAYHTVFDYGNLRIGFAEAAILQHLKTADPQNFSAAGDKRFKGLKPNAPAGNRTRVRFKGLKPNAPAGNRTRVCTVAGPVNRNWDLNLIIMSVSSIGITNNMEVRIGQRVSRGMLPILALHTFSEYYRSDHKPPVTAALIAANTLIYLRPSFLDPLIPPIEQVWFNPHLILKNKDLKRFLLSPFYHIGEPHLVYNMLSLLWKGFQLETSMGSVNFSSMVASLLVLSQGVTLMLSKSLLLFFDYERSYYSEYSVGFSGVLFAMKVVLNSQSENYTSVYGVIVPSRYAAWAELVLAQLLVPGVSFLGHLGGILAGLLYLKLRSTYSGSNPIKVVIRGIVDAVKWPFKFLPRRGRITGRGTVGSNRAWRCQTCTYDNNNGSLRVCEMCGTNRGVSGVSSFQRTSRSDGLPLDELRRRRIDRFGGS

SEQ ID NO: 119226 - protein, 38 aa, Glycine max
  Coding DNA Sequence Number=SeqID_27541
MEGKVALKKLLEVQKKAHVNSTDALNWTEEPSIKNTFP

SEQ ID NO: 119227 - protein, 175 aa, Glycine max
  Coding DNA Sequence Number=SeqID_27542
MVHISDIKLIRTDTTLDLSQKAEKDPQILGDAKGLSSFGLQQTISNCKFFTMVEQGILPFLLNKIMQHTIRKKRETKQAELNEWRCCSCWVPILPFAIPFPSPPSPFLPLIHSPAALGGGSVQRVDGENERAVDELSASSVQVPQTFHSHLAEFSSRSRWSFPSLQSHIRRYAPR

SEQ ID NO: 119228 - protein, 265 aa, Glycine max
  Coding DNA Sequence Number=SeqID_27543
  Gene Ontology: Cellular component=integral to membrane; Biological process=intracellular protein transport
  Homolog annotation: Hit_ID=A7NVY7; Match level="QueryCoverage=100%, HitCoverage=100%, E-value=1e-107, Identity=75%"; Hit description =Chromosome chr5 scaffold_2, whole genome shotgun sequence
  Pfam annotation: Domain name=Sec20; Domain location=141-232; Score =0.5; E_value=0.0074; Accession=PF03908.4; Description=Sec20
  Pfam annotation: Domain name=V-SNARE; Domain location=30-210; Score= -23.3; E_value=0.078; Accession=PF05008.6; Description=Vesicle transport v-SNARE protein
  Pfam module annotation: Pfam domain module=Sec20::V-SNARE; Domain location=141-232::30-210
MASNLQMSPQVEQIHGEIRDNFRALANGFQKLDKIKDANRQSNQLEELTDKMRECKRLIKEYDREIKDEEGRNPPEVNKQLNDEKQSMVHISSISAFDTIASFEGYGTNQIANTGASVSTAEENVQLASEMSNQELINAGTKTMDETDQAIERSKQVVHQTIEVGTQTAATLKGQTEQMGRIVNELDSIQFSIKKASQLVKEIGRQVATDKCIMLFLFLIVCGVIAIIVVKIVHPNNKDIRDIPGLAPPVPTRRLLYARSGDHFD

SEQ ID NO: 119229 - protein, 336 aa, Glycine max
  Coding DNA Sequence Number=SeqID_27544
  Gene Ontology: Mol. function=calcium ion binding; Cellular component =intracellular; Biological process=guanosine tetraphosphate metabolic process
  Homolog annotation: Hit_ID=A7NVZ3; Match level="QueryCoverage=93%, HitCoverage=60%, E-value=1e-113, Identity=62%"; Hit description =Chromosome chr5 scaffold_2, whole genome shotgun sequence
  Pfam annotation: Domain name=RelA_SpoT; Domain location=83-178; Score= 111.0; E_value=3.7e-30; Accession=PF04607.8; Description=Region found in RelA  SpoT proteins
  Pfam annotation: Domain name=efhand; Domain location=212-240; Score =34.9; E_value=2.9e-07; Accession=PF00036.23; Description=EF hand
  Pfam annotation: Domain name=efhand; Domain location=246-274; Score =15.4; E_value=0.21; Accession=PF00036.23; Description=EF hand
  Pfam module annotation: Pfam domain module=RelA_SpoT::efhand::efhand; Domain location=83-178::212-240::246-274
MEVMKIHAPLAHAVGTTYLSLELEDLSFQYLFPYSYLYVDFLWLQSHETGGVSLIDIYKEELLQNLKADPLLAELVDDVLIKGRYKSRYSTMKKLLKDGRKPEDVNDIIQSMWKEVPYRTKDYIARPKANGYKSLHLAVEVIENGKTRALMEIQIRTTEMDRLAVGGTAAYSLYKAGLTDPEEVVVDAQAKCLKTIILAAAELAALRLKDFLTNRVFRLLDKNGDGKISIEELTQVMEELGAPGEDAREMMQLLDSNSNGPLSSDEFHMFQEQVELVRNLEARDDQNNKLLDEKLHMADESGLIQVYNEFVTRLASWCLIHLKRMTEQNTLNLLHL

SEQ ID NO: 119230 - protein, 1034 aa, Glycine max
  Coding DNA Sequence Number=SeqID_27545
  Gene Ontology: Mol. function=metal ion binding; Cellular component =nucleus; Biological process=regulation of transcription, DNA -dependent
  Homolog annotation: Hit_ID=A7NVY3; Match level="QueryCoverage=98%, HitCoverage=92%, E-value=0.0, Identity=51%"; Hit description =Chromosome chr5 scaffold_2, whole genome shotgun sequence
  Pfam annotation: Domain name=SBP; Domain location=160-238; Score =175.1; E_value=1.8e-49; Accession=PF03110.5; Description=SBP domain
MEAEFGAKNQYLYGPVVSGMKKAVVGNGKRSLEWDLNDWRWDGDLFTAQPLNSVPSDCRGRQFSPPHPEIPAKNANPSTTNLSYSVFISGEGKRELEKRRRGVIGEGEGEGLNYEAGSLSLNLAGQGYPLMVEEEEKSGKKTKVIGTTTASTTTASNRAVCQVQDCRADLSNAKDYHRRHKVCDIHSKATMALVGNVMQRFCQQCSRFHVLQEFDEGKRSCRRRLAGHNRRRRKTHPDVSVVNEGSLNDQRGSNYLLMSLLRILTNLHSNGSDHTRNQDILSHLLKNLASLAGPNNGGRLAPLLEESKDLVNAGTPGAAQDKPNLNSNAPEASRPSSFIKTDNVIITQDPTMPVAQYETPADGRTQKCIASGDGGVGNSKPPSRPLFSNVCQPRDSLPSQLTTAETKVGRGNLNNIDLNNGYNDIQNTVENHKKPYPPVASVMGSIDRASWLQRDSLKSSPPQTSRNSDSTSIQSPSSSSGEAQISLLIKILFCQGAAPLCICKGKAAYNIPPPYLRIAKSLWTMGYEVLLNDLDRSMSRTDRIVFKLFGKDPSDFPLLIRSQILNWLSHSPTEMESYIRPGCIILTIYLRLEKSAWEELYCNLGSSLRKLLAESNDSFWRTGWVYARVQHSVAFLYNGQVVLDVPLHLKSPQHCRISCIKPLAVPASASAQFIVKGFNLFQSSTRLLCALEGKYLVHASCHGLIGGADAPIQHLSFSCHIPNVTGRGFIEVVEDHGLSSCSFPFIVAEQEVCSEICKLENVIEAAETTDDIQIKKQQMEEMTRALDFLQEMGWLLHRSHVKVKLGPMAPFRDLFQFNRFAWLVDFSMDHGWCAVMNKLLDIIFEGGVDAGEHASIELALLNMGLLHTAVKRNCRPMVELLLRFVPVKTSDGADSEVKQVDEASDRFLFRPDTVGPAGLTPLHVAASMSGLEDVLDALTDDPRMLGIEAWKSSRDSTGLTPNDYACLRGYYSYIQLVQKKTNKKGERQHVVDITGIVVDSYTTQKQSNGHRTCRVSSLQTEKIETTTMPRQCRA

SEQ ID NO: 119231 - protein, 2203 aa, Glycine max
  Coding DNA Sequence Number=SeqID_27546
  Gene Ontology: Mol. function=microtubule motor activity; Cellular component=microtubule associated complex; Biological process =microtubule-based movement
  Homolog annotation: Hit_ID=A7NVX5; Match level="QueryCoverage=95%, HitCoverage=94%, E-value=0.0, Identity=41%"; Hit description =Chromosome chr5 scaffold_2, whole genome shotgun sequence
  Pfam annotation: Domain name=Kinesin; Domain location=124-431; Score =411.7; E_value=1.1e-120; Accession=PF00225.14; Description=Kinesin motor domain
MSKETRTSARRNPQTESNENEFEPCPPNQINFPPPRTPFSSIPDPSRFGNATPRLSVRFGKPHSEPNSAQSTPSRNTSRLSLGGGRLSSCAFVKETEFCVHVPHFDLKDDPSFWTDHNVQVLIRIRPLSNSEKVSQGHGRCLKQESAQTLVWLGHPETRFTFDHIGCETLSQENLFRVAGVPMVENCLSGYNSCMFAYGQTGSGKTYTMMGEIKETEGYLTEDSGITPRVFDYLFTRIKAEEERRKYYKLKYSCKCSFLEIYNEQITDLLEPSSTNLQLREDLKKGVYVENLTEHSVDTVYDVLRLLLQGTANRKVAATHMNCESSRSHSVFTCIIESQWEKDSMTHFRFARLNLVDLAGSESLVIMTLVDLAHGKPRHVPYRDSRLTFLLQDSLGGNSKTMIIANVSPSICCANETLSTLKFAQRAKLIQNNAKVNEDASGDVSALQWQIQQLKGQLSFLMNNKKFPSSVPNLEPNPESCRLSEVSEEYESLGERVTTDHQLLIPSKENKCMKTALVSALRREKMAETTIQNLKAEIDHTNCLVRQKEEEIQHTSSMLRHYKEKIKQLELLVDGKLSAEKYLMEENRALQEEIQLLKVNIDKNSESSRLALENDRLLQQLQLFQNFYEHGERERLLTELSELRDQLLVHLQEKFTYSMKNENQDTDTAQELEECQNMNSKLLREVGILQANLGKYLNYNQILNSSFEHPGEILKTDKCSLVETISMRSDSGDEIPSSTWEADDALANIIEGNALRSSIMLAKDNEYNNEELEAKLEKMSKDLEEARLVNDQYQEKWALQLYQKRQTETICQEVEMETTNTILHLQEEVAHLQSEFEERLCTIAQENTELRNMVAEKEEEIRSRCLDWEKAILELTTFLLEGSRSLKDACGQVKNISCSFPQANAWISEHVDMAVKKYIEKEETIQQLQSSLKDAQKMVSDMELKISSLKEATVAFNALQQLDNNEGNEEVIELQVLLNEKTNMIRMLENEINHKNNQLCKVTKQADAAFLVAKWLSDCYNVAHMNDDIQDISIPELDVQARLGNCTISENQDVQNNLILNDLMAQVELTKLEVLEMENAVKASFVDTETQIEAFQTGVSGLYSAYRNLIQDIVKETQDTKKEIRDLKIYHRSSKGYRVDSLTSNANKCKEYANQHHTLHQIKEQLVEVNRRLNVIDNFIRAENMSSFQLLDEDLIDADDLSADSSSVSDLSTETDSFASGSKSHESTYTCNFKFPGKTTEQIVHLKSERCSVIQSHGSCKSSNTGKLVERRIHNEAVVCCLSKELNVTYDSFQRLYLRLSALLQELDDGSCFYPKELKKVAPYFQLEMQKDKAGCENDKEILGYMEIKPDDGFLTKFMEAHATVQEADLTLHALTEAYEDSKQLTAMWKQAGEDLMIERASLVEEIQKLKFSIFHKEEENRLLKDHIHFSLMDMTNSVSMLEEHFLQMQIDVEKKFLTMYSDILVTGQEMLYFMHNLRSSVEDICSQMVGEGFISFVLYNCCVTELVSKFACTSVNRDLQSARPGELHKLPQICSSVAAPAISTGKEGAEKRDQCVLIQKVQEQPDLPNVNVLYENMALRKELERKQELLEGLLFDFRLLQEQASNSKDIKDQTEKLIFSLTQVRYELEIKASQLDDILVQNRKLEGSLADTEKALTTSNYDLQLAKESIEKLSNQNVELRELLKELYANKTEADGKLEEHKEVIRGLEKEISNLTASQENQSLALFESIEDELNQVIIERDQLHEEVCVLNGKLEMAYSLADEKEAIAMEARQESESSKLFAEQKEEEVKILEHSVEELESTINVLEKKVHEMDEEVGRHRLISDSLRMELQALKERLLLVDNFPKNAYSESTSGQTDEHISRQPSKILELREALSRIRFLEKENAEQDKEIKKCKEYISEIVLHAEAQALQYQQKYKCLESMFHEVKTEVSNSTSMVSASEKIEKSSVRTRGSSSPFRCISNIVQQMNQEKDQELLVSRLRVEELEALAASRQKEVCMLQTRLAATESMTHDVIRDLLGVKLDITDYANLIDENQIVKLVEEAHHHREEFIAKEKENLDLRLQINDLIEERECCISELKTKEADILATQIAMQQLQERDQLLSAQNEMLKMDKTNLIRKVAELDDMVKTLVGTRNTQPAPQSSKTKACLLIFLFLDKGALNLGNGGYNKRLSLSQPERRLSRFNDEPSRYRKFAGNNSQG

SEQ ID NO: 119232 - protein, 480 aa, Glycine max
  Coding DNA Sequence Number=SeqID_27547
  Gene Ontology: Mol. function=protein transporter activity; Cellular component=nuclear pore; Biological process=protein import into nucleus, docking
  Homolog annotation: Hit_ID=A7NVX1; Match level="QueryCoverage=97%, HitCoverage=64%, E-value=1e-174, Identity=68%"; Hit description =Chromosome chr5 scaffold_2, whole genome shotgun sequence
  Pfam annotation: Domain name=IBN_N; Domain location=34-103; Score =25.3; E_value=0.00022; Accession=PF03810.10; Description=Importin -beta N-terminal domain
MQPTAALTMAEDLTQIAHLLDQTLSPDAIAVPAATDALDRLSLTPHFPFYLLSISTGAGNQGQKIAAATYLKNLIRRTVDSTGVKPSNVSKEFKDQLMQALLQVELSVLKILVEVFRTIAVADFVKQNLWPELVPNLQSAIQNSHLISGSNTKWNTVNALLVLHALLRPFQYFLNPKVAKEPVPPQLELISKEILVPLLAVFHQFVEKALATHGIAEKKTEKVLLTICKCLHFAVKSYMPSTLAPLLLSFCRDLMSILGSLSFDCVVNQEDEYLTRLKTGKRSLLIFSALVTRHRKHSDKWMPEIINCVLNIVKFTKNTSKLPFLSERLLSLGFDVISNILETGPGWRLVSPHFTTLLESAIFPALVMNDKDMSEWEEDPDEYIQKNLPSDIDEISGWREDLFTARKSAVNLLGVISMSKGPPMETATDSLSASSKRKKGQKNKKSNQRRSMGELLVLPFLSKFPIPSASNLSQKKILNE

SEQ ID NO: 119233 - protein, 643 aa, Glycine max
  Coding DNA Sequence Number=SeqID_27548
  Gene Ontology: Mol. function=transferase activity, transferring glycosyl groups; Cellular component=integral to membrane; Biological process=protein amino acid glycosylation
  Homolog annotation: Hit_ID=A7NVV3; Match level="QueryCoverage=100%, HitCoverage=100%, E-value=0.0, Identity=64%"; Hit description =Chromosome chr5 scaffold_2, whole genome shotgun sequence
  Pfam annotation: Domain name=Gal-bind_lectin; Domain location=171 -367; Score=120.6; E_value=4.7e-33; Accession=PF00337.13; Description= Galactoside-binding lectin
  Pfam annotation: Domain name=Galactosyl_T; Domain location=409-604; Score=107.8; E_value=3.3e-29; Accession=PF01762.12; Description =Galactosyltransferase
  Pfam module annotation: Pfam domain module=Gal-bind_lectin::Galactosyl _T; Domain location=171-367::409-604
MKKWYGGLLIMALGMMLLFLYNVKGIQPQKQSAKQSAYNFFHNHTPGDSINGSSNLPVNSSEVELKRVTTPAKRPHLVHVAGLDDLYDMKNLSKEETNSVLIWDSLRSLLSRSDALAETAQGVKEASVAWKELLSIVEKDKASKINKMDGPENQNCPFSVTSPGKAVPDSGITLDLPCGLVVDSSITLIGIPNNRSFQIDLAGLEQEGEPNPPIILHYNVSLPGENMTEEPYIVQNTWTSDLGWGKEERCPARGSANIQEVDGLVLCNIQAVRSNNKGNANVDQPASDIPSNISSESVHRTANFPFAEGNPFTSTLWVGSEGFHMTVNGRHETSFAYREVLWMQKLEPWLVSSIKVAGSLSLLSILAKGLPVTEDNDIVVDIENLKAPSIARKRLALLIGVFSTGNNFERRMALRRSWMQYEAVHSGEVAVRFFIGLHKNNRVNFELWTEAQAYGDIQLMPFVDYYSLISLKTIAICIMGTKIIPSKYIMKTDDDAFVRIDEVLSSLKGKPSEGLLYGLISSKSSPQRDEGSKWYISEEEWPHDTYPPWAHGPGYVISRDIAKFIVHAHQERKLKLFKLEDVAMGIWIEQFKNDGKEVHYENDERFYNAGCESNYVIAHYQSPRMVLCLWEKLQKEHQPVCCE

SEQ ID NO: 119234 - protein, 90 aa, Glycine max
  Coding DNA Sequence Number=SeqID_27549
  Homolog annotation: Hit_ID=A2Q670; Match level="QueryCoverage=93%, HitCoverage=39%, E-value=2e-15, Identity=45%"; Hit description =Desiccation-related protein PCC13-62, putative
MGTSQLQLVAGLLGVEAGQDAVVRAMLYERVMREKFQEINVLAADKDSLSYSRNVQEILRILNGGNERVPGSFFSKGANGRLAKSYLGAT

SEQ ID NO: 119235 - protein, 259 aa, Glycine max
  Coding DNA Sequence Number=SeqID_27550
  Gene Ontology: Mol. function=DNA binding; Cellular component =transcription factor TFIID complex; Biological process=transcription initiation
  Homolog annotation: Hit_ID=A9PCE8; Match level="QueryCoverage=66%, HitCoverage=98%, E-value=4e-75, Identity=83%"; Hit description =Putative uncharacterized protein
  Pfam annotation: Domain name=TFIID-31kDa; Domain location=82-210; Score=151.7; E_value=2e-42; Accession=PF02291.6; Description =Transcription initiation factor IID, 31
MRLFKTPATVEDGIVVVMARVVQGREGSKKEDAGSKSLEQPVDSLGSIRTVGYDKAQWQKEEFLCPFLLLTIRNSESDSVGGMGDKEEESAMPRDAKIVKSLLKSMGVEDYEPRVIHKFLELWYRYVVDVLTDAQVYSEHAGKPAIDCDDVKLAIQSKVNFSFSQPPPREVLLELAQNRNKIPLPKTIAGPGIPLPPDQDTLISPNYQFAIPNKRPAQPLEETEDEEATIPNPSQEQKVDTQPNPHQRVSFPLPKRQKD

SEQ ID NO: 119236 - protein, 27 aa, Glycine max
  Coding DNA Sequence Number=SeqID_27551
MAWLGAMVFLGFNGWWLGNEDGAGKGN

SEQ ID NO: 119237 - protein, 104 aa, Glycine max
  Coding DNA Sequence Number=SeqID_27552
MASSHKQVNSKGKRIGDEDMFKSKGKDPLEGFGGPMTRVRARKVKEAFQQVLSILFEYKPKFQGEKFKGPIGNLGISLLGDQMVADLLAVGGLILDDPKSALMP

SEQ ID NO: 119238 - protein, 222 aa, Glycine max
  Coding DNA Sequence Number=SeqID_27553
  Gene Ontology: Mol. function=nucleic acid binding; Cellular component= ribonucleoprotein complex; Biological process=multicellular organismal development
  Homolog annotation: Hit_ID=Q531A8; Match level="QueryCoverage=99%, HitCoverage=35%, E-value=1e-109, Identity=72%"; Hit description=FCA gamma
  Pfam annotation: Domain name=RRM_1; Domain location=54-125; Score =76.9; E_value=6.6e-20; Accession=PF00076.13; Description=RNA recognition motif. (a.k.a. RRM, RB
MAGCCFIKYATSEEADQAIRALHNQHTLPGGVGPIQVRYADGERERLGAVEYKLFVGSLNKQATVKEVEEIFSKYGRVEDVYLMRDEKKQSRGCGFVKYSHRDMALAAINALNGIYTMRGCEQPLIVRFADPKRPRQGDSRGLAFGGPGFGPRFDAPGTRHPSNITDPIGDRMPPPNAWRPMHPPNVGPPSNAGLQGMGPPLISRSGDMALPTNAKSDKNNV

SEQ ID NO: 119239 - protein, 398 aa, Glycine max
  Coding DNA Sequence Number=SeqID_27554
  Gene Ontology: Mol. function=sequence-specific DNA binding; Cellular component=nucleus; Biological process=regulation of transcription, DNA-dependent
  Homolog annotation: Hit_ID=A7Q8S5; Match level="QueryCoverage=53%, HitCoverage=57%, E-value=1e-41, Identity=48%"; Hit description =Chromosome chr5 scaffold_64, whole genome shotgun sequence
  Pfam annotation: Domain name=WRKY; Domain location=211-270; Score =149.9; E_value=7.2e-42; Accession=PF03106.6; Description=WRKY DNA -binding domain
  Subcellular localization annotation: CTP_CleavageSite=76; ConfidenceScore=5.06e-01
MEEKREKEKNSKSSSSTMANSVAFSDEIPNMSMSFPFSPAFSSSIFDMMPPPPPSSSHDPKAPNFANSFMDLLAVPADYYTPSLFDWSQNTAPTSAPPPSTTQINHPLPSPASSNVPDGSEVLNTPASPNSSSISSSSNEAAAATTANKTTGNDNEEEEDETAIDATAGREEEDHQDQDKTKKQLKPKKKNQKKQREPRFAFMTKSEVDHLDDGYRWRKYGQKAVKNSPHPRSYYRCTTATCGVKKRVERSSEDPTVVVTTYEGQHTHPCPATSRASFGFMHSEASGFGPTSGLGSAHFMLQQQQQFRDQAQAQAAMLYNSTSSSLSLPLNVVNSASCVNNSYANTSSLSGFLQGQENHQRGFVPSRVVAPHIFLRDNGLLQDIVPTQMGNEENEDRV

SEQ ID NO: 119240 - protein, 186 aa, Glycine max
  Coding DNA Sequence Number=SeqID_27555
  Gene Ontology: Mol. function=nucleoside-triphosphatase activity; Cellular component=integral to membrane; Biological process=transport
  Homolog annotation: Hit_ID=A7PRJ4; Match level="QueryCoverage=89%, HitCoverage=23%, E-value=1e-43, Identity=50%"; Hit description =Chromosome chr14 scaffold_27, whole genome shotgun sequence
MAQLAGADEIESLRNELAEIGRNIRSSFRSHASSFQRVSSINPVQQEVDNDAGEALQWAEIQRLPTFERITSALFDKFRKRIDKVGINLPTVELRYQNLSVEAECKIVQGKPIPTLWNTLKEWIFDTTKLSVLKSQNSKISIIKNDNGIIKPGRMTLLLGPPASGQPFFFRTQIKFITYRYMTNVL

SEQ ID NO: 119241 - protein, 287 aa, Glycine max
  Coding DNA Sequence Number=SeqID_27556
  Gene Ontology: Mol. function=catalytic activity; Cellular component =mitochondrion; Biological process=metabolic process
  Homolog annotation: Hit_ID=Q9SMK7; Match level="QueryCoverage=100%, HitCoverage=100%, E-value=1e-122, Identity=78%"; Hit description =Putative enoyl CoA hydratase
  Pfam annotation: Domain name=ECH; Domain location=20-185; Score =146.8; E_value=6e-41; Accession=PF00378.11; Description=Enoyl-CoA hydrataseisomerase family
MDGQSPEKLILVKRESNGVALVMINRPGSLNSLTRPMMVDLAQAFKRLDRDESVRVVILTGSGRSFCSGVDLTSAEDVFKGDVKDPESDPVVQMELCRKPIIGAIRGFAVTAGFEIALACDILVAAKGSKFMDTHARFGIFPSWGLSQKLSQIIGANKAREVSLSATPLTAEVAERLGLVNHVIEEAELLKKSREIADAIVKNNQDLVLRYKAVINDGLKLDLGRALSLEKPLITVPVVDRNAESIRAKPQKSKERAHDYYNGMTKEQFRKMQEFIAGRSSKKQSKL

SEQ ID NO: 119242 - protein, 935 aa, Glycine max
  Coding DNA Sequence Number=SeqID_27557
  Gene Ontology: Mol. function=DNA-dependent ATPase activity; Cellular component=nucleus; Biological process=DNA replication initiation
  Homolog annotation: Hit_ID=Q2R482; Match level="QueryCoverage=97%, HitCoverage=98%, E-value=0.0, Identity=76%"; Hit description=DNA replication licensing factor MCM2, putative, expressed
  Pfam annotation: Domain name=AAA_3; Domain location=544-685; Score= -7.4; E_value=0.0021; Accession=PF07726.2; Description=ATPase family associated with various
  Pfam annotation: Domain name=AAA_5; Domain location=544-691; Score =9.1; E_value=0.00059; Accession=PF07728.5; Description=ATPase family associated with various
  Pfam annotation: Domain name=MCM; Domain location=486-830; Score =738.9; E_value=3.3e-219; Accession=PF00493.14; Description=MCM235 family
  Pfam annotation: Domain name=Mg_chelatase; Domain location=531-697; Score=-134.0; E_value=0.0017; Accession=PF01078.12; Description =Magnesium chelatase, subunit ChlI
  Pfam module annotation: Pfam domain module=AAA_3::AAA_5::MCM::Mg _chelatase; Domain location=544-685::544-691::486-830::531-697
MAPENPSTPDPESPTSPSVGFNTDQLPHTHTSHASQDDEASVDPDIVRDDIEEQPEEEEEDGEDLYNDNFLDDYKRMDEADQFESFGLDDSLEDDRDFDQIMQDRRAAEVELEARDGRASNRNKLPQLLHDQDTDDDNHRSSKRARADFRPSVASDDDFDGMQSSPGRSQRHSREDILMTDQTEDDRDDDDFDDGYEMYHVQGTLREWVTRDEVRRFIARKFKDFLLTYLNPKNEHRDKEYVWLINEMVSASKCSLEIDYKQFIYVHPNIAIWLADAPQSVLEVMEDVTKNVVFELHPNYRNIHQKIYVRITNLPVYDQIRNIRQIHLNTMIRIGGVVTRRSGVFPQLQQVKYDCNKCGAILGPFFQNSYSEVKVGSCPECQSKGPFTVNIEQTIYRNFQKLTLQESPGIVPAGRLPRYKEVILLNDLIDCARPGEEIEVTGVYTNNFDLSLNTKNGFPVFATVVEANYVTKKQDLFSAYKLTQEDIEEIENLAKDPRIGERIVKSIAPSIYGHDDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPVGGRYDSSKTFSQNVELTDPIISRFDILCVVKDVVDPVTDEMLATFVVDSHFKSQPKGAKQDDKSFSEFQDIHASAMPADPEILPQQLLKKYITYAKLNIFPRLQDADMDKLSHVYAELRRESSHGQGVPIAVRHIESMIRMSEAHARMHLRQHVTQEDVDMAIRVLLESFISTQKFGVQKALQKSFRKYMTFKKDYNELLLYILRELVKNALHFEEIVTGSASGLTHIDVKVDDLYHKAQEHDIYDLKPFFNSSHFSRANFVLDEERRVIRHHLTR

SEQ ID NO: 119243 - protein, 743 aa, Glycine max
  Coding DNA Sequence Number=SeqID_27558
  Gene Ontology: Mol. function=actin binding; Cellular component =endoplasmic reticulum; Biological process=cytoskeleton organization and biogenesis
  Homolog annotation: Hit_ID=A7Q8R7; Match level="QueryCoverage=97%, HitCoverage=90%, E-value=0.0, Identity=77%"; Hit description =Chromosome chr5 scaffold_64, whole genome shotgun sequence
MAPRSFLLALLSLLLTQSESAPQAFKREPGHPQWHHGAFHDVRDSVRSDVRRMLHSRAEVPFQVPLEVNVVLIGFSGDGGYRYNIDAHRLEQFLKTSFPVHRPSCLETGELLDIEHHMVYNAFPAGQPELIALEKELKGAMVPAGKAREVPLFEVEATAVEPIFQRLYSYIFDMDSVGSSVTEMDRPVPSAIFIVNFDKVRVDPRNKEVNLDSSLYEKIPDLTEEDMKRQEGDYIYRYRYNGGGATQVWLSSGRFVVIDLSAGPCTYGKIEAEEGSVCSRTLPRLQNVIRPSSSSTTSHQSSNDIFLGQLASLVSTTVEHVIAPDVRFETVDLTSRLLVPIIVLQNHNRYNIMEKGHNYSINIEEIEAEVKSMLHDGQELVIIGGVHSLHRHEKLAIAVSKAMRGHSLQETKNDGRFHVHTKTYLDGAILKEEMERSADVLAAGLLEVSDPSLSSKYFLRQNWMDEPEGSTDSILKHKSLWDSYNSKYSQKRRKKVKKQGDLQPTYGTRVIPVFVLSLADVDPNLMMEDESMVWTSKDVVIVLEHQNKKIPLSYVSETQRRHALPSQAQRHILAGLASVVGGLSAPYEKASHVHERPVVNWLWAAGCHPFGPFSNTSHISQMLLDVALRNSIYARVDSVLHKIRDTSETVQTFVAEYLKTPLGEPVKGKKEKSNTELWLEKFYKKTTNLPEPFPHELVDRIEKYLDGLEELLVDMSSLLYDHRLQDAYLNSSDILQSTMFTEQ

SEQ ID NO: 119244 - protein, 80 aa, Glycine max
  Coding DNA Sequence Number=SeqID_27559
  Subcellular localization annotation: CTP_CleavageSite=62; ConfidenceScore=5.21e-01
VRPERAQGKIGISRTMPSGQISQQGAVLQSYSQFRAVWKVFPRGCCFCTSPALDAPFLMATSCMVDTCRGGRKALLLLAI

SEQ ID NO: 119245 - protein, 127 aa, Glycine max
  Coding DNA Sequence Number=SeqID_27560
  Homolog annotation: Hit_ID=A9PBV5; Match level="QueryCoverage=99%, HitCoverage=99%, E-value=2e-37, Identity=71%"; Hit description =Putative uncharacterized protein
MEGADEGIERVVDSKDLQQQSKAFDKLTDRVEDRQLDSSRVQEVPLSILSQTLLRYFTTTAMASIAASAEADWQAMRMREKELAAVKINAADVDIIANELELDKKVAERTLREHKGDAVAAIRHLLR

SEQ ID NO: 119246 - protein, 321 aa, Glycine max
  Coding DNA Sequence Number=SeqID_27561
  Homolog annotation: Hit_ID=Q9SWB6; Match level="QueryCoverage=71%, HitCoverage=100%, E-value=1e-130, Identity=99%"; Hit description =Seed maturation protein PM36
  Pfam annotation: Domain name=TENA_THI-4; Domain location=19-228; Score=223.9; E_value=3.7e-64; Accession=PF03070.7; Description =TENATHI-4 family
MEEKAKAEQKKIGMTETWLKKHRLLYNGATRHPLIISIRDGTINTASFKTWLAQDYLFVRAFVPFVASVLIKAWKESDCSGDMEVILGGMASLEDEISWFKTEANKWGISLSDVVPQQANKNYCGLLESLMSPDAEYTVAITAFWAIETVYQESFAHCIEEGSKTPPELKETCVRWGNEAFGKYCQSLQNIANRCLQKASDEELKKAEVMLLSVLEHEVEFWNMSRGNLERQDPLYHAQTCNEIAELWGLVGVLNSMDEGETHNNATSPNNPHNPTPMPGRNHSIGKYNNSGTQKIKGLSNQTGFTEGNANGAINFGSLHA

SEQ ID NO: 119247 - protein, 245 aa, Glycine max
  Coding DNA Sequence Number=SeqID_27562
MTKKKQATKRKNLELNLDDASSENDWIVENDDGTMKVWIWTTWMGMLQIEDKDLVLDQGAKDINDAAKWRIWMMKMDKMKIHVVVPKNVSGSQRRMVVVVMGVHPKGPYMGSLWRSVELAALVDVVTFLKGTLVNLIADVEVGFRRRVVRGHETQRNSQARGMAAEGSPKDGSNQKQRHVPICEEQVVGERDRRRWPNNGRKYCGYYSPKKPKRRTWRRAVAARAMTGVEVASGRTTSKDVHRGQ

SEQ ID NO: 119248 - protein, 171 aa, Glycine max
  Coding DNA Sequence Number=SeqID_27563
MRLCLCLTLLLVLASVAMGEEDADHNKHSLKAKSHAQIQCTMCSSCNNPCNQVPSPPPPSPSSNNCPPPPSPPSSGGGGEGAPYYYSPPPPSQYTYSSPPPPASTGGGMYYYTPPSNRNYPRPPPPNPIVPYFPFYYYSPLPPGSTAAPPPSTASSILCALAFSSFLLLLL

SEQ ID NO: 119249 - protein, 98 aa, Glycine max
  Coding DNA Sequence Number=SeqID_27564
MAHMTSTNRQEHSTTHHHGFMCVYSKQYTSQKLYMVLPCYSLKMEGHEKDLEFLLVCNNDPCHHDEASSLDLTWALTCKKINRTLALWGQLHSNLKRL

SEQ ID NO: 119250 - protein, 599 aa, Glycine max
  Coding DNA Sequence Number=SeqID_27565
  Gene Ontology: Mol. function=RNA binding; Cellular component=nucleus; Biological process=regulation of transcription, mating-type specific
  Homolog annotation: Hit_ID=A7Q8H8; Match level="QueryCoverage=99%, HitCoverage=100%, E-value=0.0, Identity=62%"; Hit description =Chromosome chr5 scaffold_64, whole genome shotgun sequence
  Pfam annotation: Domain name=PUF; Domain location=110-144; Score =13.8; E_value=0.28; Accession=PF00806.10; Description=Pumilio-family RNA binding repeat
  Pfam annotation: Domain name=PUF; Domain location=146-181; Score=7.5; E_value=1.6; Accession=PF00806.10; Description=Pumilio-family RNA binding repeat
  Pfam annotation: Domain name=PUF; Domain location=182-216; Score=9.5; E_value=0.91; Accession=PF00806.10; Description=Pumilio-family RNA binding repeat
  Pfam annotation: Domain name=PUF; Domain location=295-330; Score=6.8; E_value=1.9; Accession=PF00806.10; Description=Pumilio-family RNA binding repeat
  Pfam module annotation: Pfam domain module=PUF::PUF::PUF::PUF; Domain location=110-144::146-181::182-216::295-330
MAAKKHDAGDTKKRKRLNTETHEAPKASKLVASKKHKPDSVAKDNKNKKTAPLTGRERRLHSKELADARKKKRKRHFTLEQELARLWEKMRRHEIAKEDRAKLVTEALQKMKGKIPEIAGSHISSRILQTCVKHCSQAERDAVFEELQPHFLTLAYSAYAVHLVKKMLDNASKKQLAGFISTLHGHVAPLLRHMVGSVVVEHAYELANAAQKQELLSELYSTELRLFKDLVSLKESRLLDVMSKLGLQKGSVLRHMASVIQPILEKGIVDHSILHRVLLEYFSIADKERKKIIKGLKGHIDKTAYHQYGCMVLVCILSVVDDTKLITKVIIRELQSILKELVLDKNGRRPLLQLLHPNSSRYFSPDDLASLNLSIPSLSLKDQSEASSLTETSKVSLGDKESKDDIELALNEVNKDKTSVDDSDLAESGKKDPFVRRQELLIKSGLADSLLDICIESVGELIQSNFGKEVLYEVATGGSEGIMHPALGDKINSLHNAVASLAAMPKSEDSQEEHVLENFHSSRTIRKLILDCPNFASTLWEKALKGKSELWVHGHSCKVISAFLESPDPTVQKLVKKELQPLIDNGILKNPKPKEQANQ

SEQ ID NO: 119251 - protein, 97 aa, Glycine max
  Coding DNA Sequence Number=SeqID_27566
MGTVYNLREQQKLELLSILTNKLPQQAFLQGVGCRMYHRILSGGAIILGGRAIWGGGDQGAVEVGFDVKGENMNLRLTSTDPTQQSKVDGNYREVGR

SEQ ID NO: 119252 - protein, 580 aa, Glycine max
  Coding DNA Sequence Number=SeqID_27567
  Gene Ontology: Mol. function=triacylglycerol lipase activity; Biological process=lipid metabolic process
  Homolog annotation: Hit_ID=Q8W4L6; Match level="QueryCoverage=92%, HitCoverage=91%, E-value=1e-155, Identity=52%"; Hit description =Putative uncharacterized protein Z97340.15
  Pfam annotation: Domain name=Lipase3_N; Domain location=36-117; Score= 69.0; E_value=1.6e-17; Accession=PF03893.7; Description=Lipase 3 N -terminal region
  Pfam annotation: Domain name=Lipase_3; Domain location=170-285; Score= 39.5; E_value=1.2e-08; Accession=PF01764.16; Description=Lipase (class 3)
  Pfam module annotation: Pfam domain module=Lipase3_N::Lipase_3; Domain location=36-117::170-285
  Subcellular localization annotation: CTP_CleavageSite=45; ConfidenceScore=5.03e-01
MTAGAVATAAGAAVMLYLVFRRRRKAEKEWSRSRTTWRLKPAQAPANMLESIATLSETLRFTYSETIGKWPIADLAFGINYLMRKQGDLAVASVYGGSSCVELKGPGVVDELQELLRLLTLCMLFSKKPFPEFLDSAGFSLDHVLLHNPEAGLLKPAFTIIHDTQSKCFLLLIRGTHSIKDTLTAATGTVVPFHHSILNDGGISNLVLGYAHCGMVAAARWIAKLCTPTLLKALNKCPDSEVKIVGHSLGGAACMTWELGESGKHFITTIINGYDLVPTLSASSVDDLRSEVAASSWMSDLWDQAEHTKVLKAVHNSATALGSHLQFISSAKDKVAGVGAILRPVTSGTQVVMKHAQSVVEAVVKTMASHRQNIGPLPKSKLNNLAESSLEPKNISKSLLTESVPVLNKDEPNYSSGRSGLDAIDEEEQLIDANEHITSSVVNDITEGELWYELEKELEKQNNILNIRAQVEEAAAAKEITEEENQLIDAAQGTSNSITASDKVDSYRFYPPGKIMHIVSTPSSDDFSSSSIEEHVKLYETPRQLYSKLRLSRTMINDHYMPTYRKMIQLLIRQLEKDIM

SEQ ID NO: 119253 - protein, 507 aa, Glycine max
  Coding DNA Sequence Number=SeqID_27568
  Gene Ontology: Mol. function=drug transporter activity; Cellular component=membrane; Biological process=multidrug transport
  Homolog annotation: Hit_ID=A7Q8E7; Match level="QueryCoverage=99%, HitCoverage=99%, E-value=1e-168, Identity=61%"; Hit description =Chromosome chr5 scaffold_64, whole genome shotgun sequence
  Pfam annotation: Domain name=MatE; Domain location=267-429; Score =147.1; E_value=5e-41; Accession=PF01554.9; Description=MatE
  Pfam annotation: Domain name=MatE; Domain location=30-190; Score =107.6; E_value=3.8e-29; Accession=PF01554.9; Description=MatE
  Pfam module annotation: Pfam domain module=MatE::MatE; Domain location=267-429::30-190
MLAEQKFQKTYPTVTEVLEEVRRMTDIGFPIAAMSLVGYLKNMTLVVCMGRLGSLELAGGSLAIGLTNITGYSVLSGLAMGMEPLCTQAFGSRNLSLLSLTLQRTILMLLLFSLPISLLWLNLESLMLCLRQNPDITRVATLYCRFAIPDLIANSFLHPLRIFLRSKGTTWPLLWCTLLSILLHLPTLTFLTFKLNLGVPGIAISSFVANFSNLFFLLLYMFYTRVPKESLHVSLLMSHNNLIITCSSSTSTIAKEWGMLMKFSIQSCLAVCLEWWWYELMTISAGYLDNPRVALATAGIVIQTTSLMYTLPTALSASVSTRVGNELGAGQGERANLSTVVAIGLALVSSIFGLLWTTMGRERWGRVFTSDSEVLQLTVAVLPIIGLCELANCPQTTSCGILRGSARPGIGAVINFCSFYLVGAPVAIVLAFYWKLGMVGLCYGLLAAQIACVVSIFGVVYKTDWERESLKARCLVGKASCGTFAYDEDQTDALKCEEGVVFLNSQK

SEQ ID NO: 119254 - protein, 58 aa, Glycine max
  Coding DNA Sequence Number=SeqID_27569
MKTHRGRNSTIFKIIVLVFVTLIATDLRQQLKWKGWNYNLNPSLKDIHTITIIQSSLK

SEQ ID NO: 119255 - protein, 798 aa, Glycine max
  Coding DNA Sequence Number=SeqID_27570
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=100%, HitCoverage=100%, E-value=0.0, Identity=62%"; Hit description =Central motor kinesin 1
  Pfam annotation: Domain name=Kinesin; Domain location=209-522; Score =372.4; E_value=7.5e-109; Accession=PF00225.14; Description=Kinesin motor domain
MGGQMQQSNASATALYDHAGPGSLHNAAGPATDAGDAVMARWLQSAGLQHLASPLASTAIDQRLLPNLLMQGYGAQSAEEKQRLSKLMRNLNFNGESGSEPYTPTSQNLGVVSDGFYSPDFRGDFGAGLLDLHAMDDTELLSEHVISEPFEPSPFMPGGTRGFVDDFNSISRKQERGEADSDASLFLPTNEKENNTRENNVAKIKVVVRKRPLNKKELAKKEDDIVTVYDNAYLTVHEPKLKVDLTAYVEKHEFCFDAVLDENVTNDEVYRVTVEPIIPTIFEKTKATCFAYGQTGSGKTYTMQPLPLRAAEDLVRQLHRPIAEWLCLYTVNRKLCMREDGRQQVCIVGLQEFEVSDVQIVKEFIEKGNAARSTGSTGANEESSRSHAILQLVVKRHNEVKESRRNNNDVNEAKSGKVVGKISFIDLAGSERGADTTDNDRQTRIEGAEINKSLLALKECIRALDNDQIHIPFRGSKLTEVLRDSFVGNSKTVMISCISPNAGSCEHTLNTLRYADRVKSLSKSGNPRKDQAPNPIPPPAIKEVSSTSSLPGSVGAEDFNNGQRQEVKTMDMSRKVVEKESSLYSSAADVDKQSSFSSSCQFNGREEKSSASAPMDREKFEVKNSYGGDSTSQKMNSYSLNVTDEKVQRVSPPRRKGTKEEKSERSVNWVKRDVDGYDHSTTSSKQQSTGNYNITTGSGQSETESSSNVNISAILEEEEALIAAHRKEIEDTMEIVREEMKLLAEVDQPGSLIDNYVTQLSFVLSRKAASLVSLQARLARFQHRLKEQEILSRKRVPR

SEQ ID NO: 119256 - protein, 493 aa, Glycine max
  Coding DNA Sequence Number=SeqID_27571
  Homolog annotation: Hit_ID=UPI0000162A67; Match level="QueryCoverage =34%, HitCoverage=35%, E-value=1e-15, Identity=35%"; Hit description =wound-responsive protein-related
  Subcellular localization annotation: CTP_CleavageSite=12; ConfidenceScore=5.11e-01
MASAHYTLSSVLAPQATGRTTLRIPISSKRHRKNHLRPKILKILTKPYPLTLPLLPSPPPPPHPIVLPQENNNLCVELPAEETLAGEPDKLEELQVSEGTTKDNGVFQNVSAVDILKYGGMYFLGFFVLQTIYTVWIVGIFKFNQKDRDLEIDRDEKTVSWPVHGASNVFLSEEQVLMDKKIEEIKLMAREARRIESEKKGKEDEDEDFEVDDDDDDEGAVSSNRLGIEKEIGERLLKVQNRINGSAKDISAALQINSRGNSAAGVDRGVNKNVKNKGNEALVFKKKFKFKSPSTKDTKTPKGFPGNRDWKESKATKRGSESKKAAQDHGSDDVSDHAQMLHEDKRANQPELVTQKSVSSVPSEEGGKVVDDKSKVILMQRDSEEGLEGLYYGLKFTSKEQEQSDDDSYTVAFEDHADANNFCFLLKSFFEDLGSFSAYAVPMPIQELNEEIISRAKKVVVVKKRQLQLYAGQPLADVEMHLRSIIEQDQIAP

SEQ ID NO: 119257 - protein, 390 aa, Glycine max
  Coding DNA Sequence Number=SeqID_27572
  Homolog annotation: Hit_ID=A5AV49; Match level="QueryCoverage=83%, HitCoverage=73%, E-value=2e-28, Identity=39%"; Hit description =Putative uncharacterized protein
  Pfam annotation: Domain name=F-box; Domain location=180-230; Score =15.2; E_value=0.25; Accession=PF00646.24; Description=F-box domain
  Pfam annotation: Domain name=F-box; Domain location=23-73; Score =11.8; E_value=1.3; Accession=PF00646.24; Description=F-box domain
  Pfam module annotation: Pfam domain module=F-box::F-box; Domain location=180-230::23-73
MGDLRVKKKKGSNKKKHGSVSVTAIKFLPKELQVEIFAKVATRSVFDHCMIKLCCKEFLRAAEDNYVYRHASMENFALVPLPWFKGNNKEFPFLKRCRESGNSEILYREGMVQYFTSSMMELGLKNLKEAALEGHHDAKYVYCMLLMCGEDELGERKQVAGLGVKKRRNEKQHKHDGSFTTVKALPKDMLVEIFAKVATRSIFDLCMVKQCCREFLHAAEDDYVYRHASMENYALVPLQWLKESSFLKRCKESGNSEFAYREGMVQYFTYSRVELGLKNLKEAALEGDHDEAKYVYCMLLMCGEDELGQRKQGSDLLCSLKASSTSLVRCRKRVKSFVGTMWLNNKPVVPNRKSCFCGSDTSDSERLKKLSRSLRWSSFDANVALLIMNL

SEQ ID NO: 119258 - protein, 77 aa, Glycine max
  Coding DNA Sequence Number=SeqID_27573
MYFYSHCFIIKYETSGGKQFYNVRYQPTPKLLSLLVETGDNPRINSHVADISDIKQIKVYQIRSKKGLTKVFYNVES

SEQ ID NO: 119259 - protein, 78 aa, Glycine max
  Coding DNA Sequence Number=SeqID_27574
MQLNKHNFILHNEEVVLPCPKKTAIKRGTNHARSMDFTSVLVIGANAPHHSPNEMPFGDGIDTVSSYLPSLCTHDMRH

SEQ ID NO: 119260 - protein, 942 aa, Glycine max
  Coding DNA Sequence Number=SeqID_27575
  Gene Ontology: Mol. function=zinc ion binding
  Homolog annotation: Hit_ID=A5BJN7; Match level="QueryCoverage=90%, HitCoverage=56%, E-value=1e-105, Identity=32%"; Hit description =Putative uncharacterized protein
  Pfam annotation: Domain name=zf-CW; Domain location=617-665; Score =61.7; E_value=2.5e-15; Accession=PF07496.6; Description=CW-type Zinc Finger
MEIKIGRGKERQMQANIEFEEGEAFFCYKDDDDDDNTDLDSLSYIKFSTIIVKILKNNVLATDKQRTNNLLPVLFKDERIQHALGHFRKEFEGGVSAGRLGAKFGDYGSFLPTCEHSPPLRSCSKTPQKHNSSPKSPSNLHMAAAFRNSKALPNMPFSMRVGTASYEAPPFRNIRVPSADYSVKNTDISSNEVIEKFTLKDCANKSEILTDQRTLKLRIKVKSDILAKKNAAIYSGLGLDDSPSPSMENSHEESEDMPHVSQETPEESPTSIVQVMTSFTIPGGVLISPLHDSLLYLIRKEKALGNIKPMSSLNGNRTPDRKDFLSNDLRCTPLSSSICDAGETAEVTVKGFEVSKEVDGVKCRMVSTEAVKEDSLESISGQDFDKIEKQNTGSGFMKNVLEHKMIISQNNNSTNPKTNSKCNTFAISKRIKCDALKCKVDQDTQKCETNQEGKVKSESKNESKGERSPGNVMTLAEKDSIGTSNNAMVNDRKRTSIDVTSLKSKMHKIKSLKVNKVRDCDRDSLKGKKSQQKVDRINPTDGPTLNKATVNSSLDHVDKSAYRVKGNERPSGNKVVNQLSAGPCVKDAPGAFPIAENKPTSEMVLSSEAATPQVIEEDWVCCDSCQKWRLLPMGLKPEQLPEKWLCSMLYWLPGMNRCNISEEETTKALYALYQMPISEGQNNMQSHAAGPETGVGSVDALQLGLNRKKSSSDVMLDRGKKKHGINEKTRSGVNNDMHRLSNNAQESVKNRSLNEMNKQSTDSNRIKKSISKHSSRLNNLIEEKNTPKVKEKQMNGGDRNHVRLKRKMEDNQHGSGTPKKSKAEDVCYADKPLNPGMEFKKVGLISRNSLPTKASGRNMRKYDDYCWSDDLVDKLVVPVKKGDRAQFSSDDGSLDATNTRKSGSIKKRKMADWLDNEKHNKTLSLEGNMQCGKEGNANKKEK

SEQ ID NO: 119261 - protein, 852 aa, Glycine max
  Coding DNA Sequence Number=SeqID_27576
  Gene Ontology: Mol. function=DNA binding; Cellular component=nucleus; Biological process=negative regulation of cell cycle
  Homolog annotation: Hit_ID=Q6A332; Match level="QueryCoverage=96%, HitCoverage=70%, E-value=1e-170, Identity=45%"; Hit description =Always early protein 3
  Pfam annotation: Domain name=DIRP; Domain location=640-741; Score =199.0; E_value=1.1e-56; Accession=PF06584.4; Description=DIRP
  Pfam annotation: Domain name=Myb_DNA-binding; Domain location=53-98; Score=35.0; E_value=2.7e-07; Accession=PF00249.22; Description=Myb -like DNA-binding domain
  Pfam module annotation: Pfam domain module=DIRP::Myb_DNA-binding; Domain location=640-741::53-98
MAPSRKSRSVNKRFSTVREAASSKDKITENASKNRLKVSPGIQKKRKLADMLGPQWNKEELEHFYEAYRKYGKDWKKVALAVHNRSVEMVEALYTMNRAYLSLPEGTASVVGLIAMMTDHYSVLGGSDSGKESNDDAEISKKSQKRLRGKHLSDSKALEGHFSDHSQSHSVASGDGCLSLLKKRHSGIRPHAVRKRTPRVPISYSIGKDNGDRFFSSARQGSKQMVDTNDVAHKIALALTEASQRGGSSKISGSPDKKFVPSLGLKSGKKHPKSEIAGANFCSSDLDDGSSELSLGSTEGNNEDYSRKTIHRSGRENTGRERNQEKKIKKYGKNFETGENLNKHLNDVKEASSGTDDGKNLSFIKSDFVTDFADAKNARSSYKGSRTKSKKLRLEKDEGSAFDALKTLADLSLMLPVTNPDTESSAQFKEGNHDAVDESKMETHKVFPRIESTASSKLGKVFSDNGVAVPEAEGAHQLNAGFRKRKQKSFNLKYDEIHTGSHLSGSQKSKATDEVKKSIVKGKRSSVSTAHSRQLKGVKSLGNLSSSANDKGEKDDSSFSLMKVSSTNQGGPLNRGKPRRKMEKPKPMVQQDLVVSRNIFSSQHKKSIASLQDGSYSQKGKLINCLSSYQMRRWCTLEWFYSAIDYPWFSKREFVEYLDHVGLGHVPRLTRIEWGVIRSSLGRPRRFSEQFLIEEKNKLNQYRESVRSHYAEILSGTKEGLPTDLAQPLIVGQRVIAIHPKTREIHDGSVLTVDHCRYRVQFDQPELGVEFVMDIDCMPLYPFENMPTSLIQHNISSAQINQDFIELKPNGKLKQRKVAGHTILSPSENLDTIKNLHIPPTMHGSSTLSKQV

SEQ ID NO: 119262 - protein, 389 aa, Glycine max
  Coding DNA Sequence Number=SeqID_27577
  Homolog annotation: Hit_ID=A7NW77; Match level="QueryCoverage=69%, HitCoverage=91%, E-value=1e-107, Identity=70%"; Hit description =Chromosome chr5 scaffold_2, whole genome shotgun sequence
  Subcellular localization annotation: CTP_CleavageSite=64; ConfidenceScore=5.13e-01
MQVFSNARRASWLLLFPHLRTSEAPHSTALSLFSGLAQRDSRQVNTDPVHCLSKAFFSSGMDTVEATPSEDVKELYDKMLDSVKVKRSMPPNAWLWSMIANCKQQHDIRLLFDILQNLRRFRLSNLRIHDNFNCNLCREVAKACVHAGALDFGMKALWKHNVYGLTPNIASVHHLLTYAKNHNDTKLLVEVMKLLKKNDLPLQPGTADIIFSICYNTDDWELINKYAKRFVMAGVKLRQTSFETWMEFAAKRGHTESLWKIEKLRSESMKQHTLITGFSCVKGLLLERKPSDAVAVIQVLNQTLSDTKKSGIKGELQKLVSEWPLEVIKHQKEEDRKALSASLKSDILVMFGRPGQKGMYSTIAWSSEFDDIVFQNVLVCRVSPYQDAS

SEQ ID NO: 119263 - protein, 1070 aa, Glycine max
  Coding DNA Sequence Number=SeqID_27578
  Gene Ontology: Mol. function=nucleic acid binding; Cellular component= chromatin remodeling complex; Biological process=ATP-dependent chromatin remodeling
  Homolog annotation: Hit_ID=A7NW74; Match level="QueryCoverage=91%, HitCoverage=96%, E-value=0.0, Identity=78%"; Hit description =Chromosome chr5 scaffold_2, whole genome shotgun sequence
  Pfam annotation: Domain name=HAND; Domain location=750-837; Score =24.1; E_value=2.4e-08; Accession=PF09110.2; Description=HAND
  Pfam annotation: Domain name=Helicase_C; Domain location=533-604; Score=63.9; E_value=5.4e-16; Accession=PF00271.22; Description =Helicase conserved C-terminal domain
  Pfam annotation: Domain name=Myb_DNA-binding; Domain location=838 -884; Score=20.9; E_value=0.0047; Accession=PF00249.22; Description =Myb-like DNA-binding domain
  Pfam annotation: Domain name=SLIDE; Domain location=893-1006; Score =236.1; E_value=7.8e-68; Accession=PF09111.1; Description=SLIDE
  Pfam annotation: Domain name=SNF2_N; Domain location=187-478; Score =200.0; E_value=5.6e-57; Accession=PF00176.14; Description=SNF2 family N-terminal domain
  Pfam module annotation: Pfam domain module=HAND::Helicase_C::Myb_DNA -binding::SLIDE::SNF2_N; Domain location=750-837::533-604::838 -884::893-1006::187-478
MGRPSKTQVSNEFSSEEEKEEASAAAANHEIEDDDEELEAVARYVSSDDDDNSPDEAAEDDDEDKQDESNVDPEVSKREKARLREMQQLKKQKVQEILDAQNATIDADMNNRGKGRLNYLLQQTELFAHFAKGDQSSQKKAKGRGRHASKVTEEEEDEEYLKGEEDGLANTRLVTQPSCIQGKMRDYQLAGLNWLIRLYENGINGILADEMVGSRCWPQINHIQVAAYEYKYLLTCNLMEYELIVKSHGPHMVVAPKSTLGNWMNEIRRFCPVLRAVKFLGNPDERKHIREELLVAELTLVQNNEAIQYKLSTPHNWHTITDLEVDYIRVGMSASEEKAGAAPIVEKMVETCLGWFNHNNLHELWALLNFLLPEIFSSAETFDEWFQISGENDEHEVVQQLHKVLRPFLLRRLKSDVEKGLPPKKETILKVGMSQMQKQYYKALLQKDLEVVNAGGERKRLLNIAMQLRKCCNHPYLFQGAEPGPPFTTGDHLITNAGKMVLLDKLLPKLKERDSRVLIFSQMTRLLDILEDYLMFCGYQYCRIDGNTGGDDRDASIEAFNKPGSEKFVFLLSTRAGGLGINLATADVVILYDSDWQDRAHRIGQKKEVQVFRFCTEYTIEEKVIERAYKKLALDALVIQQGRLAEQKTVNKDELLQMVRFGAEMVFSSKDSTITDEDIDRIIAKGEEATAELDAKMKKFTEDAIKFKMDDTAELYDFDDENEENKFDFKKIVSENWVEPPRRERKRNYSESEYFKQTMRQGGLTKPKEPRIPRMPQLHDFQFFNTHRLSELYEKEVRYLMQTHQKNQVKDSIDVDEPEVPLTAEELEEKEQLLEEGFSSWSRKDFNAFIRACEKYGRNDIKGIASEMEGKTQEEVERYAKVFKERYKELNDYDRIIKNIERGEARISRKDEIMKAIGKKLDRYRNPWLELKIQYGQNKGKLYNEECDRFMICMIHKLGYGNWDELKAAFRMSPLFRFDWFVKSRTTQEITRRCDTLVRLVEKENQEYDERERQARKEKKIAAKSMTPSKRSMPRQSESPSLKKRKQLTMDDYLSSKSHCDFPEADFMVL

SEQ ID NO: 119264 - protein, 399 aa, Glycine max
  Coding DNA Sequence Number=SeqID_27579
  Gene Ontology: Cellular component=integral to membrane
  Homolog annotation: Hit_ID=A7NW78; Match level="QueryCoverage=44%, HitCoverage=90%, E-value=3e-32, Identity=44%"; Hit description =Chromosome chr5 scaffold_2, whole genome shotgun sequence
  Pfam annotation: Domain name=DUF588; Domain location=16-171; Score =164.7; E_value=2.4e-46; Accession=PF04535.3; Description=Domain of unknown function (DUF588)
  Pfam annotation: Domain name=HLH; Domain location=248-296; Score =21.4; E_value=0.00082; Accession=PF00010.17; Description=Helix-loop -helix DNA-binding domain
  Pfam module annotation: Pfam domain module=DUF588::HLH; Domain location=16-171::248-296
MEGVESKEREVMVAKPVAVGVSDLLLRLLAFTVTLVAAIVIAVDKQTKVVPIQLSDSLPPLDVPLTAKWHQMSAIVYFLVTNAIACTYAVLSLLLALVNRGKSKGLWTLIAVLDAFMVALLFSGNGAAAAVGVLGYKGNSHVNWNKVCNVFGKFCDQMAASIGVSLIGSLAFLLLVIIPGEYKDTRRSSEESILTKMQGHAETNNSIMAPLSQIPPSSSLHPSNIAETGNIYTTTSRKRVKKMDHTNCESLNVERERRSKMTQMFTQLQTTVPGVLPQATREVIINETIKYIKELEMKMQKLEELKESMKEGSILLACGNNNMNCSVTVSVSANVAFFGIQSLPRSGLVSVIMKVFCKHRAEILAANVSVNNGKLILAITAMVQNGGVVENIRRQILSL

SEQ ID NO: 119265 - protein, 408 aa, Glycine max
  Coding DNA Sequence Number=SeqID_27580
  Gene Ontology: Mol. function=nucleic acid binding; Cellular component= SWI/SNF complex; Biological process=regulation of transcription from RNA polymerase II promoter
  Homolog annotation: Hit_ID=A7NW95; Match level="QueryCoverage=99%, HitCoverage=28%, E-value=0.0, Identity=80%"; Hit description =Chromosome chr5 scaffold_2, whole genome shotgun sequence
  Pfam annotation: Domain name=DEAD; Domain location=22-180; Score= -38.5; E_value=0.031; Accession=PF00270.20; Description=DEADDEAH box helicase
  Pfam annotation: Domain name=ResIII; Domain location=18-174; Score =4.3; E_value=2.1e-05; Accession=PF04851.6; Description=Type III restriction enzyme, res subunit
  Pfam annotation: Domain name=SNF2_N; Domain location=24-306; Score =356.4; E_value=4.9e-104; Accession=PF00176.14; Description=SNF2 family N-terminal domain
  Pfam module annotation: Pfam domain module=DEAD::ResIII::SNF2_N; Domain location=22-180::18-174::24-306
MAHSIKESIAEQPSSLQGGKLREYQMNGLRWLVSLYNNHLNGILADEMGLGKTVQAKNDRGPFLVVVPSSVLPGWDSEINFWAPGVHKIVYAGPPEERRRLFKERIVQQKFNVLLTTYEYLMNKHDRPKLSKIHWHYIIIDEGHRIKNASCKLNADLKHYQSSHRLLLTGTPLQNNLEELWALLNFLLPNIFNSSEDFSQWFNKPFESAGDSSPDEALLSEEENLLIINRLHQVLRPFVLRRLKHKVENELPEKIERLIRCEASSYQKLLMKRVEENLGSIGNSKARSVHNSVMELRNICNHPYLSQLHAEEVDNFIPKHYLPPIIRLCGKLEMLDRLLPKLKATDHRVLFFSTMTRLLDVMEEYLTLKQYRYLRLDGHTSGGDRGALIDLFNQPGSPYFIFLLRKFG

SEQ ID NO: 119266 - protein, 594 aa, Glycine max
  Coding DNA Sequence Number=SeqID_27581
  Homolog annotation: Hit_ID=A7NWB1; Match level="QueryCoverage=97%, HitCoverage=84%, E-value=0.0, Identity=55%"; Hit description =Chromosome chr5 scaffold_2, whole genome shotgun sequence
  Pfam annotation: Domain name=IU_nuc_hydro; Domain location=128-415; Score=-63.2; E_value=6.6e-06; Accession=PF01156.10; Description =Inosine-uridine preferring nucleoside hydrolase
MRCWVAVAVAVTALIITGGGRGCAPHRILVDTDVDTDDFFALLYLLKLNTSQFQLELILYNVSNIFWMSFNEKLKEKYKRKAKKGISISANAWTSAGHAVNQIYDLLYMMGRDDVAVGVGGEGGILQNGTILPNVGGYLPIIEQGMTTVGGCRYRRAIPVGLGGRLDIDANYGIRKAFLPQGTRKYTPLQQPTAQEVLIEKISAGPITLLVIGAHTNIAIFLMNNPHLKKNVEHIYIMGGGVRSSNPTGCCPKNASSTCVPRQCGDRGNMFTDYNTNPYAEFNIFGDPFAAYQTWMILPQVIHSGIPITLVPLDATNTIPINEQFFDAFEKSQDTYEAQYIFKSLKMARDTWFDNEFYSSYFMWDSFAAGIAVSIMSKPNNQKGENEFAEMEYMNITVITSNKPYGVSDGSNPFFDGRRVPKFNLEKGGVHSGHVQQGLRDPLCFVNNGKGKCQDGYTAEVSGPDSVRVLVATKAKPNKDVGSSLDREYFISFLNVLKHPQNTGRFNFTTQFPYYKEVTYKPDFENKTPGKPVVFDMDMSAGDFLALFYLLKVPVQVIDLKAIIVSPTGWTNSATIDVIYDLLHMMGRDDIPVV

SEQ ID NO: 119267 - protein, 1003 aa, Glycine max
  Coding DNA Sequence Number=SeqID_27582
  Gene Ontology: Mol. function=heat shock protein binding; Cellular component=endoplasmic reticulum membrane; Biological process =response to stress
  Homolog annotation: Hit_ID=A7NW98; Match level="QueryCoverage=93%, HitCoverage=99%, E-value=0.0, Identity=47%"; Hit description =Chromosome chr5 scaffold_2, whole genome shotgun sequence
  Pfam annotation: Domain name=DnaJ; Domain location=130-191; Score =96.0; E_value=1.2e-25; Accession=PF00226.22; Description=DnaJ domain
MNMSTMIYDGVCLSLSLSEPRSHSRVNLKSTSVYRLGDWWDVGLNVASLGHSIHYNIFPSGSLMDCNKEEALRAKDIAEKKMENRDFVGARKIALKAQQLYPDLENIAQMLVVCDVHCSAEQKLYGNEMDWYEILQVEQTAGDAIIKKQYRKFALQLHPDKNNFAGAEAAFKLIGEAQRVLLDREKRSLFDMKLRVPMNKPAMSRFDSTVRNNVRSHSTSSNARQQQQQSRQPAQQQQQNGDRPTFWTVCPFCSVRYQYYKEILNKSLCCQNCKRPFFAYEVNVQSTSSPASNSTQQASDQQKDGLNHGTFKMGAGSHGNSQAEKSNMGPYDKKRPSNVSGKPYGKRKRKQVAESSEGSDSMRTNDSEEDIVAGKDGNSGVENHSTSREGLPRRSTRQKHQVSYKENVKNSDNGFLKPRGDGESHGETTKINDQNGLAPELKEVKQKQHLYSERNEETKTDKGKDAVGGSTQMDGTSEHSPDSTSKAENHPNVYVYPDAEFSDFDKGKNKECFTAGQIWAIYDTSEGMPRFYALIRKVLSPGFRLQIIWFEPHPDCKDEINWVNEEMPVACGKYKLSDIDITEDHLMFSHPVLCEKISRNTFKVYPRKGETWALFKNWDIKWYMDVKSHQLYEYEIVEILTDYVEGEGVYVAYMAKLKGFELFRFSHRVPSFKMTGQEGVGVPAGSYELDPGALSVNLEEIAVPETSDVKVGHSSSGLVNTSPSDRSELLMTSEGDASIPKVNLERSNLARENKDSVDDSDNCCAPPVLSSETIEVPDTQFFDFDAGRALEKFQIGQIWAFYSDEDGLPKYYGQIKKIATSPDLELHVYWLTSCWLPENTINWDDKDILISCGRFEVNKTDDLLSVYSTTSCVSHQVHADAVGKNKNYAIFPRKGEVWALYRKWTNKMKCFEMENCEYDIVEVVEETDLSINVLVLEFVSGYTSVFRGKSNEGSSVNLRIPREELLKFSHQIPAFKLTEEHGNLKGFWELDPGALPMHYYGLK

SEQ ID NO: 119268 - protein, 31 aa, Glycine max
  Coding DNA Sequence Number=SeqID_27583
MPADEEERDFLHIKIQTAISALNDPLSPMSI

SEQ ID NO: 119269 - protein, 328 aa, Glycine max
  Coding DNA Sequence Number=SeqID_27584
  Gene Ontology: Mol. function=hydrolase activity, acting on glycosyl bonds; Biological process=metabolic process
  Homolog annotation: Hit_ID=A7NWB1; Match level="QueryCoverage=98%, HitCoverage=89%, E-value=1e-121, Identity=48%"; Hit description =Chromosome chr5 scaffold_2, whole genome shotgun sequence
  Pfam annotation: Domain name=IU_nuc_hydro; Domain location=2-306; Score=-120.2; E_value=0.0038; Accession=PF01156.10; Description =Inosine-uridine preferring nucleoside hydrolase
MGRDDIPVGLGDVFAMNQSDPIFPPVGECKYVKAIPHGSGGLLDSDTLYGLARDLPRSPRRYTAENSVKFGAPRDTDHPELRQPLAMEVWNSVLQRTKPRSKITVLTNGPLTNLAKVVSVKNIRSRIQEVYVVGGHISSNVNDKGDIFSVPSNQYAEFNMFLDPLAAKIVFESEVNITLIPLNTQRRVRSFSTIIGELRRTPRTPEAVFSERLLSRLYRLKQTHNRYQHMDTFLGEILGAVVLAESHSGLNPKFEAKAVKVLADGNESSDGKTVVDEKGGKLMRILSSVDAKAYHSLYAKKLGDENQSAKIGSFEEQRRKWSHPHIIN

SEQ ID NO: 119270 - protein, 209 aa, Glycine max
  Coding DNA Sequence Number=SeqID_27585
  Homolog annotation: Hit_ID=A7NWB9; Match level="QueryCoverage=88%, HitCoverage=96%, E-value=1e-49, Identity=52%"; Hit description =Chromosome chr5 scaffold_2, whole genome shotgun sequence
  Pfam annotation: Domain name=DUF679; Domain location=24-185; Score =279.1; E_value=8.7e-81; Accession=PF05078.3; Description=Protein of unknown function (DUF679)
  Subcellular localization annotation: CTP_CleavageSite=58; ConfidenceScore=5.85e-01
MAADNPTRKTNSTSKNGGKGVTNTTFSAFGSLIKLLPTGTVFVFQFLNPVVTNSGECNATNKWLSSIVLVACGLSCAFSSFTDSYIGSDNQRHYGIVTPKGLWPFSEPEKSKSVDKLWLGDFVRAALSLLVFAVLGLLDTNTVHCFYPGFEVTQKSLLQVLPTAIGVFAGGVFMIFPDKRNGIGYPLNSNSDSNHTSNISDETAPIDNA

SEQ ID NO: 119271 - protein, 346 aa, Glycine max
  Coding DNA Sequence Number=SeqID_27586
  Gene Ontology: Mol. function=transferase activity, transferring hexosyl groups; Cellular component=integral to membrane; Biological process=carbohydrate biosynthetic process
  Homolog annotation: Hit_ID=A7NWC9; Match level="QueryCoverage=93%, HitCoverage=91%, E-value=1e-151, Identity=79%"; Hit description =Chromosome chr5 scaffold_2, whole genome shotgun sequence
  Pfam annotation: Domain name=Glyco_transf_8; Domain location=61-320; Score=314.5; E_value=1.9e-91; Accession=PF01501.11; Description =Glycosyl transferase family 8
  Subcellular localization annotation: CTP_CleavageSite=26; ConfidenceScore=5.21e-01
MVFRSSTSLIGLLSLLFLLSVSSAIRLGLVRRPSPELPLFREAPAFRNGEDCGSSPSATINVAMTLDTNYLRGTMAAVLSMLQHSTCPENLAFHFLSSHDDPPELFSSILSTFPYLKMKIYPFDSNRVRGKISKSIRQALDQPLNYARIYLADTIPENVKRVIYLDSDLVVVDDIAKLYGVDMKGKVVAAPEYCHANFTLYFTDNFWSDPVLAKTFRGRKPCYFNTGVMVMDVDTWRKERYTEKVEEWMAVQKQQKRIYHLGSLPPFLLVLAGNIKAVDHRWNQHGLGGDNFEGKCRSLHPGPISLLHWSGKGKPWLRLDSRKPCIVDHLWAPYDLYRSSRHFFEE

SEQ ID NO: 119272 - protein, 97 aa, Glycine max
  Coding DNA Sequence Number=SeqID_27587
MPRRIVLSRTIERRWQQAGIRTKSELEGKKRNKKKPNVYFKNENSKALFPFEMECTEKEGKAVLNLISSEEDNCASSSSSSSSPTNLKLFSFLSDLI

SEQ ID NO: 119273 - protein, 243 aa, Glycine max
  Coding DNA Sequence Number=SeqID_27588
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=A7QPD2; Match level="QueryCoverage=96%, HitCoverage=23%, E-value=7e-62, Identity=49%"; Hit description =Chromosome chr18 scaffold_137, whole genome shotgun sequence
  Pfam annotation: Domain name=DEAD_2; Domain location=93-238; Score =45.1; E_value=2e-10; Accession=PF06733.6; Description=DEAD_2
MIFASNPNPKKVYLIGGLQVEFPYQPYGSQFAFMARVISTLNLAQKEGHCHTLLESPSGTAIVLLLVSEIPDHTQFEINNKKQKKKEAPTIYYASRRTHSQISQVVRELRKTAYRVPMAVLVLMKTENKLLLKDQATGCPEFKNAHKVKGHPSLQKGGCNVVRDRRSCKSWTIGCCYYGARSMSNDAQLVFCPYNYINNPVIRAPMEVDIKVGIVILDEAHNMEDITCDAGSVDNEDVLDSML

SEQ ID NO: 119274 - protein, 83 aa, Glycine max
  Coding DNA Sequence Number=SeqID_27589
MIYHCDSSLEQASSKAGNYIPYIEALAKGAPTKIEGARMRKENNRKVENDDNAVLHDGKQHANSIFPMNQYPPDSSAPSNRFC

SEQ ID NO: 119275 - protein, 188 aa, Glycine max
  Coding DNA Sequence Number=SeqID_27590
MAGKFDPKDYPNAIDRMLGKKLAFRFKAIPTEVISKARKEISCLSVRKNYYMDGSQCFFATAELDPYNAQSVTPVKRLSSQSNSKYSVNVGRRPIFGTDHVKKVAEADVKGTELTFPSNSVASEGNMTWFWSDGHKKGWVKLMNRATGNRWVRTTLVSFAVPIPFIFPRKGSDEDNHFLGPHTPPPSL

SEQ ID NO: 119276 - protein, 164 aa, Glycine max
  Coding DNA Sequence Number=SeqID_27591
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=O24464; Match level="QueryCoverage=80%, HitCoverage=57%, E-value=3e-55, Identity=77%"; Hit description =Adenylate kinase
  Pfam annotation: Domain name=ADK; Domain location=1-111; Score=54.7; E_value=3.2e-13; Accession=PF00406.13; Description=Adenylate kinase
MIMNTIREGKIVPSGVTVKLILREMKSSDNHKFLIDGFPRSQENRIAFEQIIGAEPDMVLFFDCPEEEMVKRVLSRNQGRIDDNIDTIKNRLKVFESLNLPVIDYYAKKGKLYRINAVGTVDEIFEHVRPVFEACEETALVAFFPFLMPSKEWPIGGAKLSLAT

SEQ ID NO: 119277 - protein, 387 aa, Glycine max
  Coding DNA Sequence Number=SeqID_27592
  Gene Ontology: Mol. function=DNA binding; Cellular component=nucleus; Biological process=regulation of transcription
  Homolog annotation: Hit_ID=A7Q4Y6; Match level="QueryCoverage=95%, HitCoverage=100%, E-value=1e-123, Identity=60%"; Hit description =Chromosome undetermined scaffold_51, whole genome shotgun sequence
  Pfam annotation: Domain name=NAM; Domain location=26-155; Score =313.0; E_value=5.7e-91; Accession=PF02365.6; Description=No apical meristem (NAM) protein
MAQVTGRADIWWRTKEWENMNTFTHVPPGFRFHPTDEELVDYYLRKKITSGRIDLDVIKDVDLYKIEPWDLQEICRIGTEEQNEWYFFSHKDKKYPTGTRTNRATAAGFWKATGRDKAIYSKHELIGMRKTLVFYKGRAPNGQKSDWIMHEYRLETDENGTPQATTISHNLVNYLASIFTTFFLEEGWVVCRVFKKRVTTMRKVSEHDSPCWYDDQVPFMLDLDSPKQTSQSNLVYQLPYPCKQELDLPYQLPRDHFLQLPLLESPKLLQSASAITPNNPMAAYVLDHVNHSTSLLPPSLIQEEQQNFQATYGNSNSNEQAVDPVIDWRVLDKFVASQLSQDASKDNIFQGTDNSNVQFRHLDKQELVVPEQNASTSNSSCPIDLWK

SEQ ID NO: 119278 - protein, 411 aa, Glycine max
  Coding DNA Sequence Number=SeqID_27593
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=A7Q4Y9; Match level="QueryCoverage=89%, HitCoverage=89%, E-value=1e-163, Identity=76%"; Hit description =Chromosome undetermined scaffold_51, whole genome shotgun sequence
  Pfam annotation: Domain name=Trehalose_PPase; Domain location=124 -368; Score=337.5; E_value=2.4e-98; Accession=PF02358.7; Description =Trehalose-phosphatase
  Subcellular localization annotation: CTP_CleavageSite=54; ConfidenceScore=5.12e-01
MDLKSNHTPVLTDAAPVTKSRLGVHSSLLPYSHAGTTFTHGMLLTIPRKKTGILEDVRSSGWLDAMKSSSPPARKITKDVGHGFASSDSETAGAYFSWLLKYPSALASFDQIMNYAKGKRIALFMDYDGTLSPIVDNPDCAFMSDNMRAAVKKVAEYFPTAIISGRSRDKVYQFVGLTELYYAGSHGMDIIGPVRQSVSDNHPNCIRSTDKQGKEVNLFQPAAEFLPMINEVLNSLEECTKDIKGAKVENNKFCVSVHYRNVDEKYWDLVGQHVHDVLKGYPRLRLTHGRKVLEIRPVINWDKGKAVTFLLESLGLNNCDDVLPIYIGDDQTDEDAFKVLREGNKGYGILVSSAPKESNAIYSLRDPSEKHSKRFTGADLRTEEPLLVTTALSLPSFFARSSCGSCKFVNS

SEQ ID NO: 119279 - protein, 277 aa, Glycine max
  Coding DNA Sequence Number=SeqID_27594
  Gene Ontology: Mol. function=small protein conjugating enzyme activity; Cellular component=cytoplasm; Biological process=protein transport
  Homolog annotation: Hit_ID=Q0WWQ1; Match level="QueryCoverage=100%, HitCoverage=90%, E-value=1e-105, Identity=70%"; Hit description =Autophagy-related protein 3
  Pfam annotation: Domain name=Autophagy_C; Domain location=189-277; Score=54.8; E_value=2.9e-13; Accession=PF03987.6; Description =Autophagocytosis associated protein, C-terminal domain
  Pfam annotation: Domain name=Autophagy_N; Domain location=6-159; Score=224.0; E_value=3.5e-64; Accession=PF03986.4; Description =Autophagocytosis associated protein, N-terminal domain
  Pfam module annotation: Pfam domain module=Autophagy_C::Autophagy_N; Domain location=189-277::6-159
MVLTQKLHEAFKGTVERITGPRTVSAFKEKGVLSVSEFVTAGDNLVAKCPTWSWESGDPGKRKPYLPPEKQFLITRNVASYLTVPCLRRAASVEEEYEAAGGEVLLDDEDNDGWLATHGKPKGMYYLYWTGGFLEISKKGSIKQIHSYMGAEEGEDIPDMAEFDDTSNVENDPATLQSTYLVAHEPDDDNILRTRTYDISITLVTDLVIPCSILWQSRMLLQPELVLEDVSQDHARKTDHPHLPGKHASIHPCRHGAVMKKIIDVLMSRGVEPEVDK

SEQ ID NO: 119280 - protein, 150 aa, Glycine max
  Coding DNA Sequence Number=SeqID_27595
  Gene Ontology: Mol. function=two-component sensor activity; Cellular component=chromosome; Biological process=chromosome organization and biogenesis
  Homolog annotation: Hit_ID=A7PBP7; Match level="QueryCoverage=78%, HitCoverage=25%, E-value=3e-43, Identity=73%"; Hit description =Chromosome chr16 scaffold_10, whole genome shotgun sequence
  Pfam annotation: Domain name=SMC_N; Domain location=13-148; Score= -108.8; E_value=0.0012; Accession=PF02463.10; Description=RecFRecNSMC N terminal domain
MVSHTLHQPTAGIVKQLRLENFMCHSKHETEFGNHVNFITGQNGSGKSTILAALCVAFGCRAKETQRTSTLKDFIKTGATDAVIQVEIQNEGEGAFKPEIYGPVIIVERRISESTSSATLKDHQVDNTLIFMRYRAHPVSKHHYEVKQMD

SEQ ID NO: 119281 - protein, 146 aa, Glycine max
  Coding DNA Sequence Number=SeqID_27596
  Gene Ontology: Mol. function=unfolded protein binding; Cellular component=prefoldin complex; Biological process=protein folding
  Homolog annotation: Hit_ID=A7QWI6; Match level="QueryCoverage=84%, HitCoverage=100%, E-value=5e-42, Identity=65%"; Hit description =Chromosome chr10 scaffold_204, whole genome shotgun sequence
  Pfam annotation: Domain name=Prefoldin_2; Domain location=14-119; Score=104.6; E_value=3e-28; Accession=PF01920.11; Description =Prefoldin subunit
MSSSNLRDLQRELENKANDLSKLQKEIAKNHQMRKKYTLQLGENELVLKELDLLKDDTNVYKLIGPVLVKQDLAEANANVRKRIEYISAELKRLDATVQDLEEKQNSKKDAILKLQQRIQSLQAGKGKAYHLLQGLLFVEKPLAFF

SEQ ID NO: 119282 - protein, 1166 aa, Glycine max
  Coding DNA Sequence Number=SeqID_27597
  Gene Ontology: Mol. function=nucleic acid binding; Cellular component= nucleus; Biological process=regulation of transcription, DNA-dependent
  Homolog annotation: Hit_ID=Q9LK10; Match level="QueryCoverage=63%, HitCoverage=62%, E-value=1e-174, Identity=46%"; Hit description =Similarity to DNA repair protein
  Pfam annotation: Domain name=Helicase_C; Domain location=997-1076; Score=65.2; E_value=2.1e-16; Accession=PF00271.22; Description =Helicase conserved C-terminal domain
  Pfam annotation: Domain name=ResIII; Domain location=571-802; Score= -14.2; E_value=0.00075; Accession=PF04851.6; Description=Type III restriction enzyme, res subunit
  Pfam annotation: Domain name=SNF2_N; Domain location=577-972; Score =6.6; E_value=3.8e-09; Accession=PF00176.14; Description=SNF2 family N-terminal domain
  Pfam module annotation: Pfam domain module=Helicase_C::ResIII::SNF2 _N; Domain location=997-1076::571-802::577-972
MYRGVPVACRTRSKRGRVVGSGLIMGQKKKKVHDHEPVSLKRVRVSERGFDCSGGHAGDPIVIGDSGDDVSEAEEGLRHTEKRFLVEKEWKSEEGKRCSVFVDKVDNFGNDDYACVPENRVILPDDSYGDNQSEKEHCADKSGSDDSFLCLTESEDGATSDEDFQVDYDENDCCSSSEDSDSSSYDDDERGGYSKTVKERVRKVEGETESSGVCKRKGGRKDNEEGEQWIGADCASATSSKSEIYKQEARNAAQKHESKRVKSANVDAEVFGDHWKSSGCSMPSEAEALEHRKKRDTGHQSASLQKKTEYSTMIKKNLDDHEGKKHHHVKGDSAKVVTKKDRKGRKHKYGFNSNKCEKVRVVDDETGDKDELHEVLRMPSRTKNRCFKLFNECFWGKNDSVKDDSNQLEEKDDDFGQGQTKPLASRETIPLDWNFMKKEPIENLEFEKELDILWGEMDMLLRGEEIGSQVDNIGTNEARENEENSASQCKHDTIFNEEIGIYCRWCGWIATEIKYITPPFVDSERCCRRVSSGGGNTSQFDGDLFNDPGDDSEAVWSHNEGTVWDLIPDIKQSLYPHQQEGFEFIWTNLAGTTDLAKLKRVDPCSEGGCIVSHAPGTGKTRLTMVFLQTYLQSFPKCLPIIIAPANILLTWEDELRKWNIGIPFHNLNNSELSGKEKLINEVDWSGNQKQNKDAIRMVKLCSWYKEKSILLISYNLYEKLAGSTAEGDGKKEKKNNKMKKKKKRARPREYIESGMGKVLRDYPGLLVLDEGHTPRNQNSYIWKVLSESRTKKRILLSGTPFQNNFLELYNILCLMKPSFPDSIPQELKKFCQSRQMQERKDVSWDWEPVSSGNTADEKIKLLKLLMNPFVHVHKGSILQKNLPGLRDCVLVLKPDILQQETLESIEYSQSALNFEHKLALVSVHPSLFLNCSLSKKEESVVDKGKLEKLRLNPYGGVKTKFLFEFIRLCDAVNEKVLIFSQFIDTLCLIKDQLESAFNWSVGTEVLYMYGKLDHKQKQSLIRSFNDSNSQAKVLLASIKASSEGINLIGASRVVLLDVVWNPSVERQAICRAYRLGQKRVVFTYHLLAQGTPECTKYCKQAEKNRLSELVFSNRNAESHKLKSSGVMLEDIEDRVLDLMVQHKKLKDMFGECLVQPKERYLETLGP

SEQ ID NO: 119283 - protein, 893 aa, Glycine max
  Coding DNA Sequence Number=SeqID_27598
  Gene Ontology: Mol. function=metal ion binding; Cellular component =nucleus; Biological process=transcription from RNA polymerase II promoter
  Homolog annotation: Hit_ID=A7Q276; Match level="QueryCoverage=100%, HitCoverage=100%, E-value=0.0, Identity=49%"; Hit description =Chromosome chr13 scaffold_45, whole genome shotgun sequence
  Pfam annotation: Domain name=PHD; Domain location=241-290; Score=6.3; E_value=0.0024; Accession=PF00628.20; Description=PHD-finger
  Pfam annotation: Domain name=PHD; Domain location=322-379; Score =24.5; E_value=1.8e-05; Accession=PF00628.20; Description=PHD-finger
  Pfam annotation: Domain name=zf-C3HC4; Domain location=156-200; Score= 13.3; E_value=0.0027; Accession=PF00097.16; Description=Zinc finger, C3HC4 type (RING finger)
  Pfam module annotation: Pfam domain module=PHD::PHD::zf-C3HC4; Domain location=241-290::322-379::156-200
MAFHVACPITCRRICFCTLGFPRALHASPDAPNAFVHDVSALRDFLADTRRDDATVQVLVPKVLPPLPPPSDAVPLGPDALDESASMKAKRIALQRKGAAAMIAAEEYARRFESGDVVLTTDEILMLNAWLESQAGGNTPGNLTGEEQGQANRSYCRICKCGENEGSEKAQKMLSCKSCGKKYHRNCLRSWGRNRGKKICFIGVHGPVLFAGFVRTFVQNGKVSICVSFFFINYKKVILYQACRRTGDPSKFMFCKRCDGAYHCYCLQPPHKSVCNGPYLCTKHARCHSCGSNVPGNGLSVRWFMAYTNCDACGRLFTKGNYCPVCLKVYRDSESTPMVCCDTCQLWVHCQCDNISEEKYHQFQVDGNLQYKCPTCRGECYQVKNPEDAAQEIWRRRNIAERDLISSLRAAAGLPTQEEIFSISPFSDDEDSGPLKLKSESARSFKFSLKNLANDSPKKKTSSKKTAKKKNSQSFMTSKIDTHNSCEGHSDIKSLHSLDDDKNDDIQSQRNEGPDVYSSPATGSLSQTEASFPINQPGILKQKFVDEVMVSDEERKPRVVRIKSNKAHIPDSEEESGKHSLKTQNVKGKKLVINLGARKINVASSPRSDSSSCQKDQDPVTVNGNEDRSQWRKGDKFALDRQDDTARHIDGKGIKVDSGQSKFFRVSGREGNLIKLGKVKPDISEFNLTSGRGNMSDGRIKHSIDGMINQVGIKATSRGERTYLGRQSEGSSDAYETDDNNNRTPSHSLPKDSKPLLRFKFKKPSIESQNSPHQEEEKMTIKGQRSKRKRPSPFKEKASFNESEGVSQSHQDSAMDGIMDANWILMKLGNDAIGKRVEVHQTSDNSWHKGLVTDVVEGTSKLYVALDDGKVKTVELRKQGVRFVPQKQKRSKT

SEQ ID NO: 119284 - protein, 109 aa, Glycine max
  Coding DNA Sequence Number=SeqID_27599
MALIVDSVNAESSKNNVACGAYIVVCTRLMGSKSSRWSVTWVVLFICLLLCFSAKAIATRNLAGYADEKGPSRRLLGRSPCKRGRMTSEVVQGDRKQQREDSPRCNNYL

SEQ ID NO: 119285 - protein, 891 aa, Glycine max
  Coding DNA Sequence Number=SeqID_27600
  Gene Ontology: Mol. function=binding; Cellular component=nucleus
  Homolog annotation: Hit_ID=A7Q273; Match level="QueryCoverage=96%, HitCoverage=93%, E-value=0.0, Identity=47%"; Hit description =Chromosome chr13 scaffold_45, whole genome shotgun sequence
MIGREDPTKGGQLDFPVKINHQQSQWIFRTNTIITSYLEQRCYRELRTENYQSVKVVICIYRKLLISCKDQMPLFASSLLSIIQILLDQPRQDEVQILGCQTLFDFVNNQRDGTYMFNLDGFILKLCNLAQEMGDDAKVQLLRAAGLQVLSSMVWFMGEFTHISAEFDNVVSVVLENYGDVKQDSQNENAMRLYSWRVVVNDRGEVNVPVDNATNPGFWSRVCIQNMAKLAKEGTTVRRVLESLFRYFDDTNRWSPEHGLALSVLLNMQSIIENSGHNTHLLLSILVKHLDHKNVLKNPKMQLDIVGVITHLAQQTRSQQSVAIIDAGPVIDTMAVLLENMSNITVMARTLIAAAFPEALFHQLLLAMVHADHETRVGAHRIFSVVLVPSSVCPQPSSSGTPMTKAAGIQRMLSRNVSVFSSSSALFEKLERKQNSLSEDSHTDGNVNDNSILNRLKSTYSRTTSTRKSAMISAESTDNKNSKVHNSSMMNRLKSSYSRATSAKKPQIPTTVEENTTNTSNKQQVLPIRLSSHQINLLLSSIWAQSIYPLNTSENFEAIAHTYSLVLLVARSKIVEKTWKNNSISIVYSAKTGITPFHPCEVDPFLQLVNDSKLQAVIDTDRQPSKVYGSKEDDEDALKALSAIRLTENQSKESFATMIVQSLGKSSNESSILREQLLNDFSPDDACPLGAQLSAETTGNMYQSGLKEDKLPDMVDISLFTIDDDIPPCGLESQANSDPQQQPSQNLSLLSVDDILGSVSETTHQVGRISISTPFDMPYKEMALHCEALLMGKQQKMSTFMGTHPMQGYFSFRIPAPEYNQQKDESSNSSVQQTLPSSGNPFLDSNFDSNSYHTLPDTSPRLCATAYQHQAAFFQLPASRPYDNFLKAAGC

SEQ ID NO: 119286 - protein, 1183 aa, Glycine max
  Coding DNA Sequence Number=SeqID_27601
  Gene Ontology: Mol. function=zinc ion binding; Cellular component =nucleus; Biological process=regulation of transcription, DNA -dependent
  Homolog annotation: Hit_ID=A7Q270; Match level="QueryCoverage=100%, HitCoverage=100%, E-value=0.0, Identity=50%"; Hit description =Chromosome chr13 scaffold_45, whole genome shotgun sequence
  Pfam annotation: Domain name=DUF1423; Domain location=712-1177; Score= 746.9; E_value=1.4e-221; Accession=PF07227.2; Description=Protein of unknown function (DUF1423)
  Pfam annotation: Domain name=PHD; Domain location=865-924; Score=9.8; E_value=0.00094; Accession=PF00628.20; Description=PHD-finger
  Pfam module annotation: Pfam domain module=DUF1423::PHD; Domain location=712-1177::865-924
  Subcellular localization annotation: CTP_CleavageSite=51; ConfidenceScore=5.13e-01
MKRLRSSEDLHSYGGDKGNGCKDSNNLNRSFSSAQRSFYYKPEYARKGLVSSSSSSSRYERDRTVEEDREGSRLVRKRSEHDFEAFDRRKGFDRYRESDRGLIHRSESFCGGGGSQRDQFPKGFRSERERSRREGSVSSWRRGLKDLDDRERVVRSPKGLRDAKSPSWSKDSVSESEQSKKRSSSSPRPSRDGNSIKSKSKSPTWSKDSESEQSKSVEVKKAEEESLQQVQSGSGSGSEMEEGELEPEPQAETVPPVSEDLPSVAMETDEKQAQKNECHPNDDSTDAAVDERRELSSKEEVKPNEEVGCCEVKDGEEIEADEMADVRDDLSEKMLVTETEVESVGNGDDDKKEEALDAGAECEEETKKGADVDKQDKDKNKVVDLGTGADVVKPELNDGVSTGNEVPKEVDREMMMESAVNIAKDKGKGVSVALVPPTNVVHALDDSLWLDRGSRDLPTCSVDVIEGPSTRGFELFSRSPVRKVEKVDHSVLNKHKDDMEQLDLTLSLPNVLLPIGAHETTSQAPGSPSQARSVQSLSNTFCTNSDGFTASMSFSGSQSFYHNPSCSLTKTSVDYEQSVGSRPLFGGIDQVSQGCWQGQSQSDPKQKEVPFGQRTSANGNGSLFQPQASWGVLDSQAVKGQHSRVLEGSSKMGSGLDRQLSFHKQFSGQSRRHDDVRSPSQSVGSHDIGSNYSFEKKREVRERGSGSLYRTTSQKEQEQLLVGGVDFVETIIARIVSEPVHAMSRKFHEMTGQSIVCLKEGIREIMLNADKHGQILAFQKVLLNRSDIILDVLLKCHRVQLEILVALKTGLTHFLHLESSISSSELAQIFLNLRCKNLSCRSQLPVDECDCKVCAQKNGFCRECMCLVCSKFDNASNTCSWVGCDVCLHWCHTDCGLRESYIRNGPGTKGMTEMQFHCIACDHPSEMFGFVKEVFQNFAKEWSVETLCKELEYVKRIFSASKDMRGRQLHEIAEQVLPRLANKSNLPEVLRHIMSFLSDGDSSKLPMTTNFSGKEQIKENNGVAGPSQEATWMKSIYSEKPPLLERPANILPTFDQNDKRTLVQELQMSSIQKDFCFDELESIVKIKQAEAKMFQSRADDARREAEGLKRIALAKNEKIEEEYTNRIAKLRLTETDEIRKQKFEEAQALERAHLEYLNMKMRMETDIKDLLSKMEATKMSLAM

SEQ ID NO: 119287 - protein, 203 aa, Glycine max
  Coding DNA Sequence Number=SeqID_27602
  Gene Ontology: Mol. function=tRNA binding; Cellular component =cytoplasm; Biological process=tRNA aminoacylation for protein translation
  Homolog annotation: Hit_ID=A7QB33; Match level="QueryCoverage=53%, HitCoverage=71%, E-value=2e-45, Identity=73%"; Hit description =Chromosome chr5 scaffold_72, whole genome shotgun sequence
  Pfam annotation: Domain name=tRNA_bind; Domain location=94-178; Score= 121.6; E_value=2.4e-33; Accession=PF01588.11; Description=Putative tRNA binding domain
  Subcellular localization annotation: CTP_CleavageSite=60; ConfidenceScore=5.87e-01
MVNALRVGSVISLYSLRNTRPHLPLLSNATRFRSKFPFFTLSSSPNPSGYPPFRTLSSSSASTDEAMTTETITSNNASGEADNSIKDAAGLLDMRVGRILRAWKHDEADSLYVEEVDIGEPEPRIICSGLVKYIPLENLQPRNMRGVKSCGMLMAASDAKHENVELLFPPEEATPGERIWFGTEDEKDNQPDAATPNQAIALP

SEQ ID NO: 119288 - protein, 46 aa, Glycine max
  Coding DNA Sequence Number=SeqID_27603
MQNSVFGHRSTSGSGPCCQAEDMKWKLVCKCLNSRQARFPSVEIEA

SEQ ID NO: 119289 - protein, 925 aa, Glycine max
  Coding DNA Sequence Number=SeqID_27604
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A7Q1Z0; Match level="QueryCoverage=100%, HitCoverage=89%, E-value=0.0, Identity=71%"; Hit description =Chromosome chr13 scaffold_45, whole genome shotgun sequence
  Pfam annotation: Domain name=Cation_ATPase_N; Domain location=92-169; Score=48.8; E_value=1.9e-11; Accession=PF00690.17; Description=Cation transporterATPase, N-terminus
  Pfam annotation: Domain name=E1-E2_ATPase; Domain location=186-427; Score=211.8; E_value=1.6e-60; Accession=PF00122.11; Description=E1 -E2 ATPase
  Pfam annotation: Domain name=Hydrolase; Domain location=431-760; Score=65.4; E_value=1.9e-16; Accession=PF00702.17; Description =haloacid dehalogenase-like hydrolase
  Pfam module annotation: Pfam domain module=Cation_ATPase_N::E1-E2 _ATPase::Hydrolase; Domain location=92-169::186-427::431-760
MEKYLRENFSVQPKNPSEDALLRWRSAVSVVKNPRRRFRMVANLAQRADAEQKRKKLQAPAGNRGGGSMLSKEIQEAGFGIEPDELASIVRSHDTKCLEHHEGVEGLARAVRVSLQQGVNTLDVQHRQNVYGFNRHAENPPRSFWMFVWDAMQDLTLIILMVCSFVSVGVGILTEGWPKGMYDGVGIILCILLVVFVTSICDYKQSLQFKDLDKEKKNVSIQVTRDSKRQKVSIHDLVVGDIVHLSIGDIVPADGLFTSGFGLLIDESSLSGESEAVNVDQEKPFLLSGTMVQDGSAKMLVTSVGVRTEWGRLMDTLNEGGDDETPLQVKLNGVATIIGKIGLCFAIVTFMVLTGRFLCGKIAHHEITKWSLNDASSLLNFFATAVIIIVVAVPEGLPLAVTLSLAFAMKKLMNDKALVRHLSACETMGSASCICTDKTGTLTTNHMVVDKIWICQQTKAIKIGNSENVLKSSISEHISDLLLQSIFQNTGSEIVKGQDGRNKIMGTPTESALLEFGLLLGGDSKFYNDKYKIVKVEPFNSIRKKMSVLVALPDGTNKYRAFCKGASEIVVKMCEKVVNADGKVVQLNEQQRNSVTEVINGFASQALRTLCIAFKDIEGSSGSDSIPEDKYTLIAIIGIKDPVRPGVKEAVKTCLEAGIVVRMVTGDNINTAKAIARECGILTDGIAIEGPDFRNKSPQELMNIIPKIQVMARSLPLDKHTLVKHLRDDFYEVVAVTGDGTNDAPALHEADIGLAMGIAGTEVAKENADVIVMDDNFATIVNVTRWGRAVYINIQKFVQFQLTVNVVALMLNFVSACVSAESISGSAPLTAVQMLWVNMIMDTLGALALATEPPHDGLMKMPPVGRNAKIITRVMWRNIIGQSIYQIIVLLVLKFRGKQILKLNGPDDATLLLNTVIFNTFVFCQ

SEQ ID NO: 119290 - protein, 457 aa, Glycine max
  Coding DNA Sequence Number=SeqID_27605
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=A7Q1Z1; Match level="QueryCoverage=100%, HitCoverage=100%, E-value=0.0, Identity=84%"; Hit description =Chromosome chr13 scaffold_45, whole genome shotgun sequence
  Pfam annotation: Domain name=NAD_Gly3P_dh_C; Domain location=275-426; Score=137.3; E_value=4.3e-38; Accession=PF07479.5; Description=NAD -dependent glycerol-3-phosphate deh
  Pfam annotation: Domain name=NAD_Gly3P_dh_N; Domain location=44-247; Score=-35.8; E_value=0.0014; Accession=PF01210.14; Description=NAD -dependent glycerol-3-phosphate de
  Pfam module annotation: Pfam domain module=NAD_Gly3P_dh_C::NAD_Gly3P _dh_N; Domain location=275-426::44-247
MFGNGEAVTHSACSNGSVQTVNGNLEEKLDELRLLMGKVDGDPLRIVGVGAGAWGSVFTAMLQEAYGGLREKVLIRIWRRPGRTVDRALAKHLFEVINSREDVLRRLIRRCAYLKYVEGRLGDRVLYADEILKDGFCLNMIDTPLCPLKVVTNLQEAVWDADIVINGLPSTETREVFEEISKYWKERITVPAIISLAKGVEAELGPEPRIITPTLMINQATGVPIENILYLGGPNIASEIYNKEYANARICGAEKWRKPLAKFLRQPHFIVWDNGDLVTHEVMGGLKNVYAIGAGMVAALTNESATSKSVYFAHCTSEMIFITHLLAEEPERLAGPLLADTYVTLLKGRNAWYGQKLAKGELSLEMGDSIKGKGTIQGVSAVKAFYELLSQSSLNVLNPEENELVAPVELCPILKMESPVEAILQALRDETMNDPRDRIEIAQSHVFYRPSLLGHQP

SEQ ID NO: 119291 - protein, 228 aa, Glycine max
  Coding DNA Sequence Number=SeqID_27606
  Gene Ontology: Cellular component=peroxisomal membrane; Biological process=peroxisome organization and biogenesis
  Homolog annotation: Hit_ID=A9PEL6; Match level="QueryCoverage=100%, HitCoverage=100%, E-value=8e-94, Identity=73%"; Hit description =Putative uncharacterized protein
  Pfam annotation: Domain name=PEX11; Domain location=5-226; Score =279.7; E_value=5.8e-81; Accession=PF05648.5; Description=Peroxisomal biogenesis factor 11 (PEX11)
MNDSVDKLVIFLAKRDGIDKLVKTFQYVSKLVNWHVEATHPDTSKRFKQWEVASGLSRKAFRTGRFLTGFNVLRRNPGSTLSLRLLAVLSNAGEMVYFFFDHFLWLARIGTIDASLAKKMSFISAFGESVGYVFFIIADFIMLKEGLKAERKLRRSSSKEKSEEEEKAVILKIRSDRIMRLMAVAANLADLFIAIAEIEPNPFCNHTVTLGISGLVSAWAGWYRNWPS

SEQ ID NO: 119292 - protein, 407 aa, Glycine max
  Coding DNA Sequence Number=SeqID_27607
  Gene Ontology: Mol. function=hydrolase activity, hydrolyzing O -glycosyl compounds; Cellular component=extracellular region; Biological process=carbohydrate metabolic process
  Homolog annotation: Hit_ID=A7Q7Y2; Match level="QueryCoverage=97%, HitCoverage=98%, E-value=1e-172, Identity=71%"; Hit description =Chromosome chr18 scaffold_61, whole genome shotgun sequence
  Pfam annotation: Domain name=Cellulase; Domain location=40-363; Score= -41.9; E_value=0.00035; Accession=PF00150.9; Description=Cellulase (glycosyl hydrolase family 5)
MTSIMNLTRSMVILSILISTLVCEARLLRVTPGFVQTKDTELVLNGSPFLFNGFNSYWMMNVAADPNQRYKVSNVFREASAIGLTVCRTWAFSDGGNQSLQISPGLYNEAMFQALDFVVAEAKKYRVRLIFSLVNNYNDFGGRPQYVQWANSSGVPVANDDDFYTNPVVKGYYKNHVKRILTRINTITKTAYRDEPTIMAWELINEPRCQVDYSGKTINAWVQEMAPYVKSIDPMHLLEVGMEGFYGDSIPDRQQYNPGFQVGTDFVSNHLIKEIDFATIHAYPDNWLTGQNDTMQMAFMQRWMTSHWEDSRTILKKPLVFTEFGKSKKDPGYSIHARDSFMNVVYSSIYSFAQNGGTFAGGLVWQLLDEGMDPYDDGYEIVLSQNPSTSSVISQQSSKMVALEHIH

SEQ ID NO: 119293 - protein, 527 aa, Glycine max
  Coding DNA Sequence Number=SeqID_27608
  Gene Ontology: Mol. function=transcription factor activity; Cellular component=plastid; Biological process=regulation of transcription, DNA-dependent
  Homolog annotation: Hit_ID=Q9SLX4; Match level="QueryCoverage=99%, HitCoverage=99%, E-value=0.0, Identity=65%"; Hit description=Sigma factor
  Pfam annotation: Domain name=Sigma70_r2; Domain location=288-358; Score=70.8; E_value=4.4e-18; Accession=PF04542.5; Description=Sigma -70 region 2
  Pfam annotation: Domain name=Sigma70_r3; Domain location=362-443; Score=56.2; E_value=1.1e-13; Accession=PF04539.7; Description=Sigma -70 region 3
  Pfam annotation: Domain name=Sigma70_r4; Domain location=461-513; Score=36.4; E_value=1e-07; Accession=PF04545.7; Description=Sigma-70, region 4
  Pfam module annotation: Pfam domain module=Sigma70_r2::Sigma70 _r3::Sigma70_r4; Domain location=288-358::362-443::461-513
MATAAVIGLSGGKRLLSSSYHYSDIIEKLSYGSDFGSTHYQIVPTKSLIVAKKSSNYTPTFPASNQQNQSIKALKEHVDDAPTIADPWFQSYNSNDLEVESSEMGYSVEALLLLQKSMLEKQWNLSFEREVLTENSSKGKKCRKVAVTCSGVSARQRRMNTKRKTAIKTCGAMQLKSKISPELLQHRLKGYVKGLVSEELLSHAEVVNLSEKIKVGLSLEEHKSSFQQHIAGGRGGNIAVKNCIGMEKRLKEKLGCEPSDDQMATSLKISRTELRARMIECSLAREKLAMSNVRLVMSIAQKYDNLGAEMGDLVQGGLIGLLRGIEKFDSSKGFKISTYVYWWIRQGVSRALVENSRTLRLPAHLHERLSLIRNAKFRLEERGITPTIDRIAKYLNMSQKKVRNATEAISKIISLDREAFPSLNGLQGETHHSYIADNRVENIPWNGVDEWALKDEVNRLINVTLVEREREIIRLYYGLEKECLTWEDISKRIGLSRERVRQVGLVALEKLKHAARKRQMEAMLLKH

SEQ ID NO: 119294 - protein, 431 aa, Glycine max
  Coding DNA Sequence Number=SeqID_27609
  Gene Ontology: Mol. function=hydrolase activity, acting on glycosyl bonds; Cellular component=extracellular region; Biological process =cell wall organization and biogenesis
  Homolog annotation: Hit_ID=Q2LAH5; Match level="QueryCoverage=100%, HitCoverage=100%, E-value=0.0, Identity=92%"; Hit description =Polygalacturonase precursor
  Pfam annotation: Domain name=Glyco_hydro_28; Domain location=98-430; Score=481.6; E_value=9.8e-142; Accession=PF00295.8; Description =Glycosyl hydrolases family 28
MSPQTPTIPLFIVLASLVLCNGYYLEESFYKTNAKHYPVHDGRLIKTKHEHFGLITRANRASHLTSRPRGTVSVDDFGAKADGSDDSEAFGKAWNEACSRGAILVVPENRIYRLKPIIFSGPCRPNTAFMLYGTIEAWSQMSAYQEDRQHWIVFDSVSNFRVGGGGTFNGKGKKWWQSSCKVNTNLAVTFYQCNNLKVTNLRFKDAPQMHVVFEGCFNVIVSNLVIRAPGDSPNTDGIHVADTQNIVISNSDIGTGDDCISIISGSQNVRATDITCGPGHGISIGSLGADNSEAEVSNVVVNRATLTGTTNGVRIKTWQGGSGYARNIKFLNIAMQNVTNPIIIDQYYCDQSKPCQEQDSAVQLSNVLYQNIKGTSASEVAIKFDCSRAVPCRQIYVQDVILEPQGHGGTIATCEHVSYVNRGKFFPQCTP

SEQ ID NO: 119295 - protein, 365 aa, Glycine max
  Coding DNA Sequence Number=SeqID_27610
MGNSHLLGNRGPQLIPCRLQLGRSAAIDVSRRVDEGINEVWTLLYTIKESWWNFFYKYSTNCMLSLTKYVDSDGNLCMVKLSLDETDVYSNWGDFSFTIQRTGTSSFLQMHPNMVWADFQSIMSMKTNNAVDACGVSTQTVLYLYRRGKRGGLVVTECKRNRGDKEANAVTMAHYFANSDDDKDIGLSVVAKIRAALNGKLDVTVEGPEQHPAFSLLHMFDEVNRTRSWKPAIFSHCAANIRGAREPGNRQNVRIIDNGDCEKYMGGPIGCHIERYEDHRRLVLSDSEDILPRRARAHRQKARGIVNGARLMGNDRRSMFLQPEDDDTDDGDGVRFPRCSGNISVNIAQEHKLFFQPAANPFINK

SEQ ID NO: 119296 - protein, 122 aa, Glycine max
  Coding DNA Sequence Number=SeqID_27611
  Homolog annotation: Hit_ID=A8MR60; Match level="QueryCoverage=72%, HitCoverage=41%, E-value=1e-27, Identity=67%"; Hit description =Uncharacterized protein At3g23255.1
MLRYSGKTCLLFQFVFNVALHSNNNVIFICYRLRLDSKPPFLSQGIDPSSHVFHRIQMKYVNDDQDIRKYFAAFHLYDALPAAVLIDDFGDFFDDNQKGSCKGSLVRYSYSPERLPKVSLHL

SEQ ID NO: 119297 - protein, 199 aa, Glycine max
  Coding DNA Sequence Number=SeqID_27612
  Gene Ontology: Mol. function=pyridoxal phosphate binding; Cellular component=cytoplasm; Biological process=biosynthetic process
  Homolog annotation: Hit_ID=Q1SKS5; Match level="QueryCoverage=96%, HitCoverage=19%, E-value=1e-85, Identity=75%"; Hit description=SAM (And some other nucleotide) binding motif
MSWMSVDEFLVQCKKSGDAAYASLRSLLERLDNPETRSQARIFLSHLQKRFPTKDSCERHHGRNKLTMMVIPSIFLPEDWSFTFDEGINRHPDSIFKERTVAELGCGNGWISIAIAEKWLPYKVYGLDINPRAVKVSWINLYLNALDENGHLIYDVENKTLLDRVEFHESDLLSYCREKDIQLERIVGCLPQNHQNVSS

SEQ ID NO: 119298 - protein, 233 aa, Glycine max
  Coding DNA Sequence Number=SeqID_27613
  Homolog annotation: Hit_ID=A7QHB3; Match level="QueryCoverage=91%, HitCoverage=90%, E-value=8e-79, Identity=69%"; Hit description =Chromosome chr18 scaffold_96, whole genome shotgun sequence
MSYEKFNVDSRNSVCRIVRSYLLHYGYEDTLNSFDVASKSTVPPIYIAQESGIDEQEITYALNHRKTLRQLIRNGDIDVAFGKLREWYPQIVEDNTSATCFLLHCQKFIELVRVGALEEAVKYGRMELSSFYDLPVFKDLVQDCVALLAYERPLESSVGYLLKDSQREVVADTVNAMILSTNLNMKDSKHCLHSYLERLLRQLTACCLVRRSLNGEQGEAFQLQRVLSSSRRG

SEQ ID NO: 119299 - protein, 342 aa, Glycine max
  Coding DNA Sequence Number=SeqID_27614
  Gene Ontology: Mol. function=GTP binding; Cellular component =endoplasmic reticulum membrane
  Homolog annotation: Hit_ID=A7PQ69; Match level="QueryCoverage=100%, HitCoverage=100%, E-value=1e-116, Identity=64%"; Hit description =Chromosome chr18 scaffold_24, whole genome shotgun sequence
  Pfam annotation: Domain name=AIG1; Domain location=20-217; Score =345.8; E_value=7.5e-101; Accession=PF04548.7; Description=AIG1 family
  Pfam annotation: Domain name=MMR_HSR1; Domain location=20-138; Score =15.5; E_value=4.1e-05; Accession=PF01926.14; Description=GTPase of unknown function
  Pfam module annotation: Pfam domain module=AIG1::MMR_HSR1; Domain location=20-217::20-138
  Subcellular localization annotation: CTP_CleavageSite=50; ConfidenceScore=5.35e-01
MGGSSIGDDWELTSSSNEGRTVVLVGRTGNGKSATGNTILGRKVFKSRASSSAVSTSCELQTTELNDGQIVNVIDTPGLFDLSVGSEFVGKEIVKCIDLAKDGIHAVIVVFSVRTRFTEEEETALRSLQTLFGSKIVDYMIVVFTGGDELEENAETLEDYLGRECPEPLKDEGKRFGQVQQLLSFVNTVLSRNGGRPYTDELFTQLKKGAMELHNQQREVDSLKGYSKGEILKFKKQMQQTYDDQLKRITEMLACGCAIILMHSTFWCSKLVHLKKVESKLREATMRLEQQLAEEQAARLKAEENAMLAQMRSDDEIRKLREHLEKAHEELRKRGEGRCAIL

SEQ ID NO: 119300 - protein, 413 aa, Glycine max
  Coding DNA Sequence Number=SeqID_27615
  Gene Ontology: Mol. function=sugar:hydrogen symporter activity; Cellular component=integral to membrane; Biological process =carbohydrate transport
  Homolog annotation: Hit_ID=A9PFB9; Match level="QueryCoverage=98%, HitCoverage=85%, E-value=1e-157, Identity=66%"; Hit description =Putative uncharacterized protein
  Pfam annotation: Domain name=MFS_1; Domain location=1-363; Score=6.8; E_value=0.011; Accession=PF07690.7; Description=Major Facilitator Superfamily
  Pfam annotation: Domain name=Sugar_tr; Domain location=4-412; Score =176.3; E_value=7.8e-50; Accession=PF00083.15; Description=Sugar (and other) transporter
  Pfam module annotation: Pfam domain module=MFS_1::Sugar_tr; Domain location=1-363::4-412
MVCLCTLQSPTLSGVSWYKLSSVEIGLLTSGSLYGALIGSVLAFNVADFLGRRKELIGSAVVYLVGALVTALAPNFPVLVLGRLVFGTGIGLAGYGIGSLFVETVAGWRYMYGVSSPMAIIMGLGMWWLPASPRWLLLRAIQGKGDVQNSKDIVIRSLCQLQGQAFNDSIPWQVDEILAELSYLGEEKEATFGELFQGKCLKALWIGAGLVLFQQITGQPSVLYYAGSIFQSAGFSGASDATRVSILLGVFKLIMTGVAVVVVDKLGRRPLLLGGVSGIGYANLLISAARMVISLFFLGSYYIFLDNTPVVAVVGLLLYVGSYQISFGPIGWLMIAEIFPLRLRGRGLSIAVLVNFGANALVTFAFSPLKALLGAGILFYTFGVIAVTSLVFIYLVIPETKGLTLEEIEAKCL

SEQ ID NO: 119301 - protein, 737 aa, Glycine max
  Coding DNA Sequence Number=SeqID_27616
  Gene Ontology: Mol. function=methionine-tRNA ligase activity; Cellular component=cytoplasm; Biological process=tRNA aminoacylation for protein translation
  Homolog annotation: Hit_ID=A7QHL2; Match level="QueryCoverage=85%, HitCoverage=75%, E-value=0.0, Identity=79%"; Hit description =Chromosome chr5 scaffold_98, whole genome shotgun sequence
  Pfam annotation: Domain name=tRNA-synt_1g; Domain location=100-513; Score=685.7; E_value=3.6e-203; Accession=PF09334.2; Description=tRNA synthetases class I (M)
MNTDGDMKKKHRRKRKTNKNGGRRNRNKKKKDACDDRRNKNNKKKFVTNTNAGLTLPYSPFLNLAAGGTASSLRGTQPNSFPMTENLKAPKLPVEGKRNILITSALPYVNNVPHLGNIIGCVLSADVFARYCRLRGYNAIYICGTDEYGTATETKAMEENCSPKEICDKYHAIHKEVYNWFNISFDEFGRTSSPEQTEVCQAIFRKIFENKWLSENTMQQLYCNTCERFLADRLVEGTCPTPGCEYDSARGDQCEKCGKLLNPTELKNPGCKVCQKTPRIRDTDHLFLELPLLKDRLEKYISEMSVVGGWSQNAIQTTNSWLREGLKPRCITRDLKWGVPVPHEKYSDKVFYVWFDAPIGYVSITSCYTRDWEKWWKNPENVELYQFMGKDNVPFHTVMFPSTLLGTSENWTLMKTISVTEYLNYEAAHMGYKLIQKGPNDAYNQTGKFSKSKGIGVFGNDAKDTNIPVEVWRYYLLTNRPEVSDTLFTWSDLQAKLNSELLNNLGNFINRVLSFIAKPAGQGYDSIIPSVPDDVSGDSHGPTKKLADKVAAYIDQYIEAMEKVKLKQGLKVAMSISSEGNAYLQEAEFWRLYKENKSLCSLVMKTAAGIVYLLACLLEPFIPSFTLEVFKQLNLPVDTHVSLCDDKGDIDRVKRPWDIISASHKIGTPKPLFRELKDEEVKFYRKKFAGSQADRIVRAEAEAQNVAEQLKKTKVSGVFPGSSISNKFKEVGRKSSR

SEQ ID NO: 119302 - protein, 329 aa, Glycine max
  Coding DNA Sequence Number=SeqID_27617
  Homolog annotation: Hit_ID=A7PBD7; Match level="QueryCoverage=51%, HitCoverage=96%, E-value=7e-39, Identity=53%"; Hit description =Chromosome chr16 scaffold_10, whole genome shotgun sequence
METESHEDLQHPSVSSNDTHSDDASNHRDAEQKQDVSREEVVQILQVIASTGRFCLRQGCVGGRYLMWVLTLHTLRPKGVEIAAVSLSQQQITTGIAAILAAPVNSSHLSISTAPYSASWGWLCCMAFWDSLLWPNLMIVDLNMDLYIQRANVVKFLNDRHDWDKLKSMLSFQLKQVLSEYPEARMTSEQQYASFGESYIELVNKLDEGILINSSIAKILLDAKGLYPNLSKLALALEKNLLVTSTLTICTDPYPQATAKELDDQEKPSEKQQQQQQSDSAENGVELLVSDKDEVMTEADVGDDMTIGMEAFEGVKSSETNSELNANSA

SEQ ID NO: 119303 - protein, 181 aa, Glycine max
  Coding DNA Sequence Number=SeqID_27618
  Homolog annotation: Hit_ID=Q9LWS9; Match level="QueryCoverage=99%, HitCoverage=99%, E-value=2e-46, Identity=52%"; Hit description =Putative uncharacterized protein P0541H01.30
  Pfam annotation: Domain name=DUF1218; Domain location=44-132; Score =68.1; E_value=3e-17; Accession=PF06749.3; Description=Protein of unknown function (DUF1218)
MEKKVLILCCVVAFLGLLSAATSFGAEATRIKVSQVHFVAPNQCTYPRSPALPLGLTAALALMLSQIIINVGTGLTFVIGFLLLLTGAALNDQRGEESVYFGYYYCYVVKPGVFTGGAILSLASAAFGILYYISLTERKNGSQYPYPNQGVIAMAQPQIPSQTSQEPVFVHEDTYVRRQFT

SEQ ID NO: 119304 - protein, 418 aa, Glycine max
  Coding DNA Sequence Number=SeqID_27619
  Gene Ontology: Mol. function=kinase activity; Cellular component =intracellular; Biological process=intracellular protein transport
  Homolog annotation: Hit_ID=A7P260; Match level="QueryCoverage=100%, HitCoverage=100%, E-value=1e-136, Identity=62%"; Hit description =Chromosome chr19 scaffold_4, whole genome shotgun sequence
  Pfam annotation: Domain name=GAT; Domain location=253-349; Score =27.6; E_value=3.9e-06; Accession=PF03127.5; Description=GAT domain
  Pfam annotation: Domain name=VHS; Domain location=44-179; Score=86.1; E_value=1.1e-22; Accession=PF00790.10; Description=VHS domain
  Pfam module annotation: Pfam domain module=GAT::VHS; Domain location =253-349::44-179
MSDNLMGKVNALGERLKIGGAEVGRKMSAGMSSVSFKVKEFFQDSSHAGKLVGEATSEALHEPDWATILHICDLINADQLNTAELVRAIKKRVVAKSPRGQYLALVLLEALVKNCDKAFLEVATERVLDEMVKLIDDPQTILNNRNKALIMIEAWGESTIELRYLPVYAETYKSLKSRGIRFPGRDNESLAPIFTPPHSAITPEADVSFADLIQYDIHGQSLTSVTPPRSATTPEADVSLAHLMPQDIHMQSFKSEQIKETFDVARNSIELLSTVLSSTMQQNVLKDELTTTLVQQCRQSQTSVHRIVETAWDNEAVLVEALNVNDEIQKVFSKYEELKKEQKEPTVVPFEAEPVVTKEEALIRKPGSRIGVHGGSHDDMLDDLDEMIFGKKGRDDAFEGGQHPKKQQSSSKDDLISF

SEQ ID NO: 119305 - protein, 221 aa, Glycine max
  Coding DNA Sequence Number=SeqID_27620
  Gene Ontology: Cellular component=chloroplast inner membrane
  Homolog annotation: Hit_ID=Q67YD5; Match level="QueryCoverage=76%, HitCoverage=44%, E-value=4e-78, Identity=85%"; Hit description =Putative uncharacterized protein At5g12470
KRKSAQYANRLSPRVGRFINAAGTTGFPTGKRAVSATQLIYDHDYEFELGTRLLADDLFLAKVAMECGVGVFTKTAAEYEKRRENFFNELEIVFADVAMAIIADFMLVYLPAPTVALRPPLALTAGPIAKFFHGCPDNAFQVALSGASYSLIQRVGAIVRNGAKLFAVGTASSLVGTAMTNAFINAKKAVNKTSEGEIENVPILSTSAAYGVYMAVSSNLR

SEQ ID NO: 119306 - protein, 518 aa, Glycine max
  Coding DNA Sequence Number=SeqID_27621
  Gene Ontology: Mol. function=transcription regulator activity; Cellular component=histone methyltransferase complex; Biological process=transcription from RNA polymerase II promoter
  Homolog annotation: Hit_ID=A7NZN5; Match level="QueryCoverage=77%, HitCoverage=85%, E-value=1e-102, Identity=52%"; Hit description =Chromosome chr6 scaffold_3, whole genome shotgun sequence
  Pfam annotation: Domain name=SPRY; Domain location=259-361; Score =38.4; E_value=2.6e-08; Accession=PF00622.19; Description=SPRY domain
MTLPPSLSEPPSLSDSFSPLNPALAMDSLQATYKDEEDEEDEPQPQPPPTTADSPEAPPATTSTPSDTPTEPPNDARSEPEPSEDLSEDEAASDGSKKSPKSGREEGDASDEDPPPKKQKQLSSLTEATKEDLVAPQDGTNNAAATPATNGAAPKKSKKKNNNVWATKSTRKGKKKTNRNNNNNNSNNNNNHNHHANGEDNVLITPVPRFPDKSDDTEDMKICLSKVYKAEKVELSEDRMSAGSTKGYRMVRATRGVVEGAWYFEIRVVKLGESGHTRLGWSTEKGDLQAPVGYDGNSFGYRDIDGSKIHKALREKYGEEGYKEGDVIGFYINLPGGEQYAPKSSQLVWYKGQRYVYAQDSKEDPPKLVPGQFSTLLCFNGSLGCLIVIELLIPFCVYILKYVKLNVAKIPISIVNDKWWAHRHAMDGSEISFFKNGICQGVAFKDLHGGRYYPAASMFTLPNEPNCTVKFNFGPDFECFPEDFNERPIPRPMSEVPYLGFDNKVENEESNEKKSQKE

SEQ ID NO: 119307 - protein, 399 aa, Glycine max
  Coding DNA Sequence Number=SeqID_27622
  Gene Ontology: Mol. function=iron-sulfur cluster binding; Cellular component=endoplasmic reticulum; Biological process=metabolic process
  Homolog annotation: Hit_ID=Q9C7H2; Match level="QueryCoverage=91%, HitCoverage=65%, E-value=1e-167, Identity=76%"; Hit description =Putative uncharacterized protein F28P5.4
  Pfam annotation: Domain name=Radical_SAM; Domain location=173-348; Score=74.7; E_value=2.9e-19; Accession=PF04055.12; Description =Radical SAM superfamily
  Pfam annotation: Domain name=UPF0004; Domain location=49-128; Score =26.2; E_value=3.8e-07; Accession=PF00919.11; Description =Uncharacterized protein family UPF0004
  Pfam module annotation: Pfam domain module=Radical_SAM::UPF0004; Domain location=173-348::49-128
  Subcellular localization annotation: CTP_CleavageSite=35; ConfidenceScore=5.07e-01
MEDIEDLLIGSATPPGFRLPLAAAVGVGTKRNQLSSSSLSPSPAIPGTQSDSEYMAGQLSAFGYSLSDDPDHADLWLINTCTVKSPSQSAMDTIISKGKSSNKPLVVAGCVPQGSRDLKELEGISIVGVQQIDRVVEIVEETLKGHEVRLLTRKKLPALDLPKVRKNKFVEILPINVGCLGACTYCKTKHARGHLGSYTIDSLVGRVKSVISEGVKEIWLSSEDTGAYGRDIGVNLPTLLNALVAELPADASTMLRIGMTNPPYILEHLKEIAEILRHPCVYSFLHVPVQSGSDTILSAMNREYTVSEFRTVVDTLTELVPEMQIATDIICGFPGETDEDFLQTINLIKEYKLPQVHISQFYPRPGVWGVVAALPVATMLVRFCISDRPKPHTCDSLVN

SEQ ID NO: 119308 - protein, 707 aa, Glycine max
  Coding DNA Sequence Number=SeqID_27623
  Gene Ontology: Mol. function=isoleucine-tRNA ligase activity; Cellular component=cytoplasm; Biological process=tRNA aminoacylation for protein translation
  Homolog annotation: Hit_ID=A5AU06; Match level="QueryCoverage=93%, HitCoverage=56%, E-value=0.0, Identity=80%"; Hit description =Putative uncharacterized protein
  Pfam annotation: Domain name=Anticodon_1; Domain location=347-505; Score=134.3; E_value=3.5e-37; Accession=PF08264.4; Description =Anticodon-binding domain
  Pfam annotation: Domain name=tRNA-synt_1; Domain location=3-292; Score=-13.6; E_value=1.4e-17; Accession=PF00133.13; Description=tRNA synthetases class I (I, L, M and V)
  Pfam annotation: Domain name=tRNA-synt_1g; Domain location=44-316; Score=-277.5; E_value=0.0056; Accession=PF09334.2; Description=tRNA synthetases class I (M)
  Pfam module annotation: Pfam domain module=Anticodon_1::tRNA-synt _1::tRNA-synt_1g; Domain location=347-505::3-292::44-316
  Subcellular localization annotation: CTP_CleavageSite=57; ConfidenceScore=5.09e-01
MCLFKKFFLKFFTVFSEVPLLAKGRLVKSGAFTHSYPFCWRSQTPLIYRAVPSWFVRVESLKEKLLENNKKTYWVPDFVKGRIQYQDNIILMRETDKRFHNWLENARDWAISRSRFWGTPLPLWISEDEEEVVVIDSVAKLEELSGVKVFDLHRHNIDHITIKSDSGRVLRRVDDVFDCWFESGSMPYAYIHYPFENVELFEKNFPGHFVAEGLDQTRGWFYTLMVLATALFGKPAFRNLICNGLVLAEDGKKMSKSLKNYPSPMEVINDYGADALRLYLINSPVVRAEPLRFKKEGVYGVVRDVFLPWYNAYRFLVQNAKRLEVEGLAPFVPFDHATLLNSTNVLDQWINSATQSLIHFVRQEMDGYRLYTVVPYLLKFLDNLTNIYVRFNRKRLKGRSGEEDCRIALSTLYNYYQKMMVLLLSCKVMAPFTPFFTEVLYQNMRKVSNGSEESIHYCSFPTEEGRRGERIEQSVSRMMTIIDLARNIRERHNKPLKTPLREMVIVHPDADFLDDINGKLKEYVLEELNVRSLVPCNDTLKYASLRAEPEFSVLGKRLGKSMGIVAKEIKAMSQENILAFENAGEVVIANQCLKLTDIKVLRDFKRPDGMTEKEVDAAGDGDVLVILDLRPDESLFEAGAAREIVNRIQKLRKKVALEPTDMVEVYFESLDDDKSVSHRVLHSQHCRTATLFLQIPILILSACKLRK

SEQ ID NO: 119309 - protein, 455 aa, Glycine max
  Coding DNA Sequence Number=SeqID_27624
  Gene Ontology: Mol. function=transferase activity; Cellular component= mitochondrial outer membrane; Biological process=glycolysis
  Homolog annotation: Hit_ID=Q6Q8A0; Match level="QueryCoverage=91%, HitCoverage=82%, E-value=1e-151, Identity=66%"; Hit description =Hexokinase 6
  Pfam annotation: Domain name=Hexokinase_1; Domain location=9-193; Score=130.3; E_value=5.4e-36; Accession=PF00349.12; Description =Hexokinase
  Pfam annotation: Domain name=Hexokinase_2; Domain location=195-449; Score=224.7; E_value=2.1e-64; Accession=PF03727.7; Description =Hexokinase
  Pfam module annotation: Pfam domain module=Hexokinase_1::Hexokinase _2; Domain location=9-193::195-449
MVLSSCALLGIWVKIHPVESRDGAMMSIRSALTAIISFMKRKTEKGTYYALDLGGTNFRVLRVHLHGQQSSVLEHEVERQPIPQNLMTSTSEDLFDFIASSLKEFIEKEGDGSELSPDRRRELGFTFSFPVKQMSVSSGILLKWTKGFSIVDLVGIDVPACLQEALTRKGLDVRVAALVNDTVGTLALGHYHDSDTVASVIIGTGTNACYLERVDAIIKCQGLPTTSGYMVVNMEWGNFWSSHLPRTSYDIDLDSESPNPNDQGFEKMISGMYLGDIVRRVILRMSLESDMLGPISSKLSMPFMLRTPMMAAMHEDDSPDLREVARILKGILEIPDVPLKLRKVVVKVCDVVTRRAARLAAAGIVGILKKIGRDGSGGIAGGRRSDMKMKRTVVAIEGGLYSSYTLFRDYLHEALNDILGEDIARHVILKVTEDGSGVGAALLAASHSSYDVDTV

SEQ ID NO: 119310 - protein, 364 aa, Glycine max
  Coding DNA Sequence Number=SeqID_27625
  Gene Ontology: Mol. function=hydrolase activity, hydrolyzing O -glycosyl compounds; Cellular component=extracellular region; Biological process=carbohydrate metabolic process
  Homolog annotation: Hit_ID=Q6S9W0; Match level="QueryCoverage=85%, HitCoverage=91%, E-value=1e-124, Identity=71%"; Hit description=Endo- 1,3-beta-glucanase
  Pfam annotation: Domain name=Glyco_hydro_17; Domain location=58-363; Score=600.5; E_value=1.6e-177; Accession=PF00332.9; Description =Glycosyl hydrolases family 17
MEDKKTSLMGEIEHEDTTLEEDVSPNTNLPVPTRKGTMAVFKLTLEGWKISSRIAQSIGVCYGVIGDNLPSRQEVVDLYKTNGIGRMRIYYPDEEALQALRGSGIELIMDVAKETLQSLTDSNAATDWVNKYVTPYSQDVNFKYIAVGNEIHPNTNEAQYILSAMTNIQNAISSANLQIKVSTAIDSTLITNSYPPNDGVFTSDAEPYIKPIINFLVSNGAPLLANVYPYFAYANDQSIPLAYALFTQQGNNDVGYQNLFDAMLDSIYAALEKVGASNLQIVVSESGWPSEGGAGASIDNAGTYYANLIRHASSGNGTPKRPGESIETYLFAMFDENQKQGADTERHFGLFNPDKSPKYQLSFN

SEQ ID NO: 119311 - protein, 320 aa, Glycine max
  Coding DNA Sequence Number=SeqID_27626
  Gene Ontology: Mol. function=protein-tyrosine kinase activity; Biological process=protein amino acid phosphorylation
  Homolog annotation: Hit_ID=A7P8N3; Match level="QueryCoverage=68%, HitCoverage=86%, E-value=2e-39, Identity=43%"; Hit description =Chromosome chr3 scaffold_8, whole genome shotgun sequence
  Pfam annotation: Domain name=Hin1; Domain location=147-299; Score= -16.4; E_value=0.039; Accession=PF07320.4; Description=Harpin-induced protein 1 (Hin1)
MGGRMHTKSDSEVTSNSMEQSSPARSPPRRPLYYVQSPSNHDVEKMSYGSSPMGSPHHHFHYYLSSPIHHSRESSTSRFSASLKNPRNFSSSSSWKKLHPHPNRDVDPDDHDDADHHLKQSSRNLRLYLWFFLLFLLLLTLFSFILWAASKTYKPRIIVKSIVLENLYVQSGNDGTGVPTDMLSLNSTVRILYRNPATFFGVHVTSTPLLISYYQLAIASGQLASRPLRARVRIAAATKRALRSIPTEPSATLKQQIIPLGRGFLRDNHMKQGYAYVIGTRVMLPSSVDSLGRKGNVTEIKNVSPPKNNLMHVLTNGEHL

SEQ ID NO: 119312 - protein, 313 aa, Glycine max
  Coding DNA Sequence Number=SeqID_27627
  Gene Ontology: Mol. function=calcium ion binding
  Homolog annotation: Hit_ID=O82062; Match level="QueryCoverage=90%, HitCoverage=79%, E-value=1e-117, Identity=75%"; Hit description=39 kDa EF-Hand containing protein
MINYKALATSCIQNEKAKFLWGQGKVLNEFTHGKQEKVSKSEFKEVLSDILLGMAAGLKRDPIVILRIDGEDLLEFVNGSGYEAEMVSIFSQIESPDRSLHDHIIEALGKLTVEQGIPPTSDSWVLSNIVEPALLSQDGSDLDKPVSQETFLEEFKIVAMSVANHLKEQPVIVAHSENTFDGSGVKRLLSNKFELDKTLSSAIETLPKDRNGKLSKEYLRVTLDTVAPSAGLPPVGAIEEMDKVIGEVFKMVNADDAKVVKEDEFKKLLTEILGSIMLQLEGNPISVSSNSVVHEPLDSSSTLLQPSPSETAA

SEQ ID NO: 119313 - protein, 250 aa, Glycine max
  Coding DNA Sequence Number=SeqID_27628
  Gene Ontology: Mol. function=calcium ion binding; Cellular component =endoplasmic reticulum membrane
  Homolog annotation: Hit_ID=A5BQP3; Match level="QueryCoverage=88%, HitCoverage=89%, E-value=6e-69, Identity=60%"; Hit description =Putative uncharacterized protein
  Pfam annotation: Domain name=TRAP_alpha; Domain location=1-250; Score= -59.5; E_value=3.6e-07; Accession=PF03896.7; Description=Translocon -associated protein (TRAP), alpha subunit
MACIDKFWVFALALLLLASPLLQVARCQSDSDDVVEAAEESGDIGIVGDDVQDFGDGTFPSAPGIETISVFPKNSARLITAGEESELLVGVKNDGDSSLNVIAIKASVHLPFDHRMLVQNLTAQGFNNGISTALKANAFSFSSGTFDLVGTIIYEIDEHPFQSTFFNGTVEVVESGAFLSMESVFLVTLGVALLVLLGLWIHGQIQHLSKKTKRAPKVEVGTRTTDASTDEWLQGTAYTQSMSSKSKKKK

SEQ ID NO: 119314 - protein, 165 aa, Glycine max
  Coding DNA Sequence Number=SeqID_27629
MGGATGGAAAILGGRHHRLELLEVDATGVIAVDGLDHVATFVEEALEVEAVEREVELRSGDEAVFVAVVEIEGVVELARSTVGRGVGATESGELREADEAVVVGVEVFHDAVKVLQRDVESERSEHAVELVGGDLTVAVGVEAVEDCLEFVHVFEVRKELTFENL

SEQ ID NO: 119315 - protein, 243 aa, Glycine max
  Coding DNA Sequence Number=SeqID_27630
  Gene Ontology: Mol. function=structural constituent of ribosome; Cellular component=ribonucleoprotein complex; Biological process =translation
  Homolog annotation: Hit_ID=P36688; Match level="QueryCoverage=53%, HitCoverage=69%, E-value=2e-38, Identity=67%"; Hit description=50S ribosomal protein L12, chloroplast precursor
  Pfam annotation: Domain name=Ribosomal_L12; Domain location=122-190; Score=123.5; E_value=6.1e-34; Accession=PF00542.10; Description =Ribosomal protein L7L12 C-terminal domain
  Subcellular localization annotation: CTP_CleavageSite=54; ConfidenceScore=5.73e-01
MASTTLTTLSLRNLSYPTPSSSSYPTHLSANPSSLQFPNFSHRATTTRRARVVVVSAVEAPEKITKLGDEIAGLTLEEAKNLVDFLQDKLGVSAAAFAPVAVAAGAVGAVADAPAAVEEKTEFDVLIEEVPSNARIAVIKAVRALTNLALKEAKELIEGLPKKFKEGISKDEAEDAKKQLEEAGAKVFVEMEVKGFKLLNWKLEIGNMELATRKLLNFFVSLSSFILFHLHYRALLCASGLWF

SEQ ID NO: 119316 - protein, 398 aa, Glycine max
  Coding DNA Sequence Number=SeqID_27631
  Gene Ontology: Mol. function=small conjugating protein ligase activity; Cellular component=protein complex; Biological process =regulation of protein metabolic process
  Homolog annotation: Hit_ID=A9PJF9; Match level="QueryCoverage=99%, HitCoverage=97%, E-value=2e-71, Identity=72%"; Hit description =Putative uncharacterized protein
  Pfam annotation: Domain name=UEV; Domain location=27-148; Score =218.9; E_value=1.1e-62; Accession=PF05743.4; Description=UEV domain
  Pfam annotation: Domain name=Vps23_core; Domain location=312-376; Score=125.9; E_value=1.2e-34; Accession=PF09454.1; Description=Vps23 core domain
  Pfam module annotation: Pfam domain module=UEV::Vps23_core; Domain location=27-148::312-376
MTQFLNSVLSQRGPSAVPYSEDTKWLIRQHLVALTTAFPSLEPKTASFTHNDGRSVNLLQADGTIPMTFQGVTYNIPVVIWLMESYPRHPPCVYVNPTRDMIIKRPHPHVNPSGLVSVPYLQNWTYPSSNLVDLILNLSLHFGRDPPLYSQRRPNPNPNPNPHPPPNYGNSPSNLSSSSSSSSGYPHAHAHAHPPPRTYPPSPYPASSSRVQSSEDPSEVFKRNAINKLVEMVHGDVAALRKTREGEMEELFSLQGVLKQREESLNKGVKEMQEEMEALEQQLQMVLMNTDVLEGWLRDNQGKKMAGLENPEDAFECADVLSKQMLDCTAADLAIEDTLYALDKALQVGAVPFDQYLRSVRALSREQFFHRATATKVRAAQLQAQVANMAARSPHYGS

SEQ ID NO: 119317 - protein, 310 aa, Glycine max
  Coding DNA Sequence Number=SeqID_27632
  Gene Ontology: Mol. function=nucleic acid binding; Cellular component= nucleus; Biological process=response to DNA damage stimulus
  Homolog annotation: Hit_ID=A7PNI0; Match level="QueryCoverage=67%, HitCoverage=72%, E-value=1e-49, Identity=52%"; Hit description =Chromosome chr1 scaffold_22, whole genome shotgun sequence
  Pfam annotation: Domain name=Swi3; Domain location=74-158; Score =142.3; E_value=1.4e-39; Accession=PF07962.3; Description=Replication Fork Protection Component S
  Pfam annotation: Domain name=zf-CCHC; Domain location=6-23; Score =32.4; E_value=1.7e-06; Accession=PF00098.14; Description=Zinc knuckle
  Pfam module annotation: Pfam domain module=Swi3::zf-CCHC; Domain location=74-158::6-23
  Subcellular localization annotation: CTP_CleavageSite=59; ConfidenceScore=5.37e-01
MEGTATGCYKCGRPGHWSRDCPFSAPNSNPNPNPNPNPNPATTPNPNTPNPSSSSFKPRFAAEKPKKLPRTKPKLTPELLLSDEGLGYVLRYFPREFKYRGGGHEVRDLGNLLRLYTEWHSRLLPYYSFNQFVHKVEKVAATRRVKTCLRELRERVASGGDPTKLREPPVVHDIPSDEHGYVVSAEDGGATHQETDVFAESENVNDIQEDMLNDIYDKATEEHAQSMHNVIGTNKASESSAAEKTSEEVQYNGSSQSGKAEITEEQRARMEANRLKALERRAEITEEQRARMEANRLKALERRAALSQAS

SEQ ID NO: 119318 - protein, 86 aa, Glycine max
  Coding DNA Sequence Number=SeqID_27633
  Homolog annotation: Hit_ID=A5BSG2; Match level="QueryCoverage=62%, HitCoverage=9%, E-value=1e-13, Identity=58%"; Hit description =Putative uncharacterized protein
MSKKTEGTNSKTSSTMTIHETSFPTISVKLDGTNYGVWSQLLEMYIARQKVVRIETDPNYDEWGAEDALANFDPRQKIEQEIIRWS

SEQ ID NO: 119319 - protein, 79 aa, Glycine max
  Coding DNA Sequence Number=SeqID_27634
  Subcellular localization annotation: CTP_CleavageSite=33; ConfidenceScore=5.35e-01
HLNTTLTSWSSNNIRVRCFRSHKNPTLHRRRVRAQVGKCPRRACGGQGRVKGESEMYGGHGKVKGEGRKGMRVPRLKHK

SEQ ID NO: 119320 - protein, 388 aa, Glycine max
  Coding DNA Sequence Number=SeqID_27635
  Gene Ontology: Mol. function=enoyl-[acyl-carrier-protein] reductase (NADH) activity; Cellular component=chloroplast; Biological process =metabolic process
  Homolog annotation: Hit_ID=O04945; Match level="QueryCoverage=99%, HitCoverage=96%, E-value=1e-144, Identity=70%"; Hit description =Enoyl-ACP reductase precursor
  Subcellular localization annotation: CTP_CleavageSite=67; ConfidenceScore=5.17e-01
MSRSCIPASQKIADAGAVVLGGKSKIGSWNKLASACHIASVQPFRRGFTSSSIKSVKSDTKALFEFSAQSADSGLSIDLKGKRAFIAGVADDNGYGWAIAKALAAAGAEILVGTWVPALNIFESSLRRGKFDISRILPDGSMMEITKVYPLDAVFDNPDDVPEDIKTNKRYAGSSKWTVQEVAESVKEDFGSIDILVHSLANGPEVTKPLLETSRNGYLAAISASSYSYVSLLKHFLPILNPGMPLILLPGGSSISLTYIASERIIPGYGGGMSSAKAALESDTRVLAFEAGRKRKIRVNTISAGPLRSRAAKAIGFIDMMIDYSSANAPLQKEVLAEEVGYTAAFLASPLASAITGTVLYVDNGLNAMGVGVDSPIFKDLNIPKDQH

SEQ ID NO: 119321 - protein, 478 aa, Glycine max
  Coding DNA Sequence Number=SeqID_27636
  Gene Ontology: Mol. function=nucleoside-triphosphatase activity; Cellular component=protein complex; Biological process=cell division
  Homolog annotation: Hit_ID=A7P2W5; Match level="QueryCoverage=96%, HitCoverage=46%, E-value=0.0, Identity=77%"; Hit description =Chromosome chr1 scaffold_5, whole genome shotgun sequence
  Pfam annotation: Domain name=AAA; Domain location=224-409; Score =250.5; E_value=3.6e-72; Accession=PF00004.20; Description=ATPase family associated with various cellular activities (AAA)
  Pfam annotation: Domain name=AAA_3; Domain location=224-350; Score= -17.9; E_value=0.031; Accession=PF07726.2; Description=ATPase family associated with various
  Pfam annotation: Domain name=AAA_5; Domain location=224-356; Score =0.6; E_value=0.0026; Accession=PF07728.5; Description=ATPase family associated with various
  Pfam module annotation: Pfam domain module=AAA::AAA_3::AAA_5; Domain location=224-409::224-350::224-356
MDAETSSQYMLTGQPLSLKHLTEGIKGDKTSEDDEINKLFSNVLSILPPKDENLLATFKKQLEEDKKIVTSRSNLNALRKVLEEHQLSCMDLLLVNTDSIILTKHKAEKVVGWAKNHYLSSCLLPSIKGERLYLPRESLKIEGPGNYVTEAFSKPQGIVRRNLAKDEFESNFISAVVPPGEIGVKFDDIGALEDVKKALNELVILPMRRPELFSRGNLLRPCKGILLFGPPGTGKTLLAKALATEAGANFISITGSTLTSKWFGDAEKLTKALFSFASKLAPVIVFVDEVDSLLGARGGAFEHEATRRMRNEFMAAWDGLRSKENQRILILGATNRPFDLDDAVIRRLPRRIYVDLPDAENRMKILRIFLAQENLNFDFQFDKLANFTDGYSGSDLKNLCIAAAYRPVQELLEEEKKRASNDTTSVLRPLNLDDFIQAKSKVGPSVAYDATSMNELRKWNEMYGEGGSRTKAPFGFGT

SEQ ID NO: 119322 - protein, 203 aa, Glycine max
  Coding DNA Sequence Number=SeqID_27637
  Gene Ontology: Mol. function=protein serine/threonine kinase activity; Cellular component=spindle pole body; Biological process =protein amino acid phosphorylation
  Homolog annotation: Hit_ID=A7P2X0; Match level="QueryCoverage=66%, HitCoverage=11%, E-value=1e-64, Identity=76%"; Hit description =Chromosome chr1 scaffold_5, whole genome shotgun sequence
  Pfam annotation: Domain name=Pkinase; Domain location=1-202; Score =19.9; E_value=8e-10; Accession=PF00069.16; Description=Protein kinase domain
  Pfam annotation: Domain name=Pkinase_Tyr; Domain location=22-203; Score=-95.7; E_value=1.5e-06; Accession=PF07714.8; Description =Protein tyrosine kinase
  Pfam module annotation: Pfam domain module=Pkinase::Pkinase_Tyr; Domain location=1-202::22-203
MNKGKNCAKTLLGESQCSPKKWVGKWETIDNSGKVLVPLNLNHKNIVKYLGSSKTKSHLHIVLEYVENGSLANNIKPNKFGPFPESLVALYIAQGLVKLADFGVATKLTEADVNTHSVVGTPYWMAPEVIEMAGVCAASDIWSVGCTVIELLTCVPPYYDLQPMPALFRIVQQKYNILIEYQRYQENELQGRCQKISSMASLM

SEQ ID NO: 119323 - protein, 271 aa, Glycine max
  Coding DNA Sequence Number=SeqID_27638
KIIPVWWESWSWVNIVVVFPHNPKQYFLQHTLGVTDGIRVNRWKWWWLALTWTIWQQRNKVIFSNDTFTASKLLDDAVFLLWTWLRNLEKDFATHYISGLQVEEKVTLETLDYHSHFQLDQNQLHPKGAIRTSALKMGPPKMEAYLHQVEDHTGYVSHPRASFALGHHLSPSSYISFGYSSVPSSVYFPISSLKGKQLWLPTMVVKLASSPLHLQLQQHLHQELLVVYSGGLFLICTWPLVFAPQHPCVTDYQTTNRQVLSSSRADQQRSL

SEQ ID NO: 119324 - protein, 1225 aa, Glycine max
  Coding DNA Sequence Number=SeqID_27639
  Gene Ontology: Mol. function=binding
  Homolog annotation: Hit_ID=A7PNG7; Match level="QueryCoverage=88%, HitCoverage=98%, E-value=0.0, Identity=57%"; Hit description =Chromosome chr1 scaffold_22, whole genome shotgun sequence
MAMEREKENCNSPGNMPVTHAGLFHVIYLLLDGKFQSLTVAEFITVTSYTTKNKTEMRMALPISRLIRVSTSAKVGFLGKSESIGSSSKVVSNEFNLAFFTLLLLYSSIEEQLRRSVNGMAEKAAAPPPLKPLTTQEWETLIENFQNGVHRKWNSLDPLFDLLLSSLHRKDFPLSLKLQLLVFLDEFSLSFFTSHHHLHRLVDAFKTVVHAPIDAAASAFKDQFMVSTSSILICASENVVVEAQTENMLVELLLTVINRPNFGSDRHTRGVACECLRELERWKPGLLSDVVGHLWNLCQNERTHASQCYLLLFTSVIHNIVARKLNVSILNTSVPMVPFNAPNCVTDSGSGSDIGLGLNVKELRRALAFLLEWPQVMTPCGMMEFVCMIIPVAVALELQPSMLKVQLFGMIHSFDPILCHVVLSMYLRFLDAFDGQEGEVSRRLLLISRESQHYLVFRLLALHWLLGFNRMIFEKTKPTLELCSTFYPALFDPLALKALKLDLLAFFSVCARVLRLKGGSDELIDPVKLFEDGLVCVSSFKWLPPGSTETAVAFRTFHKFLIASSSHSNNDPSTTRNMLDSAIFCTLQGLLVDMMLESRRLVPVVVAFVDRLLSCQKHSWLGECLLQKFDKHLLPNVRMDYKLVYCFPIFDRIAENQAIPPRALLELLTNFMIFLVEKHGPDTGMKSWSQGSRALGICRTMLMHHHSSRLFLRLSRLFTFTCLYFPDLEVRDNSRIYLRMLVCIPGKKLRDILNLGDMILGISSSSHPTSFFNVQSPRPSQKFKTFKNISSCIHLERLVPLLVKQFWSLSLSNLVVSNTKPTYLEIIRDLKSPVEEKEFSDSSNTQIIPEFARINQPQEPLRVMDSKVAEILNTLRKYFSCIPDFRHMPGLIVRISCCLRFESNTFNRMLGIDKTATSLEEVDALPAIYATVLKFSSSAPYGSIPSYRIPFLLGEPYNKDPASQNASLSIVPVGVGNDSREEEKYRATVEIDLEPREPTPGIVDVHIETNAENGQIIQGQLQGITVGIEDMFLKAIVPADIPEDEIPRYNFDLFNTLWEACGSSSSTGRETFQLKGGKGIAAISGTQSVKLLDVPATSLIQATERHLARFVVGVSGEPLIDAIWEGGIIQNVIWEDASPDATSVANHDTGPLRLTYNDEEYEKGAISNSRKRNLGCFLVLIFLPPRFHLLFQMEVGDLSTLVRIRTDHWPSLAYIDDYLEALYLS

SEQ ID NO: 119325 - protein, 225 aa, Glycine max
  Coding DNA Sequence Number=SeqID_27640
  Gene Ontology: Mol. function=binding
  Homolog annotation: Hit_ID=A7QMM0; Match level="QueryCoverage=41%, HitCoverage=10%, E-value=7e-23, Identity=58%"; Hit description =Chromosome chr19 scaffold_126, whole genome shotgun sequence
MKQYSFLLLSDDCFAMIALETLQDDVDARITLASLLLEEAKEDEAISLLSPPKDSAPSEKSNRWWADIRIKLKLCNIYWNRGTLDDFVDTIFPLVRESLYVATLRQKFAVAHQSTAVAVNVRHAAVACVMCWSSVSRMRRLLFCCRRARERRLRLSCASPVPAPPFVALETDAGRAAEEEKLGYGWLGSVQPLSQTFFKIKNPLFRHSCDSAMTAMAMAAAIAPP

SEQ ID NO: 119326 - protein, 707 aa, Glycine max
  Coding DNA Sequence Number=SeqID_27641
  Homolog annotation: Hit_ID=A7PNG5; Match level="QueryCoverage=88%, HitCoverage=86%, E-value=0.0, Identity=65%"; Hit description =Chromosome chr1 scaffold_22, whole genome shotgun sequence
  Pfam annotation: Domain name=C2; Domain location=402-487; Score=51.1; E_value=3.9e-12; Accession=PF00168.21; Description=C2 domain
  Subcellular localization annotation: CTP_CleavageSite=35; ConfidenceScore=5.72e-01
MILQHASPTSPPLCPCNLFANSASLKFRRKCTVLLCAVPSDNPNWNADFANSARRTATTFVLKRISNQLEPHTTTTTTTTNDNGVIDSELQATPPVQLGSNFTAFSEDPIVDKLRTQLGVIHPIPSPPINRNVVFLFVFFFFVGVVFDKLWTSRRRNKNNSEDRLRGGVWPQVPTSFSLFLEKDLQRKESVEWVNMVLGKLWKVYRGGIENWIIGLLQPVIDNLKKPDYVQRVEIKQFSLGDEPLSVRNVERRTSRRVNDLQYQIGLRYTGGARMLLMLSLKFGIIPIVVPVGVRDFDIDGELWVKLRLIPTEPWVGAASWAFVSLPKIKFELSPFRLFNLMAIPVLSMFLTKLLTEDLPKLFVRPKKIVLDFQKGKAVGPVAGGVKSGEMQEGNKDSVGELSVTLVDARKLSYIFYGKTDPYVILSLGNQVIRSKKNSQTTVIGPPGMPIWNQDFHMLVSNPRKQKLFIQVKDALGFADLTIGTGEYVVDSLYFMPLGLTSPMAAMRTIVVWFPSGDPYSQVTTQKNIVDLGSLKDTVPTDRIVVLQGGWGFLGKRSSGEILLRLTYKAYVEDEEDDKTEVDAIYTDISDDELSDSEANGTNGKDERDSVYETDKESFMDVLAALIVSEEFQGIVASETGFSKVLDNGSNVGSRVSNSQVPNVEPIPSSSDNSEGSGGSALLWLAVITSISLLIALNVGGSSLFNP

SEQ ID NO: 119327 - protein, 277 aa, Glycine max
  Coding DNA Sequence Number=SeqID_27642
  Gene Ontology: Mol. function=structural constituent of ribosome; Cellular component=ribonucleoprotein complex; Biological process =ribosome biogenesis and assembly
  Homolog annotation: Hit_ID=P35685; Match level="QueryCoverage=86%, HitCoverage=93%, E-value=1e-109, Identity=82%"; Hit description=60S ribosomal protein L7a
  Pfam annotation: Domain name=Ribosomal_L7Ae; Domain location=132-227; Score=119.7; E_value=8.8e-33; Accession=PF01248.17; Description =Ribosomal protein L7AeL30eS12eGadd45 family
MAGISIRITRYVTNAFMLKAPKRGGKAPALAAKKKPEKVSNPLFEKRPKQFGIGGALPPKRDLTRFVKWPKNVQIQRKKRILKQRLKVPPALNQFTKTLDKNLATSLFKLLLKYRPEDKAEKKERLLKRAQAEAEGKTVEAKKPIVVKYGLNHVTYLIEQNKAQLVVIAHDVDPIELVVWLPALCRKMEIPYCIVKGKARLGTVVHKKTASVLCLTTVKNEDKLEFSRVLEAIKANFNDKYDEYRKKWGGGIMGSKSQAKTRAKEKLLAKEAAQRMN

SEQ ID NO: 119328 - protein, 485 aa, Glycine max
  Coding DNA Sequence Number=SeqID_27643
  Homolog annotation: Hit_ID=A7PNF0; Match level="QueryCoverage=74%, HitCoverage=68%, E-value=1e-145, Identity=74%"; Hit description =Chromosome chr1 scaffold_22, whole genome shotgun sequence
  Subcellular localization annotation: CTP_CleavageSite=62; ConfidenceScore=5.86e-01
MVAIMQQQQQQQQQQQNPSALVPFQLKNPQSSTTTTAAATPLRSPSAQSQLSSPLSVVPPLRQSPLSSHPVPVTSVEPALTAVPTCPLVRVRLSDIAPYEGAPAGPYLRAMEALCGSLLRHNAALIELGNEDTALMRCGLEGARLFFRSRAHLGSGKGSRGVYMYRAGRALEDWDSSPPCMADIFKCMGKASRSALSAIARHLRLRSDFMIMCAHEKTVALCSVFNHLLDDAPLPANEVSSSVLVVTYSHASLQNGRGAIGGGKPPMNGEVEKGLLTLISSDTPGLQVCDPSGRWYLADSGSVPGDLLLITGKALTHATAGLCPAASYRASPDYFLSPNGGGRTSLAYRLMPQGNAILDCSPIAAAGHVIPQSYVRISVSQFMDDLAAEELIGSRCDNADAAAQNNVNKEPSLRSVLSDPLSGTFLEDAMLVSCGHSFGGLMLRRVIETLLELQQPLSSMRTIGGYFVMPLSESGGKKWVTKWIQ

SEQ ID NO: 119329 - protein, 549 aa, Glycine max
  Coding DNA Sequence Number=SeqID_27644
  Gene Ontology: Mol. function=ARF GTPase activator activity; Cellular component=cytoplasm; Biological process=regulation of ARF GTPase activity
  Homolog annotation: Hit_ID=A7PNG9; Match level="QueryCoverage=91%, HitCoverage=46%, E-value=9e-78, Identity=58%"; Hit description =Chromosome chr1 scaffold_22, whole genome shotgun sequence
  Pfam annotation: Domain name=Ank; Domain location=456-488; Score =40.5; E_value=6.2e-09; Accession=PF00023.21; Description=Ankyrin repeat
  Pfam annotation: Domain name=Ank; Domain location=489-521; Score =26.0; E_value=0.00014; Accession=PF00023.21; Description=Ankyrin repeat
  Pfam annotation: Domain name=ArfGap; Domain location=113-233; Score =58.5; E_value=2.2e-14; Accession=PF01412.9; Description=Putative GTPase activating protein for Arf
  Pfam annotation: Domain name=ArfGap; Domain location=262-385; Score =18.8; E_value=6.5e-07; Accession=PF01412.9; Description=Putative GTPase activating protein for Arf
  Pfam module annotation: Pfam domain module=Ank::Ank::ArfGap::ArfGap; Domain location=456-488::489-521::113-233::262-385
VQTVKQGYLLKRSSSSRGDWKRRFFVLDNQGNLYYYRVKGVKPMAENEADRMDWVNKITGAITSLFNSQFLQQPQFGRVHSQNRNSATGASLASQSEDSQKSLRDDVYSKEVGSVSKILRGIPGNDKCAECSAPEPDWASLNLGILLCIECSGVHRNLGVHVSKVHSFRYKCKSFIYVIVANNNTKCPASYLIIVVNSCRSDRYCGGAAPIRDGHVCSGAVSGRSWSGAGCGAVFCAATSKRTLLFQMPTGKIKVPTTQHSHNKQHQVRSLDRIRSVKIAVIPLSAIPLLESAAPLRYTGIDNYVRSITLDVRVWENTVLELFDNLGNAYCNSIWEGLLLLDHERVGEPNVPMKPCSADAFQHKEKYIQAKYVEKSLIIREEDIPENPSVSIRIWQAVQAVNVREVYRLIATSTSNLINTKYYDEAHHAADAKGHQHGPEACLKVEETTETERCFRGWSLLHLACHSGSALMVELLLQFGADVNMCDYHERTPLHHCITSGKNQLAKFLLRRGARPSVKDAGGLTVLERAMERGAITDEELFILLAECQ

SEQ ID NO: 119330 - protein, 167 aa, Glycine max
  Coding DNA Sequence Number=SeqID_27645
  Gene Ontology: Mol. function=DNA binding; Cellular component=nucleus
  Homolog annotation: Hit_ID=A7PNH7; Match level="QueryCoverage=89%, HitCoverage=52%, E-value=7e-41, Identity=59%"; Hit description =Chromosome chr1 scaffold_22, whole genome shotgun sequence
MVVVAAIATADHNLEPYLKRKRRKSEEHNLGKKVNNRKNQYSKVMLLQDKPVELASKTNLHSALPSSMATYSRISHHMDQRQRIQYDGICSPLKQLMEQNAQAFNQITANLSTYKLQDNIDLFCHTRHNINTILNNMSEMPGIMSQMPPLQVNINEDLASSILLNRT

SEQ ID NO: 119331 - protein, 130 aa, Glycine max
  Coding DNA Sequence Number=SeqID_27646
  Homolog annotation: Hit_ID=A5AI03; Match level="QueryCoverage=83%, HitCoverage=67%, E-value=4e-22, Identity=53%"; Hit description =Putative uncharacterized protein
MAAQSNAGFHNEDIDSILNRHAISFQPGGAINRLSEMVPMGNYFGLSSSSGMIYSGNSSIINSNPVMSQAGNPSSSSLLLDSVPGLKHDTGLAVEWSVDEQYRLEEDLASWPFCIRELIMPSVCKPFYET

SEQ ID NO: 119332 - protein, 236 aa, Glycine max
  Coding DNA Sequence Number=SeqID_27647
  Gene Ontology: Mol. function=hydrolase activity, hydrolyzing O -glycosyl compounds; Biological process=carbohydrate metabolic process
  Homolog annotation: Hit_ID=A7QL73; Match level="QueryCoverage=91%, HitCoverage=96%, E-value=2e-41, Identity=58%"; Hit description =Chromosome chr3 scaffold_117, whole genome shotgun sequence
  Pfam annotation: Domain name=CBM_4_9; Domain location=29-155; Score =0.6; E_value=0.0024; Accession=PF02018.8; Description=Carbohydrate binding domain
MHYPMITLPALKCFQSQCLAHPQKPQYNGGIIQKPELNNGLQGWTAFGEARIEYRESLGNKYVVAHSRNQAHDCVSQKIYLEKDKHYILSAWIQVSEGNDVPVTAPVKTTTRLKFVGAIFAESNCWSMLKDGLTADESGPAELYFEVLPIVLHNSLCTKFDSLLYAVDRLLSERRLCKLSGTTDQNGFFEANLFHGDYEMEISHPAMKNYTFTQRLQVIPTEDFKETKQFVQLPIK

SEQ ID NO: 119333 - protein, 400 aa, Glycine max
  Coding DNA Sequence Number=SeqID_27648
  Gene Ontology: Mol. function=oxidoreductase activity; Cellular component=chloroplast thylakoid membrane; Biological process =metabolic process
  Homolog annotation: Hit_ID=Q38M75; Match level="QueryCoverage=99%, HitCoverage=98%, E-value=2e-86, Identity=66%"; Hit description =Ripening regulated protein-like
  Pfam annotation: Domain name=ADH_N; Domain location=31-190; Score =19.9; E_value=2e-05; Accession=PF08240.3; Description=Alcohol dehydrogenase GroES-like domai
  Pfam annotation: Domain name=ADH_zinc_N; Domain location=226-364; Score=29.5; E_value=2.6e-06; Accession=PF00107.17; Description=Zinc -binding dehydrogenase
  Pfam module annotation: Pfam domain module=ADH_N::ADH_zinc_N; Domain location=31-190::226-364
MNLMQAVRYDAYGGGPAGLKHVEVAVPSPKANEVLIKLEAVSINPIDWKIQKGLLRPLFLPRTFPHIPCTDVAGEIVEIGTQVKDFKVGDQVLAKLTHQRKTPARAISHGCARTKKRNPVCLKAEGRELAADNELILPKAKISSGSAKSVTPLPSPLAVLAQQNSPPQPSLYGGGFAEFAVASESLTAARPSEVSAAEAAALPIAGLTARDALTQIAGVKLDGTGQLKNILVTAASGGVGHYAVQLAKLGNTHVTATCGARNIDFVKGLGADEVLDYRTPEGAALKSPSGRKYDAVINCTTGISWSTFDPNLTEKAVVVDLTPNASSLWTAAMKKITFSKKQLVPFFVNVQREGLEYLLQLVKDGKLKSVIDSKFPLSKAEDAWAKSIDGHATGKIIVEP

SEQ ID NO: 119334 - protein, 162 aa, Glycine max
  Coding DNA Sequence Number=SeqID_27649
  Gene Ontology: Mol. function=metal ion binding
  Homolog annotation: Hit_ID=A7PPV8; Match level="QueryCoverage=60%, HitCoverage=10%, E-value=2e-09, Identity=36%"; Hit description =Chromosome chr18 scaffold_24, whole genome shotgun sequence
MKDETNRNIKPKEWIIIMITYKIGPTVVVVKYDCMKDKTFEHPYLQASGGHIVICEAQNIIESNATETVWLLKIPDDSNWSVGSTEDNSEYESTSVGWYEQKDTVEEEDLTLTFSDKVMVRSFSSKAKKVLQKHTASNFHAFGVAVIASTRCNQEIVQFTEE

SEQ ID NO: 119335 - protein, 108 aa, Glycine max
  Coding DNA Sequence Number=SeqID_27650
  Gene Ontology: Mol. function=heat shock protein binding; Cellular component=chloroplast; Biological process=protein folding
  Homolog annotation: Hit_ID=A7NSU4; Match level="QueryCoverage=91%, HitCoverage=21%, E-value=1e-27, Identity=61%"; Hit description =Chromosome chr18 scaffold_1, whole genome shotgun sequence
  Pfam annotation: Domain name=DnaJ; Domain location=3-67; Score=92.3; E_value=1.5e-24; Accession=PF00226.22; Description=DnaJ domain
MASLYDVLGISVGASCIEIKAAYRKLARTHHPDVVAMDQKESSANQFMMIHSAYSTLSDPEKRAQYDREIYRYRRSANIAGRNQTFSYAGSGRKWETDQCCYPRWFVQ

SEQ ID NO: 119336 - protein, 54 aa, Glycine max
  Coding DNA Sequence Number=SeqID_27651
MVLSATLRVKTNGTIRNSLAKDKENLPFGECDHAMVSSTLCCLGGTVAMILKKI

SEQ ID NO: 119337 - protein, 364 aa, Glycine max
  Coding DNA Sequence Number=SeqID_27652
  Gene Ontology: Mol. function=molecular_function; Cellular component =anchored to membrane; Biological process=biological_process
  Homolog annotation: Hit_ID=A9P812; Match level="QueryCoverage=93%, HitCoverage=96%, E-value=1e-124, Identity=65%"; Hit description =Putative uncharacterized protein
  Pfam annotation: Domain name=Thaumatin; Domain location=31-240; Score= 308.7; E_value=1.1e-89; Accession=PF00314.8; Description=Thaumatin family
MGLLASSCFILIALLLLTPKGVMGATFTFFNKCDYTVWPGILANAGSPPLDSTGFELPKDTSRAFQAPTGWSGRFWGRTGCTFDGSGAGSCLTGDCGSGQVECNGAGAAPPATLAEFTLGTGGQDFYDVSLVDGYNLPMIVEGTGGSGLCASTGCTSDLNQQCPAELRASEGSACKSACEAFGSPEYCCSGAYGSPATCRPSIYSEMFKAACPRSYSYAYDDATSTFTCSGADYTVTFCPSSPSQKSSRDTTTNPMTSTTTSPGSGTVTGTGTGTGSEGAVVYTGADNGVAYNTVTDSGSSSGSGGETMLADGSYLAGLAMGDSPERTVSIAILALPVKLADSLPHCKPPSKRFARKSIPCFIR

SEQ ID NO: 119338 - protein, 111 aa, Glycine max
  Coding DNA Sequence Number=SeqID_27653
MAVESSSSLGMEIRKMGGSFHLVSERALVRYPIVDSSYGGGLLLARNDVVFQWWPVLQDEDIGALVRTVKLNQLGIEGSIEFVDAYGSNMHGPVWKWSRRDGSDLGVGSGG

SEQ ID NO: 119339 - protein, 550 aa, Glycine max
  Coding DNA Sequence Number=SeqID_27654
  Gene Ontology: Cellular component=integral to membrane; Biological process=transport
  Homolog annotation: Hit_ID=A7P899; Match level="QueryCoverage=100%, HitCoverage=99%, E-value=1e-173, Identity=56%"; Hit description =Chromosome chr3 scaffold_8, whole genome shotgun sequence
  Pfam annotation: Domain name=C4dic_mal_tran; Domain location=111-321; Score=-77.7; E_value=0.014; Accession=PF03595.8; Description=C4 -dicarboxylate transportermalic acid transport protein
  Pfam annotation: Domain name=DUF580; Domain location=206-548; Score =203.2; E_value=6.3e-58; Accession=PF04515.3; Description=Protein of unknown function, DUF580
  Pfam module annotation: Pfam domain module=C4dic_mal_tran::DUF580; Domain location=111-321::206-548
MGSSEDPNNKVDFPYESPASQPFLSKPSYPSSSSSAVEEESESNQQFHHITYNSGPRSFKDLPFLILFLLFVLSSFAFGIFAIIHRNNSYPSLSSFTYDPTTTSCVLNPSNSSSSSSVSTLSLVDTTSSVSPKLVKGLIWTLVITFVLSVPLCWALLLLLKHYTKQIVYAAIPLFIAIPVFLNVYWFVACTLGASCSNAFPLAYRVLILVFLFLVIGIIVWILVVNWHRVELTVSIIGVASHALSRNMALFGVLPCLSVGLVLYFVPIVVFMVFARFNGKIVVKNLKSGYDCEWKEDSWVPAYYALAVLTMLWSAAAMVEAQVYVISGTIANWYFSKEHQTPKRSIRTPLRNVFGPSSGTICLSGLLVCVVRMVRSAVDSARQEDTPGIVNLVLRCCVNALLTAVDFLNKFTINFAAITGEAYCSSARMTYELLRRNLLSAVFVETISSRILAGIVFVFSASYTIVACVILKAGTNLGSDSYFVAAMAWVLLMVVLGYLVHVLDNVIDTIYVCYAIDRDRGEVCKQDVHEVYIQLPISRSLRQSVTTRTL

SEQ ID NO: 119340 - protein, 674 aa, Glycine max
  Coding DNA Sequence Number=SeqID_27655
  Gene Ontology: Mol. function=identical protein binding; Cellular component=extracellular region; Biological process=negative regulation of catalytic activity
  Homolog annotation: Hit_ID=A7P8A1; Match level="QueryCoverage=66%, HitCoverage=57%, E-value=0.0, Identity=74%"; Hit description =Chromosome chr3 scaffold_8, whole genome shotgun sequence
  Pfam annotation: Domain name=PA; Domain location=137-235; Score =101.9; E_value=1.9e-27; Accession=PF02225.13; Description=PA domain
  Pfam annotation: Domain name=Peptidase_S8; Domain location=1-374; Score=-22.6; E_value=1.5e-05; Accession=PF00082.13; Description =Subtilase family
  Pfam annotation: Domain name=Senescence; Domain location=312-662; Score=240.3; E_value=4.3e-69; Accession=PF06911.3; Description =Senescence-associated protein
  Pfam module annotation: Pfam domain module=PA::Peptidase _S8::Senescence; Domain location=137-235::1-374::312-662
MSGYAAGIAKGVAPKARLAAYKVCWKNSGCFDSDILAAFDAAVNDGVDVISISIGGGDGIASPYYLDPIAIGSYGAVSRGVFVSSSAGNDGPSGMSVTNLAPWLTTVGAGTIDRDFPSQVILGDGRRLSGVSLYAGAALKGKMYQLVYPGKSGILGDSLCMENSLDPNMVKGKIVICDRGSSPRVAKGLVVKKAGGVGMILANGISNGEGLVGDAHLLPACAVGANEGDVIKKYISSSTNPTATLDFKGTILGIKPAPVIASFSARGPNGLNPQILKPDFIAPGVNILAAWTQAVGPTGLDSDTRRTEFNILSGTSMACPHVSGAAALLKSAHPDWSPAALRSAMMTTATVLDNRNQIMTDEATGNSSTPYDFGAGHLNLGRAMDPGLVYDITNNDYVNFLCGIGYGPKVIQVITRAPASCPVRRPAPENLNYPSFVAMFPASSKGRDGEAVEARVLGGGEEAELCGDGGGGHPEAEDGSVRGGVRVADVDGWEARDVTVERLKWGNDFLKKRLESGSHSQVSPQALESMKRVKKLTMMSEKVATGVLSGVVKVSGFFTSSVVNSKAGKKFFSLLPGEIVLATMDGFNKVLDAAEVAGRNVMSTSSVVTTGLVSDKYGEEAAQVTNEGLDAAGHAIGTAWAVFKLRKALNPKSAIKPTTLAKAAAEATSTKLKK

SEQ ID NO: 119341 - protein, 1894 aa, Glycine max
  Coding DNA Sequence Number=SeqID_27656
  Gene Ontology: Mol. function=ubiquitin-protein ligase activity; Cellular component=intracellular; Biological process=protein modification process
  Homolog annotation: Hit_ID=Q6WWW4; Match level="QueryCoverage=94%, HitCoverage=94%, E-value=0.0, Identity=65%"; Hit description=E3 ubiquitin-protein ligase UPL3
  Pfam annotation: Domain name=Arm; Domain location=209-249; Score =10.4; E_value=0.52; Accession=PF00514.14; Description=Armadillobeta -catenin-like repeat
  Pfam annotation: Domain name=Arm; Domain location=291-331; Score =12.0; E_value=0.33; Accession=PF00514.14; Description=Armadillobeta -catenin-like repeat
  Pfam annotation: Domain name=Arm; Domain location=334-372; Score =20.0; E_value=0.009; Accession=PF00514.14; Description=Armadillobeta- catenin-like repeat
  Pfam annotation: Domain name=HEAT; Domain location=214-251; Score =19.7; E_value=0.011; Accession=PF02985.13; Description=HEAT repeat
  Pfam annotation: Domain name=HEAT; Domain location=339-374; Score =17.2; E_value=0.063; Accession=PF02985.13; Description=HEAT repeat
  Pfam annotation: Domain name=HEAT; Domain location=541-577; Score =5.9; E_value=3.6; Accession=PF02985.13; Description=HEAT repeat
  Pfam annotation: Domain name=HECT; Domain location=1520-1894; Score =371.2; E_value=1.6e-108; Accession=PF00632.16; Description=HECT -domain (ubiquitin-transferase)
  Pfam module annotation: Pfam domain module=Arm::Arm::Arm::HEAT::HEAT:: HEAT::HECT; Domain location=209-249::291-331::334-372::214-251::339 -374::541-577::1520-1894
  Subcellular localization annotation: CTP_CleavageSite=56; ConfidenceScore=5.95e-01
METRSRKRAEASSAAPSSPSSGPTTRSSKRARLSSSSSASAAAAAASVSSVNTRSRSSRTKEPLPPKNPPPMDSANESSGSRRDRRNKDNSDKGKEKEHDVRIRDRDADRGLALNMDGGGDDDDNDSEGGVGILHQNLTSASSALQGLLRKLGAGLDDLLPSSAMGSASSSHQSGRLKKILFGLRADGEEGRQVEALTQLCEMLSIGTEESLSTFSVDSFVPVLVGLLNHESNPDIMLLAARALTHLCDVLPSSCAAVVHYGAVSIFCARLLTIEYMDLAEQSLQALKKISQEHPTACLRAGALMAVLSYLDFFSTGVQRVALSTAANMCKKLPSDAADFVMEAVPLLTNLLQYHDSKVLEHASVCLTRIAEAFASSPDKLDELCNHGLVTQAASLISNSSSGGGQASLSTPTYTGLIRLLSTCASGSPLGAKTLLLLGISGILKDILSGSGVSSKASVSPALSRPPEQIFEIVNLTNELLPPLPHGTISLPIISNMFLKGPIVKKSPAGSSGKQEDTNGNVPEISAREKLLNDQPELLKQFAMDLLPVLIQIYGSSVNGPVRHKCLSVIGKLMYFSTAEMIQSLLSVTNISSFLAGVLAWKDPHVLLPALKIAEILMEKLPGTFSKMFIREGVVHAVDQLILTGNSTNISTQASSAEKDNDSISGASSRSRRYRRRSGNSNPDGNPLDDLKTPVSVNVGSPPNSVDMPTVNSSIRLSVSTAAKAFKDKYFPSDPGAAEVGITDDLLHLKNLCMKLNAGADEQRTNGKGKSKTSGFGLEEYLIGIIADMLKELGKGDGVSTFEFIGSGVVAALLNYFSCGYFSKDRPLETHLPKLRQQALTRFKLFIAVALPSTTEDGTVAPMTVLVQKLQNALSSLERFPVVLSHSSRSSSGSARLSSGLSALSQPFKLRLCRAQGERSLRDYSSNVVLVDPLASLAAIEEFVWPRIQRSELGQKSTVPAGNSESGTTPTGAGVSSPTTHRHSTRSRSSVNIGDTSRKEISQDKSTSSSKGKGKAVLKPAQEEARGPQTRNATRRREALDKDAQIKPVNGDSTSEVNARALVEEVKRGMRKNDEDLDISPVEIDEALVIEDDDISDDEDDDHDDVLRDDSLPVCSPDKVHDVKLGDIVEESNVAPATSDGGQTNAASGSSSKAGTVRGSDSADFRSGYTSSSRGAMSFAAAAMAGLGSANSRGIRGGRDRLGRPLFGSSNDPPKLIFTAGGKQLNRHLTIYQAIQRQLVLDEDDEERFAGSSDYVSSDGSRLWGDIYTITYQRAENQTDRTPPGGSTSNASKSGKSGSVLNSSSEDKLNQTSVLDSILQGELPCELEKSNPTYNILALLRVLEGLNQLASRLRAQVVTDSFAEGKILDLVELSFTSGARVPTEEFISSKLTPKLARQIQDALALCSGSLPSWCYQLSKACPFLFPFETRRQYFYSTAFGLSRALYRLQQQQGADGHGSTNEREVRVGRLQRQKVRVSRNRILDSAAKVMELYSSQKAVLEVEYFGEVGTGLGPTLEFYTLLSHDLQKVVLQMWRSGSSEKYQMEIDGDEKKMKNSEGSFVGDGELVQAPLGLFPRPWPANADASEGTQIFKVIEYFRLLGRVMAKALQDGRLLDLPLSVAFYKLVLGQELDLHDILFIDAELGKTLQELNALVCRKCFIESIGGSYTDTFANLHFRGAPIEDLCLDFTLPGYPEYILKPGDEIVDINNLEEYISMVVEATVKTGIMRQMEAFRAGFNQVFDISSLQIFSPQELDYLLCGRRELWKTETLADHIKFDHGYTAKSPAIVNLLEIMGEFTPEQQRAFCQFVTGAPRLPPGGLAVLNPKLTIVRKLSSSAANASSNGNGPSELADDDLPSVMTCANYLKLPPYSTKEIMYKKLLYAISEGQGSFDLS

SEQ ID NO: 119342 - protein, 69 aa, Glycine max
  Coding DNA Sequence Number=SeqID_27657
MWEDFNPWSHLHKYRPRWFMWVANTDAKAIDSAEIYSSQVLHAEKRTPGKMIEEIKGEKGSSVDDARLV

SEQ ID NO: 119343 - protein, 73 aa, Glycine max
  Coding DNA Sequence Number=SeqID_27658
MGPRCGGATNLRCGGDDEREDEEKEFDRVILSHMYERSNNKIDPIMPLSSGWTGPTGRTEPNFTIMVGRLLEE

SEQ ID NO: 119344 - protein, 92 aa, Glycine max
  Coding DNA Sequence Number=SeqID_27659
  Gene Ontology: Mol. function=catalytic activity; Cellular component =chromatin; Biological process=auxin mediated signaling pathway
  Homolog annotation: Hit_ID=P32295; Match level="QueryCoverage=100%, HitCoverage=100%, E-value=7e-30, Identity=69%"; Hit description =Indole-3-acetic acid-induced protein ARG7
  Pfam annotation: Domain name=Auxin_inducible; Domain location=1-90; Score=178.9; E_value=1.3e-50; Accession=PF02519.5; Description=Auxin responsive protein
MGFRLPSIRRASFKASQAASKSAEVPKGYLAVYVGEKQKRFVIPVSYLNQPSFQNLLSQAEEEFGYDHPMGGLTILCSEDIFQHITAHLNGQ

SEQ ID NO: 119345 - protein, 48 aa, Glycine max
  Coding DNA Sequence Number=SeqID_27660
  Homolog annotation: Hit_ID=Q6V5J5; Match level="QueryCoverage=60%, HitCoverage=7%, E-value=4e-07, Identity=89%"; Hit description =Nuclear division RFT1-like protein
MKRQQSDSHEITEKKQKKKMAEWSKAPDSSSGPRERAWVQIPLLTTLH

SEQ ID NO: 119346 - protein, 55 aa, Glycine max
  Coding DNA Sequence Number=SeqID_27661
MSLAIETLSQAASLKRLKSGCGAGAVADTGGLCTWRGEVVGVVVHCFASPVFYKP

SEQ ID NO: 119347 - protein, 591 aa, Glycine max
  Coding DNA Sequence Number=SeqID_27662
  Gene Ontology: Mol. function=transferase activity, transferring glycosyl groups; Cellular component=chloroplast; Biological process =purine base biosynthetic process
  Homolog annotation: Hit_ID=A9PE93; Match level="QueryCoverage=91%, HitCoverage=93%, E-value=0.0, Identity=84%"; Hit description =Putative uncharacterized protein
  Pfam annotation: Domain name=GATase_2; Domain location=76-270; Score =114.0; E_value=4.6e-31; Accession=PF00310.12; Description=Glutamine amidotransferases class-II
  Pfam annotation: Domain name=Pribosyltran; Domain location=319-470; Score=82.8; E_value=1.1e-21; Accession=PF00156.18; Description =Phosphoribosyl transferase domain
  Pfam module annotation: Pfam domain module=GATase_2::Pribosyltran; Domain location=76-270::319-470
  Subcellular localization annotation: CTP_CleavageSite=36; ConfidenceScore=5.77e-01
MAAAAAATTLSSSLSKPSSLTFQTHSFPITLPTPPRAAAKPPLLVFSKNPISDIVSSTFSRAEEGAWDDEKPREECGVVGIYGDPEASRLCYLALHALQHRGQEGAGIVTVNNNVLQSITGVGLVSEVFNQSKLDQLPGSLSIGHVRYSTAGQSMLKNVQPFVAGYRFGSVGVAHNGNLVNYKTLRTNLEDNGSIFNTTSDTEVVLHLIATSKHRPFILRIVDACEKLEGAYSIVFVTEDKLVAVRDPFGFRPLVMGRRSNGAVVFASETCALDLIEATYEREVYPGEVLVVDKNGIQSLCLMSHPQPKQCIFEHIYFALPNSVVFGRSVYESRRQFGEILATESPVECDVVIAVPDSGVVAALGYAAKAGVPFQQGLIRSHYVGRTFIEPSQKIRDFGVKLKLSPVRAVLEGKRVVVVDDSIVRGTTSSKIVRLLKEAGAKEVHMRIASPPIIGSCYYGVDTPSSEELISNRMSVEEIRDFIGSDSLAFLPFDSLKRLLGSESPNFCYACFSGNYPVEPRELKVKRVGDFVDDGLNGSLESIDGGWVQANRNQIKHKASLSGQKSDAVLQFYLDDTDNNVYIIGQYKFSK

SEQ ID NO: 119348 - protein, 209 aa, Glycine max
  Coding DNA Sequence Number=SeqID_27663
  Homolog annotation: Hit_ID=Q1EPH2; Match level="QueryCoverage=89%, HitCoverage=35%, E-value=1e-24, Identity=33%"; Hit description =Putative uncharacterized protein
MVLPRNALMHVIYSLIIFGYEESSCCTAIADKFATYSPEILASKSFSKLLLAGILLDTANLRDPRCSSKDKYMASLLINGAGRYGCNGLYQLLRYKMHDLSSLQVADILRKDFKKWTGQVSEKLRALIVVSGYYNDEKNFKREVLISTESAKLLESLLFFFDFNASRLPLKSLHFPGLKNGMKAYEIDKITSRKIVEHLIEEFVGIPKA

SEQ ID NO: 119349 - protein, 355 aa, Glycine max
  Coding DNA Sequence Number=SeqID_27664
  Gene Ontology: Mol. function=pyrophosphatase activity; Cellular component=cytoplasm; Biological process=carbohydrate metabolic process
  Homolog annotation: Hit_ID=A7QC23; Match level="QueryCoverage=74%, HitCoverage=56%, E-value=2e-61, Identity=49%"; Hit description =Chromosome chr10 scaffold_76, whole genome shotgun sequence
MRSAGANTPTQKEPYIRTRENPYFDGLLRSDGQIPLKSQLEFTYIGETRPKNFVSDISEEVMELSPENSAVSGLNSKSSEHSSSEKWLKTSKIAPFIQLDILSELIEPDNPKHHHLGYGQSPRTPEQSPAIHNTEKTYTVIRRKEKLSSILLPLSAASYYIGVSPEMEIVESCESIDKLNAFLKARKDDVNAGVPGKFLHAVMGSDGADVGTVASTIMYSFYLHVTSESNQFCTVPIININRANLGSHVELKWLLDSCHIDQSSLIFADEIDLSYYDIFGSLKIVLLKGSRISSKQEKLKQAVVEIFHCRKGETIYPWVKTVTTTEEVLVPLVYHTLVQMVTHLHLASHGVLTYY

SEQ ID NO: 119350 - protein, 403 aa, Glycine max
  Coding DNA Sequence Number=SeqID_27665
  Gene Ontology: Mol. function=identical protein binding; Cellular component=cellulose and pectin-containing cell wall; Biological process=negative regulation of catalytic activity
  Homolog annotation: Hit_ID=A7P7W9; Match level="QueryCoverage=99%, HitCoverage=94%, E-value=1e-106, Identity=56%"; Hit description =Chromosome chr3 scaffold_8, whole genome shotgun sequence
  Pfam annotation: Domain name=PA; Domain location=60-164; Score=54.1; E_value=4.7e-13; Accession=PF02225.13; Description=PA domain
  Pfam annotation: Domain name=Subtilisin_N; Domain location=5-70; Score=5.3; E_value=0.051; Accession=PF05922.7; Description =Subtilisin N-terminal Region
  Pfam module annotation: Pfam domain module=PA::Subtilisin_N; Domain location=60-164::5-70
MGERMNQSEQQLVEDSHLDILSRILRSKGAARRSIQYSYKHGFSGFVAVLSQSHAKLIAGKDLSKFYRIVFGEDIAASDADEKSARSCNSGSLNATLAKGKAILCFQSRSQRSATVAIRIRTVTEVGGAGLIFAQFPTKDVDTSWSKPCVQVDFITGTTILSYMEATRNPVIKFSKTKTVVGQQLSPEVAFFFSRGPSSLSPSVLKPDIAAPGVNILAAWSPASSARLVSDAANEDESDLHPLNFNIDPAALAFYLTKASLKNEYKQYIWAEGAPHKQADPFDYGGGHVDPNKVTDLGLVYDMKNSEYVRFLCSMGYNSTAISLLAGFPTKCQKSHKFLLNMNLPSIIIPELKQPLTISRTVTNVGPIKSIYTARVVAPIGISINVEPSTLTFSSKRKKIKIN

SEQ ID NO: 119351 - protein, 67 aa, Glycine max
  Coding DNA Sequence Number=SeqID_27666
MLKLRGCKSDSSSFAASDTKRAEEAGDQAARILTPGAAISGCTTFINHKHKAFYIFVKIKTIALMKE

SEQ ID NO: 119352 - protein, 194 aa, Glycine max
  Coding DNA Sequence Number=SeqID_27667
  Homolog annotation: Hit_ID=A5APQ9; Match level="QueryCoverage=36%, HitCoverage=30%, E-value=1e-16, Identity=61%"; Hit description =Putative uncharacterized protein
  Pfam annotation: Domain name=CRS1_YhbY; Domain location=52-120; Score= -3.2; E_value=0.018; Accession=PF01985.12; Description=CRS1  YhbY domain
  Subcellular localization annotation: CTP_CleavageSite=48; ConfidenceScore=5.71e-01
MAAIAAAASSHLMFVLRSQPLSSSFISFLKPLLLSIPQRCFYAPSTYPCSTASKTCLRYFLLRFLKMAKKQRLRMMNWKLKEIKIRRSCPGELDDVVKQLEAATGSVAVGQIGRTLIIYRPSLSKMKAEEKKKQNRNLILKKQVKPRLVNKKGKEQVPKLSWPGSSWKGRKKKVGHKTHSDYVDLCPGAWPEQA

SEQ ID NO: 119353 - protein, 37 aa, Glycine max
  Coding DNA Sequence Number=SeqID_27668
MKAGRRSGREKRTEDSLSSDAHAECFPLLLCKCRLMQ

SEQ ID NO: 119354 - protein, 545 aa, Glycine max
  Coding DNA Sequence Number=SeqID_27669
  Gene Ontology: Mol. function=microtubule motor activity; Cellular component=microtubule associated complex; Biological process =microtubule-based movement
  Homolog annotation: Hit_ID=A7P7W1; Match level="QueryCoverage=90%, HitCoverage=42%, E-value=0.0, Identity=73%"; Hit description =Chromosome chr3 scaffold_8, whole genome shotgun sequence
  Pfam annotation: Domain name=Kinesin; Domain location=106-472; Score =455.3; E_value=8.2e-134; Accession=PF00225.14; Description=Kinesin motor domain
  Subcellular localization annotation: CTP_CleavageSite=80; ConfidenceScore=5.99e-01
MASSSRARSSSPFSHRKPSTPLSSASSSTSSFTNGRVMPRSCSSSTSSFYNSGGGGRSMTPSRGHSESVYYGYGNPSPVEFGMDEEVITEPVDSSRARDSISVTIRFRPLSEREYHRGDEIAWYADGDKIVRNEYNPATAYAFDRVFGPHTNSDEVYEVAAKPVVKAAMEGVNGTVFAYGVTSSGKTHTMHLCYLEYIRWKSSCYILPHHHIATFSDTSYCNGDQYSPGIIPLAIKDVFSIIQDVSFPANLANVVEVFVICGTPGREFLLRVSYLEIYNEVINDLLDPTGQNLRVREDAQGTYVEGMKEEVVLSPGHALSFIAAGEEHRHVGSNNFNLFSSRSHTIFTLMIESSAHGEDYDGVIFSQLNLIDLAGSESSKTETTGLRRKEGSYINKSLLTLGTVIGKLSEGKASHVPYRDSKLTRLLQSSLSGHGHVSMHVNKLICTVTPASSNMEETHNTLKFASRAKRVEIYASRNKIIDEKSLIKKYQREISVLKHELDHLKKGMQLGVNHEEIMTLKQKVFVIVTRSGFSFCTTDIWVVGR

SEQ ID NO: 119355 - protein, 126 aa, Glycine max
  Coding DNA Sequence Number=SeqID_27670
  Subcellular localization annotation: CTP_CleavageSite=73; ConfidenceScore=5.25e-01
MEDLLDASFASNSLSKDYEHQSAFQNQDVQVSMRSFPLQTWVPQSQGGSPQRSFTSNLYPQIDSLVGVMEMPKAKAGEGYSNWIYNYDYAAYKLPSICPPLIKKMQTLSLINYAVQLTPFKGHPYV

SEQ ID NO: 119356 - protein, 76 aa, Glycine max
  Coding DNA Sequence Number=SeqID_27671
MFSSRVEINILTKYICIVDYPIQNIVDYLVESKFCRGNDSMSMANYGATSHGNTRSGSQWCKDKRESEGRRASLGY

SEQ ID NO: 119357 - protein, 276 aa, Glycine max
  Coding DNA Sequence Number=SeqID_27672
  Gene Ontology: Mol. function=hydrogen ion transporting ATPase activity, rotational mechanism; Cellular component=proton -transporting two-sector ATPase complex; Biological process=proton transport
  Homolog annotation: Hit_ID=Q9C9Z8; Match level="QueryCoverage=80%, HitCoverage=94%, E-value=3e-80, Identity=65%"; Hit description =Putative vacuolar ATP synthase subunit E; 11053-12830
  Pfam annotation: Domain name=vATP-synt_E; Domain location=16-225; Score=274.4; E_value=2.3e-79; Accession=PF01991.9; Description=ATP synthase (E31 kDa) subunit
MKDADVSRQIQQMIRFIRQEAEEKANEISVAAEEEFNIEKLQLLEAEKRKIRQEYERKAKQIDVRRKIEYSTQLNAARIKVLQAQDDAVGAMKDAAKKGLLRISNDKKVYRKLVKDMIVQGLLRLREPSVLLRCRESDRKLVESLIEEAKKEYSEKANMQAPKIALDDRVYLPPSPKNSAVDSHEPYCTGGIVLASEDGKIVLENTLDARLDVIFRQKLPEACKEAPVRLNNILQFEFSLYVSKWKSKDVATSFPLSLIKANAPPLLFFLFSKTKF

SEQ ID NO: 119358 - protein, 547 aa, Glycine max
  Coding DNA Sequence Number=SeqID_27673
  Gene Ontology: Mol. function=protein transporter activity; Cellular component=clathrin adaptor complex; Biological process=intracellular protein transport
  Homolog annotation: Hit_ID=A7P2Q5; Match level="QueryCoverage=99%, HitCoverage=93%, E-value=0.0, Identity=78%"; Hit description =Chromosome chr1 scaffold_5, whole genome shotgun sequence
  Pfam annotation: Domain name=Adap_comp_sub; Domain location=287-537; Score=143.4; E_value=6.2e-40; Accession=PF00928.12; Description =Adaptor complexes medium subunit family
MVVLAASIVSKSGKEKLNLESLNVEFGVLVSRQFVDMSRIRIEGLLAAFPKLIGTGKQHTYVEMENVRYVYQPMEALYLLLVTNKHSNILEDLATLRLLSKLVPEYSYSLDEEDICQNAFELIFAFDEVISLGHTENVTVAQVKQYCEMESHEEKLHKLVMQSKINDTKDVMKRKASEIDKSKIEKNRGDKGGFGPLQSLGSGKIENSFSDLSISSSGTGFASGSGFGLNSDVDSFSTKSKGRPTSSATAPPKGIGMKLGKSQRTNQFLESLKAEGEVILEHVQPKLGLPQAAALPSTDPISLTVEEKLNVTLKRDGGVSNFDVQGTLSLQILDKEDGHIQVQVQTGENQAIIFKTHPNMNKDLFANENILGLKDPNRPFPTGQAGGSEGVGLLKWRMQSTDESMVPLTSGSIINCWPSSSGNETYVSIEYEALSLFDLQNVVISVPLPALRDAPSVKQIDGEWRYDSRNSFLEWSVLLIDNSNRSGSMEFVVPQAEPSAFFPISVRFIATETFSDLKVTNVIPLNGGNPPKYSQRTQLITENYQIV

SEQ ID NO: 119359 - protein, 224 aa, Glycine max
  Coding DNA Sequence Number=SeqID_27674
  Gene Ontology: Mol. function=binding
  Homolog annotation: Hit_ID=A2Q380; Match level="QueryCoverage=99%, HitCoverage=51%, E-value=2e-78, Identity=70%"; Hit description=ATA15 protein, putative
  Subcellular localization annotation: CTP_CleavageSite=22; ConfidenceScore=5.13e-01
MALAANKVSSSPIVTNRTALCRSGEKHYFSSSTRVNRIQLSRHRLEHGHLNYRCLHRERSTLFNDWFWFINGKPVGLISKKKSSISCKSTGANNTEEKECITTYDDVSDLTRVHTKDEKNDHTLVVHGLADACRFVCNDAKFLSRGIMRMDARARQDVAFLGTEFLKLDARAREDTEKIDRDVKEKASRLSHIATILKDKAQSRLKNAADEHWNDGALEVNLFI

SEQ ID NO: 119360 - protein, 25 aa, Glycine max
  Coding DNA Sequence Number=SeqID_27675
MDIRLRVIEAANTAIFLLNRFPPKQ

SEQ ID NO: 119361 - protein, 599 aa, Glycine max
  Coding DNA Sequence Number=SeqID_27676
  Gene Ontology: Mol. function=zinc ion binding; Cellular component =intracellular
  Homolog annotation: Hit_ID=A7QFY0; Match level="QueryCoverage=23%, HitCoverage=76%, E-value=1e-17, Identity=43%"; Hit description =Chromosome chr9 scaffold_90, whole genome shotgun sequence
MDAPVKKKALSRPSLSPQKKDKCIVFPLVRYNEFRQPVCQACNVVMLESIRAHLASPEHHEVMEKLKANAAGSTEDKDAKPVTVTNNSPKANPEQPQDTASQLPEFSQDVPKQQSPSALPRDFCDDSGKIRTRSVTEMTDPPKEQEHQESIVSPSTDEALTSSKRGRSRKTKPTKFIINQKSNTPSTPRRSKRIKHVADKTANNVPEVSSSEELLKGRTAENSQVDGKEVSSDIDALVIYKRKRLPRRRSSGQIGKSPKKTVPTEPPTAAISSSTTASPPHQDPPAAAPANADASHIENTNTAEPVLSKSLVEEVGKVNPAPANAQEQIASSKGQESPDQVDSKADEVSTGNTPLDLEAINKMIEDDPLSAIENILTGKVSISSKTPQSITQAEQPKVQGSPADVLSKELKDLMQTFSLGDFVTDYEQMSKVLLILEELQKNEKFLSHEQQTFIKAFRLFFNNAVTHRKECDMARIKKVDLNRAKEDILRKLQEVKHTQEQITMSISNADNRVNEISSCIEQLEEQLYKLKEERETFQLAIKEREKQRETLKNDSILWAHQTKDLVFDLAEIEAKEKILGQQLEADNDAYDQFKASFPF

SEQ ID NO: 119362 - protein, 198 aa, Glycine max
  Coding DNA Sequence Number=SeqID_27677
  Homolog annotation: Hit_ID=A7PR83; Match level="QueryCoverage=82%, HitCoverage=97%, E-value=6e-46, Identity=58%"; Hit description =Chromosome chr14 scaffold_26, whole genome shotgun sequence
MGNTMGRSKKAKVMKVDGETLKLKTPARANDVVKDYPGHVLLDSEAVKHFGLRAKPLEPYQELKPTKIYFLVELPKIQPEEEKTALPRRVRSSGIRGMNASDRLQLLMLSKRSVSDLPLSRQSPNLGSDGPIRVKMRLPKAHLDKLMEESTDGSQVAQKIISLYMGTNAGEGAAGVSAPEDGGRKTVHNHKPREVKRH

SEQ ID NO: 119363 - protein, 222 aa, Glycine max
  Coding DNA Sequence Number=SeqID_27678
  Gene Ontology: Mol. function=aspartic-type endopeptidase activity; Cellular component=endoplasmic reticulum; Biological process =proteolysis
  Homolog annotation: Hit_ID=Q9FGI3; Match level="QueryCoverage=90%, HitCoverage=45%, E-value=3e-84, Identity=76%"; Hit description =Similarity to nucleoid DNA-binding protein
  Subcellular localization annotation: CTP_CleavageSite=18; ConfidenceScore=5.31e-01
ANDNNLPTGSFYLGNNPNSARFRYVSMLTFPQSQRMPNLDPLAYTVPMQGIRIGGKKLNIPPSVFRPNAGGSGQTMVDSGSEFTFLVDAAYDAVREEVIRVVGPRVKKGYVYGGVADMCFDGSVMEIGRLIGDVAFEFEKGVEIVVPKERVLADVGGGVHCLGIGRSERLGAASNIIGNFHQQNLWVEFDLANRRIGFGIKAQKSLLGYESVASLLYKLGDE

SEQ ID NO: 119364 - protein, 635 aa, Glycine max
  Coding DNA Sequence Number=SeqID_27679
  Gene Ontology: Mol. function=metal ion binding
  Homolog annotation: Hit_ID=A5AHW0; Match level="QueryCoverage=92%, HitCoverage=83%, E-value=0.0, Identity=59%"; Hit description =Putative uncharacterized protein
  Pfam annotation: Domain name=PHD; Domain location=550-598; Score =36.0; E_value=1.4e-07; Accession=PF00628.20; Description=PHD-finger
MAVEYSIGTRVIIDTDNDTNMRLCLVKSWSGHFVSKRRYHFIIPMDNGWHKPLDEDSIDNEKHLLHGVIHCNGYGHLLCVNGIEEGSKVLSGREIMDLWDRICTNLRVRKIAVEDVSCKRSMDLRLLHGVAYGHSWFGRWGYRFCRGSFGVTEREYNEAMTTLGSLGLDVIVKDLSKTKTKYKAEIKQIIRCYRDMSETHIISLRDLLRFMLTVKSSRAPVPKITDTYSAAADSTSSALTSRNSTKHTLPNRSNSMKDKSVRYKKFSNAVTSIDSRWPTRRLEFAAQVIVDALKENKAVKPGSGGMTRQDVRDAARIHIGDTGLLDYVLKSLNNVIVGNYVVRRMVNPTTRILEYTIHDLGKGLKAPEVETEVMAHVDQQVEESSWKPGNDVYCDALFLYKNVLLSYPDSEAVDTAVQTILDSRYFVKEWPVRDEIKEQVLTFICRLQPNFVDKKHELKGVACGEIVVVPLHATVGDLKRASEAALRDTYCIAESLIVTDIKELMDVSDEEVLFGLIQSGVELCVRGIAIDLLTPLKYEGGSESDNWKVRCECGAQDDDGERMVACDICEVWQHTRCCGIDDSETVPPLFVCTGCCDSVLVPSSRTESTVFGVDSADSFLISEDSTLLLGYEYGY

SEQ ID NO: 119365 - protein, 44 aa, Glycine max
  Coding DNA Sequence Number=SeqID_27680
MLMLMLMKRLWKNVVRVSVPVPPTPMLPKENTNSEALFAGFIKC

SEQ ID NO: 119366 - protein, 205 aa, Glycine max
  Coding DNA Sequence Number=SeqID_27681
  Gene Ontology: Mol. function=nutrient reservoir activity; Cellular component=anchored to membrane
  Homolog annotation: Hit_ID=Q2PES4; Match level="QueryCoverage=67%, HitCoverage=34%, E-value=1e-53, Identity=74%"; Hit description =Putative fasciclin-like arabinogalactan protein FLA2
  Pfam annotation: Domain name=Fasciclin; Domain location=35-171; Score= -10.4; E_value=0.025; Accession=PF02469.13; Description=Fasciclin domain
MPYYISVLQISAADSEAPTAAPSAIDPISIMSKQGCKAFTDLLRGSKALPSFKENVDGGLTVFCPTHSTVSGFAAKYKNLTEAQKVSLLLYHTTPVYESLHMLKSSNEIMNILAIEGANKYDFTVQSEGEDVNLKTKLHGFPPTPNYKFKSISSQTQSVNSDATATQNLYPFCPNNYHIVHFYFEFNSHHFLDSRFRDNFHYMPS

SEQ ID NO: 119367 - protein, 210 aa, Glycine max
  Coding DNA Sequence Number=SeqID_27682
  Homolog annotation: Hit_ID=A5BWW9; Match level="QueryCoverage=87%, HitCoverage=89%, E-value=1e-25, Identity=40%"; Hit description =Putative uncharacterized protein
MSHSHLNSLSSNCSSSMELEIGATHTDQTLEPWFPSDTSTGYLQDAIAGRGIWCKEQNLLSCSKDQKVDEFPMFSTTTAQSFHDCGFTHQKRFVTSNLSSSPQGDTHEAAIKHDPAWSSYAYGQRKKIAYPFKLVKSGGIEGETTLKDINNQILTTPSASKPIPHPVKDSVTNPCKLVRESIGLSGKEVASLTRIHTRGRGSITIIRTKD

SEQ ID NO: 119368 - protein, 264 aa, Glycine max
  Coding DNA Sequence Number=SeqID_27683
  Gene Ontology: Mol. function=protein serine/threonine kinase activity; Cellular component=cell surface; Biological process =protein amino acid phosphorylation
  Homolog annotation: Hit_ID=A7PT10; Match level="QueryCoverage=89%, HitCoverage=34%, E-value=1e-76, Identity=59%"; Hit description =Chromosome chr8 scaffold_29, whole genome shotgun sequence
  Pfam annotation: Domain name=Lectin_legB; Domain location=25-248; Score=270.1; E_value=4.5e-78; Accession=PF00139.10; Description =Legume lectin domain
  Subcellular localization annotation: CTP_CleavageSite=24; ConfidenceScore=5.06e-01
MSLLCFTFVPSMLLSIFCFFNSVTAATEFDFGTLTLGSLKLLGDAHLNNNTVSLTRDLAVPTSSAGRALYSRPVRFRQPGNRFSASFTTFFSFSVTNLNPSSIGGGLAFVLSPDDDTIGDAGGFLGLGGGGGFIAVEFDTLMDVEFKDINGNHVGVDLNSVVSSEVGDLANVGVDLKSGDLINAWIEFDGSSKGLSVWVSYSNLKPKDPVLTMNLDVDKYLNDFMYVGFSASTQGSTEIHRIEWWSFGSSFAAAEAAAPPPPPA

SEQ ID NO: 119369 - protein, 194 aa, Glycine max
  Coding DNA Sequence Number=SeqID_27684
  Gene Ontology: Mol. function=protein kinase activity; Cellular component=extracellular region; Biological process=protein amino acid phosphorylation
  Homolog annotation: Hit_ID=A7PTR1; Match level="QueryCoverage=63%, HitCoverage=24%, E-value=5e-42, Identity=70%"; Hit description =Chromosome undetermined scaffold_30, whole genome shotgun sequence
  Pfam annotation: Domain name=ABC1; Domain location=152-194; Score= -40.5; E_value=0.098; Accession=PF03109.7; Description=ABC1 family
  Subcellular localization annotation: CTP_CleavageSite=63; ConfidenceScore=5.40e-01
MTPKPFNFPAKRTTALFLLTATAVSAAQTSSSAVPSPLPALSPEKIGGEIHGLIRTARAVSTVASTVVDYEFSLRGLPKDSDQYRQTISQVHLRSAKRFLKLCEANKGFYVKAGQFVSAQKVLPKEYSSTLSSLQDQVAPLPFKVIGEVLKDNLGPDFSEMFLSIDEQPVAAASIAQVHRAVLKSGHEVAIKRI

SEQ ID NO: 119370 - protein, 436 aa, Glycine max
  Coding DNA Sequence Number=SeqID_27685
  Gene Ontology: Mol. function=DNA binding; Cellular component=nucleus; Biological process=response to salicylic acid stimulus
  Homolog annotation: Hit_ID=Q0PJH7; Match level="QueryCoverage=100%, HitCoverage=100%, E-value=0.0, Identity=84%"; Hit description=MYB transcription factor MYB177
  Pfam annotation: Domain name=Myb_DNA-binding; Domain location=60-105; Score=58.0; E_value=3.3e-14; Accession=PF00249.22; Description=Myb -like DNA-binding domain
MAIQSQNAFTRSRGGLPIGDGISLNSGVHPVADIPLHDQFSCGNDYALKVRKPYTITKQRERWTDEEHKKFLEALKLYGRAWRRIEEHVGTKTAVQIRSHAQKFFSKILRESSRNSTTLEESIEIPPPRPKRKPIHPYPRKLVEIPKTEISNSELPLRSNSLKPSDFGQENNSPKSVLSTVVSETLGSSDSDTPTRCLSPTSSISDVPTNRFPLAEPKTSFEEEGSPPSSAHDKQPPVKLEFFHKESVSTKDDATEESSGRTLKLFGTTLLITDTCKPSSPTMEPWKPTPAAAMYLMQLQNGCSDITEGPASIVPWWSLPHNTPFMPLHKEPKGNHIYSNLGEFVHKEVQKEGSWTGSNTSSINDGDNIEKSDDQAKSHVHCFSKSEISSISELRVRPKTCGKGFVPCKRRMAERESKYSSICYEEREEQGIKLSL

SEQ ID NO: 119371 - protein, 507 aa, Glycine max
  Coding DNA Sequence Number=SeqID_27686
  Gene Ontology: Mol. function=oxidoreductase activity; Cellular component=nucleus; Biological process=electron transport
  Homolog annotation: Hit_ID=A7PYX8; Match level="QueryCoverage=93%, HitCoverage=84%, E-value=0.0, Identity=68%"; Hit description =Chromosome chr4 scaffold_39, whole genome shotgun sequence
  Pfam annotation: Domain name=Amino_oxidase; Domain location=26-472; Score=282.7; E_value=7.4e-82; Accession=PF01593.15; Description =Flavin containing amine oxidoreductase
  Pfam annotation: Domain name=DAO; Domain location=18-375; Score= -24.3; E_value=0.00043; Accession=PF01266.15; Description=FAD dependent oxidoreductase
  Pfam annotation: Domain name=FAD_binding_2; Domain location=18-352; Score=-143.0; E_value=0.021; Accession=PF00890.15; Description=FAD binding domain
  Pfam module annotation: Pfam domain module=Amino_oxidase::DAO::FAD _binding_2; Domain location=26-472::18-375::18-352
MYGTVTSHIKRQCNSPHTVIVIGAGISGIAAARSLHEASFKVIVLESRDRIGGRIYTDYSFGCPVDMGASWLHGVCNENPLAPLIRGLGLTLYHTGGDNSVIYDHDLESCMLFNIDGHQVPQHIMIEVGDTYKRILAEIVKVRNEHPDDMPILQAISIVLNKHPELRLQGLAHEVLQWYICRMEAWFASDADIIPLKTWDQASAIILVEGYKIFFPENFYTCPFSEHVLTGGHGLMVKGYDPVVKALANDLDIRLNHRVTKISNGYNMVMVTVEDGRNFVADAVIVTVPIGILKANLIEFTPKLPDWKASAINDIGMGNENKIALRFDRVFWPNVEVLGIVAPTSYACGYFLNLHKATGHPILVYMAAGRFAYDLEKLSDESAANFVMQQLKKMFPDASKPVQYLVSRWGTDPNSLGCYACDLVGMPDDVYERLRAPLGNLFFGGEAVSMDDHQGYVHGAYSSGLMAAENCQRHLLQKQGHMENLPLVPSVRHEMFETTIPLQISRI

SEQ ID NO: 119372 - protein, 387 aa, Glycine max
  Coding DNA Sequence Number=SeqID_27687
  Gene Ontology: Mol. function=catalytic activity; Cellular component =nucleus; Biological process=metabolic process
  Homolog annotation: Hit_ID=Q9C9G2; Match level="QueryCoverage=89%, HitCoverage=74%, E-value=1e-102, Identity=49%"; Hit description =Putative amp-binding protein; 53611-55674
  Pfam annotation: Domain name=AMP-binding; Domain location=19-366; Score=96.9; E_value=6.1e-26; Accession=PF00501.19; Description=AMP -binding enzyme
MSSKLQPSQSCNFLDEVSSMKELASHGLLYTLSQSCKEYNDVVSVLAPNIPAMYEMHFAVPMAGAVLNTINTRLDANNIATILRHSEAKVLFVDYEYVPKAKEALELLIAKKYHSSPPLLILIDDINSPTSIQFVELEYEQLVYNDDSNFFPEKIHDEWAPIALNYTSGTTSASKGVVYSHREAKPSERFEIKSIVEILTGGAPSPPSLIEKIESLGFHVMHAYGLTEATGSVLVCEWQQHWNQLPKDEQAQLKARLGVIILTLEDVDVKKVDTMESVSRDGKTMGEIVLRGSSIMKGYFKDLDSTLKAFSDGWFHTGDAGVIHKDGYLEIKDRSKYVIISGGENISSVDLEYVLYKHPRVLEAAVVAMPHPRWGESPCAFVVLKKF

SEQ ID NO: 119373 - protein, 111 aa, Glycine max
  Coding DNA Sequence Number=SeqID_27688
  Gene Ontology: Mol. function=ATPase activity; Cellular component =chromosome; Biological process=chromosome organization and biogenesis
  Homolog annotation: Hit_ID=A5H621; Match level="QueryCoverage=70%, HitCoverage=27%, E-value=7e-17, Identity=62%"; Hit description=SMC1
MLIGTIDSYTRINHNTVDGSKCIRDTPFINGAFVRLVYHLANSIEIKFTCTITSAGASEYHIDESLVNWVTYNNRLKSLGILVKARNFFVFQVSLEKHCFTFISLKNAKVG

SEQ ID NO: 119374 - protein, 182 aa, Glycine max
  Coding DNA Sequence Number=SeqID_27689
  Gene Ontology: Mol. function=nucleotide binding; Cellular component =anchored to membrane; Biological process=response to stress
  Homolog annotation: Hit_ID=A7NWM1; Match level="QueryCoverage=52%, HitCoverage=16%, E-value=9e-38, Identity=75%"; Hit description =Chromosome chr5 scaffold_2, whole genome shotgun sequence
MPKPTAVALLYGQQQQQTSHENMGSGTEKIALIFNMGAGYCDVVVTATTGGASQIKALAGSTIGGEDLLQNMMHHLLPNSENLFKNHGVKEIKQMGAVSSFAPKYKNLTEAQNVSLLLYHATPVYESLHMLKSSNEIMSTLATEGAANKYNFTVQSEGKDVNLKTKVNTKIVNNIYYNKIIL

SEQ ID NO: 119375 - protein, 153 aa, Glycine max
  Coding DNA Sequence Number=SeqID_27690
MDACLEGKGSAASTHDASHINTPKDFCSVDNTNVKGIKTKERVQGLSARQKRGIEKRRKKQKVTQEDEPSLQNFNYGLPSFHSGQVFTFIIYLMYPRMFRAISIKTQASHNKSMMELLQEQLSTTTHEQMMSSIYIAKIKNAIHKATYHTVVI

SEQ ID NO: 119376 - protein, 262 aa, Glycine max
  Coding DNA Sequence Number=SeqID_27691
  Homolog annotation: Hit_ID=A7PTL3; Match level="QueryCoverage=53%, HitCoverage=50%, E-value=3e-25, Identity=40%"; Hit description =Chromosome undetermined scaffold_30, whole genome shotgun sequence
  Pfam annotation: Domain name=FHA; Domain location=123-186; Score =14.1; E_value=0.079; Accession=PF00498.17; Description=FHA domain
MELGDSSKKSRFSSYEKVAAISLVVLAVASPLYIDHRPESGVGFENQMSDGKVGGRSCLSLSTVGLPQLTNDEINLTDGTLPTLGRLKSSEGTKRLWNRIKQGAKRQEVLQPTGRADTRVRSYNQGLSAKGERGCDVIITKDKGVSRVHAEIVVNTMNPNDGAKKKVHELPNKDTALEDGDLVSFGTGTATYKDMQSHYICLFPTYVCLNACKFNLTGAGITHTLGEGCTHVLVDQLMPLKKDLVDAVVTKKSCVLKNWLEV

SEQ ID NO: 119377 - protein, 46 aa, Glycine max
  Coding DNA Sequence Number=SeqID_27692
MVEVGPLKKLCGEWINLRWEMAIEGDGEGRVYIEIEDEDEEEEEKR

SEQ ID NO: 119378 - protein, 284 aa, Glycine max
  Coding DNA Sequence Number=SeqID_27693
MVDNQKDNGTAKKEKRKRNGGSSSTSRANVLSPNIVPESNDNQNVSDLPQRDHPNEPHAEPDNPEEQPAAAAKTTEARNQYQSLRELFNGESSTPCLASDVHDQTNDKGKEVHKKFPTIIVLEEECQNAEHGWADDAPVAAAETGFHQKNGEIDQKGKGKVHQTNPPKLLADAMKSSIINPFSLSSSPSSFLHLEGASFSSWSKPNNSLSVLSFSYSDLQRGVGMQNPMGPFPKQQPLLLSAELLVPSGMEGRWMRNLDLNQPPPQDEELEEAQNEVDNHYLRD

SEQ ID NO: 119379 - protein, 66 aa, Glycine max
  Coding DNA Sequence Number=SeqID_27694
MANARGKTPPFPSCDVAINRVPRLFTLTENPKYSIKLTVFTTHRVANNIVMQYLKIGSRRVILHVF

SEQ ID NO: 119380 - protein, 298 aa, Glycine max
  Coding DNA Sequence Number=SeqID_27695
  Gene Ontology: Mol. function=DNA binding; Biological process =regulation of transcription, DNA-dependent
  Homolog annotation: Hit_ID=A7NXZ1; Match level="QueryCoverage=66%, HitCoverage=65%, E-value=6e-44, Identity=50%"; Hit description =Chromosome chr6 scaffold_3, whole genome shotgun sequence
  Pfam annotation: Domain name=B3; Domain location=33-124; Score=72.1; E_value=1.8e-18; Accession=PF02362.12; Description=B3 DNA binding domain
MGLSYIARPLDEIKEATKEERLCALEAAEAIQINLNSSNPSFIKSMGLPSKFCEEHLPKTLHDMVLEDENGSEYEAVYIGNRAGLSGGWRAFALDHKLDDGDALVFELIEASRFKIYIVRAFPDSVEEKGNNILEEEGNVRATKAPKAACNLESECKTKKPKQAAVYETKESESSQEYLLDSSIDNEVKPQGVNPTNKETKFSQKNTPKKSKYPATADSKGKVQIKTEKPKASIKLSNNTRKSKEGINEIGGSDKLEKNEFVQDADSKLEKVELVEEARKCVTKKLEKTSSKFFRKKA

SEQ ID NO: 119381 - protein, 318 aa, Glycine max
  Coding DNA Sequence Number=SeqID_27696
  Homolog annotation: Hit_ID=A7Q9W0; Match level="QueryCoverage=89%, HitCoverage=90%, E-value=8e-68, Identity=50%"; Hit description =Chromosome chr8 scaffold_68, whole genome shotgun sequence
  Pfam annotation: Domain name=DUF1191; Domain location=26-310; Score =254.8; E_value=1.9e-73; Accession=PF06697.3; Description=Protein of unknown function (DUF1191)
MRVRASFFVLFSLSCLLCVLLSSAQQLPPDAVVSARLLDSHLQDSAFRALFSPITGVPYDAQVPTNLSGIKVSAMRLRSGSLRTRGVLSYKEFEIPIGVVEKPYVERLVLVYQNLGNWSDQFYPLPGFSYLAPVLGLLAYSGINLSASELPELDIRASEKPVLVNFPHVRPAPLGALAKCVYFDLHGSVQFDTLLPGNVCSTMQQGHFSIVVESNAPSPAPSSGGEFQDASGKNNKKNNKFMLRILAPCVVGGIVLLIIILGLLVVLVRRHTKGTRMQQLECVAYSNEIMDMTSIGDIKVPLAFGTRTRPMIEHDYFP

SEQ ID NO: 119382 - protein, 87 aa, Glycine max
  Coding DNA Sequence Number=SeqID_27697
  Homolog annotation: Hit_ID=A5ADM3; Match level="QueryCoverage=58%, HitCoverage=12%, E-value=8e-08, Identity=54%"; Hit description =Putative uncharacterized protein
MAKGCSNNTYEEARKQRLEENKKRFEDLGISRISKNLTEIASSAKKKLRHVPKQKTKKTNVEVEPRRSSRVRNPVRSYREDEQTTSM

SEQ ID NO: 119383 - protein, 172 aa, Glycine max
  Coding DNA Sequence Number=SeqID_27698
  Gene Ontology: Mol. function=small conjugating protein ligase activity; Cellular component=proteasome complex; Biological process =regulation of protein metabolic process
  Homolog annotation: Hit_ID=Q5YJR0; Match level="QueryCoverage=51%, HitCoverage=59%, E-value=1e-38, Identity=88%"; Hit description =Ubiquitin carrier protein
  Pfam annotation: Domain name=UQ_con; Domain location=29-166; Score =66.9; E_value=6.8e-17; Accession=PF00179.17; Description=Ubiquitin -conjugating enzyme
MTVKTSDTCSSRRRSQLVCKRMPGADKPVRARQRMRKEKIPHQAPFAIQAAQLLGRAIGAGLFAITPAGERGMCCKAIKLGNARVAFRTKVFHPNINSNGSICLDILKEQWSPALTISKVAFRTKVLLSICSLLTDPNPDDPLVPEIAHMYKTDRAKYEATARSWTQKYAMG

SEQ ID NO: 119384 - protein, 665 aa, Glycine max
  Coding DNA Sequence Number=SeqID_27699
  Gene Ontology: Mol. function=kinase activity; Cellular component =Golgi membrane; Biological process=vesicle fusion with Golgi apparatus
  Homolog annotation: Hit_ID=A7NY02; Match level="QueryCoverage=93%, HitCoverage=100%, E-value=1e-112, Identity=41%"; Hit description =Chromosome chr6 scaffold_3, whole genome shotgun sequence
  Pfam annotation: Domain name=KIP1; Domain location=22-95; Score =177.2; E_value=4.2e-50; Accession=PF07765.3; Description=KIP1-like protein
  Pfam annotation: Domain name=Pox_A_type_inc; Domain location=194-215; Score=4.2; E_value=20; Accession=PF04508.3; Description=Viral A-type inclusion protein repeat
  Pfam annotation: Domain name=Pox_A_type_inc; Domain location=316-338; Score=0.6; E_value=69; Accession=PF04508.3; Description=Viral A-type inclusion protein repeat
  Pfam annotation: Domain name=Pox_A_type_inc; Domain location=379-401; Score=2.3; E_value=39; Accession=PF04508.3; Description=Viral A-type inclusion protein repeat
  Pfam annotation: Domain name=Pox_A_type_inc; Domain location=432-454; Score=2.8; E_value=33; Accession=PF04508.3; Description=Viral A-type inclusion protein repeat
  Pfam annotation: Domain name=Pox_A_type_inc; Domain location=555-577; Score=8.3; E_value=5.2; Accession=PF04508.3; Description=Viral A-type inclusion protein repeat
  Pfam annotation: Domain name=Prefoldin_2; Domain location=467-564; Score=-2.4; E_value=0.03; Accession=PF01920.11; Description =Prefoldin subunit
  Pfam module annotation: Pfam domain module=KIP1::Pox_A_type_inc::Pox _A_type_inc::Pox_A_type_inc::Pox_A_type_inc::Pox_A_type _inc::Prefoldin_2; Domain location=22-95::194-215::316-338::379 -401::432-454::555-577::467-564
MAASGVHSSKQMRRLESRKSHSWWWDSHISPKNSKWLSENLEEMDRSVKRMLKLIEEDADSFAKKAEMYYQKRPELVALVEEFYRVYRALAERYDHVTGELRKNIPSDLQSQGSGISDAGSEPSSTWPSPTPKRGGRLKSSTRAAGFEYFLGSSGNGTDVYQKDGDESSTLTDSEEESDDSSVNNYSGFSRNGSDLGINRRIMELETELREVKEKLWMQEEEHADGSTRGSRNENTEDLYTKINAYEQELMTVNEKLRLSEEEITKQKIELQKYRLFNTENLEAGFESSLTKKHINEGGEAHKMIEVEGSIDGVDKELFDQNGEIETLARELRITKENLKASEMQITSLKFEANKSSERIQQLHDQLELARKDISTWKTKFNSEKRESTKLHERLARLRTSLSDRDHEIRDLKTEVSDAEQKIFPEKAQLKSEMSKVLEERTHLEEQIREWESRGRCFEDDIRRIQSEKMEMEEALKGEIQLLKAGIEQRENNIKELNTSIDTLKLEKDNLHVEVGSLKEEVNSRDGRIEHLNSHLNELHVEHVQLIAGMEEAHKHVEELKSKAKQLEEEVERQRTVILEGAEEKREAIRQLCFSLEHYRDGYNMLRQHVMGHRRVPVLAAYQGHVYYYGEVMTMFAWCKLYSGLLAIRLIPQYAADAIAKITLP

SEQ ID NO: 119385 - protein, 102 aa, Glycine max
  Coding DNA Sequence Number=SeqID_27700
  Subcellular localization annotation: CTP_CleavageSite=54; ConfidenceScore=5.06e-01
MAFAKRKIAVILFLFMVTAAIASNAASKRNTVYEFGPTVQGEYGNSSATMEISRASANGFPLPLLLPTVIFCVLVFFGSKFLVFGVPILFVLALVVAFLGLR

SEQ ID NO: 119386 - protein, 63 aa, Glycine max
  Coding DNA Sequence Number=SeqID_27701
  Homolog annotation: Hit_ID=A6FJQ2; Match level="QueryCoverage=60%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARITTDKDDAQMENN

SEQ ID NO: 119387 - protein, 49 aa, Glycine max
  Coding DNA Sequence Number=SeqID_27702
MLPPWRIVVVPWLSRSRSGSTKVKIQIHTTTEAAMVIKLAIELAHHLSL

SEQ ID NO: 119388 - protein, 301 aa, Glycine max
  Coding DNA Sequence Number=SeqID_27703
MERDMITMIVDTLSVFYYEKMVGYMPSSFTDLVFAGERIEVGLRRGKFDNATLGSTSNRRFRASGAKKKEGDTHAMTSAPTWPKSQQTPHNTYQYSPHQPRFSAHVKNPSNPVPVQQRVPTQRKGLPHNLTPGGMWTSGPKQMEDVLTSRRFILEVLHEAGMICLVGGMLSGRGPATGFDGQRPDWGLWHEKGGKGCFQPIPVKKPALFPYKSDKAVPWRYTTQGPDERKDASVIHAKDDLSFAKVTNIFGTSSMTRSGQIFVAPELLVPSKDPRGKAKAGMEESDKADLFDGRQVHQIEQ

SEQ ID NO: 119389 - protein, 186 aa, Glycine max
  Coding DNA Sequence Number=SeqID_27704
MHALLGSFNSGNWSDSDDLDRIGLSCHTITRNGDNLVPLDLEIKATLRRNRAERRRKLLQDIIVASILEEETIFSDSLSPDSPSSREFATQLPETTSMEDEQHQKITLEDYSSSSGNLFQGLPNEDPYEHLATFIEICNTVKIAEKVVEKFLKKYFPESMIAEGKAAISSFHQFPDESLSEALKRL

SEQ ID NO: 119390 - protein, 69 aa, Glycine max
  Coding DNA Sequence Number=SeqID_27705
  Homolog annotation: Hit_ID=A5B2X9; Match level="QueryCoverage=72%, HitCoverage=3%, E-value=8e-07, Identity=48%"; Hit description =Putative uncharacterized protein
MAEEPRRVTLEDYSSSTVPQIFHYLPNEDPYAHLATYIEICNTIRLAGVPADSIRLSLFSFSLAGEAKR

SEQ ID NO: 119391 - protein, 206 aa, Glycine max
  Coding DNA Sequence Number=SeqID_27706
  Gene Ontology: Mol. function=aspartic-type endopeptidase activity; Biological process=RNA-dependent DNA replication
  Homolog annotation: Hit_ID=Q6WAY3; Match level="QueryCoverage=94%, HitCoverage=7%, E-value=4e-11, Identity=30%"; Hit description =Gag/pol polyprotein
MVGYVPSSFADLVFADERIEMGLKRGKFNHPAWTNEKTGANEEDEKEGETHAVTAHSYTAKFPTSSTPSLLSLYQPFSLPTTHLSIKAIPKSTTKPTYHTTNAKHHLYHKPKHQPRNEFCSEKPVGFTPNSDSYANFLHYLLYTTMVAITSARFPQPPFFRGYNSNAMCAYHGGAPGHSTEHCRALKRKVQSLIDAGWLKFEENRV

SEQ ID NO: 119392 - protein, 157 aa, Glycine max
  Coding DNA Sequence Number=SeqID_27707
MEVPTAHKDLIWEDIQAEFDIPEASDSRTKRKLLQTVGERWRQFKSNLTRKWALAADQDGVEDTDVRKKAQTIQKQNTAPHVLSRGGYDYLEQKLLAEKTKKKLEEAAQSGSIDGVIDPPSPVRRHVKWKMARTKKIGEMTTEAAKEITEKIDSFEE

SEQ ID NO: 119393 - protein, 195 aa, Glycine max
  Coding DNA Sequence Number=SeqID_27708
  Gene Ontology: Mol. function=NADH dehydrogenase (ubiquinone) activity; Cellular component=integral to membrane; Biological process=electron transport
  Homolog annotation: Hit_ID=Q5MA12; Match level="QueryCoverage=57%, HitCoverage=78%, E-value=1e-55, Identity=96%"; Hit description=NADH -ubiquinone oxidoreductase chain 1
  Pfam annotation: Domain name=NADHdh; Domain location=48-190; Score= -168.7; E_value=0.0013; Accession=PF00146.12; Description=NADH dehydrogenase
  Subcellular localization annotation: CTP_CleavageSite=6; ConfidenceScore=5.08e-01
MSSSVQDSTPSRAGCRPRWSWEPTYTFLGLALPQHLNQMRAPKRNQPSLFQKALLGRRCLFTSLGQCSKHESVTPPSPMLSHRQRLGKRGRATCRETCTCGSGRGPRYTVLICVGPRNSSEIVMAQKQIWSGIPLFPVLVMFFISRLAETNRAPFDLPEAEAESVAGYNVEYARDAILNSPLLAEANVRGPGDSF

SEQ ID NO: 119394 - protein, 182 aa, Glycine max
  Coding DNA Sequence Number=SeqID_27709
MATMMEAMMSMKKIMEANAVIVAATSAVAKQMNHPTSNMVGKDLGSTDDPMMCKFKTSTPSRHMVCLPNYTPPNVVYIPNEDVNNSTPILIKSQQPQSDHAHVSRPMEETHEIPHHDLANFEPCLGYAAEGQAVGGIPLQNTLEGPQYHPQPQPSRSTAVKNPHDYGRNGKVGSSRGKAQGH

SEQ ID NO: 119395 - protein, 157 aa, Glycine max
  Coding DNA Sequence Number=SeqID_27710
  Homolog annotation: Hit_ID=Q6UUU1; Match level="QueryCoverage=54%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVWARLSHSTPDTQFPGKQFAPKLD

SEQ ID NO: 119396 - protein, 72 aa, Glycine max
  Coding DNA Sequence Number=SeqID_27711
GVNYMQIDIFFAVAPNLQVVVIIKKGENVNHEDFDDIKKNLLEKGGDVNHASFDGVEKKSHVCHHQKGGECE

SEQ ID NO: 119397 - protein, 98 aa, Glycine max
  Coding DNA Sequence Number=SeqID_27712
AFHSRYPKGTRSNLFSKLSRKETGTKNKDFIQENGSQAFLSYAVKTESLKVSKEGRAVTSGRDSRRAGGDQRRPFNLRGGTEKSKAKAAGDGWSDQLL

SEQ ID NO: 119398 - protein, 45 aa, Glycine max
  Coding DNA Sequence Number=SeqID_27713
MRGRTLRRDFDGYGLELLFEIYHRLFQALPLRLTSSLSSEALTSS

SEQ ID NO: 119399 - protein, 261 aa, Glycine max
  Coding DNA Sequence Number=SeqID_27714
  Homolog annotation: Hit_ID=Q2HW90; Match level="QueryCoverage=81%, HitCoverage=54%, E-value=2e-19, Identity=28%"; Hit description =Putative uncharacterized protein
MGSSQKPSLKKRFYQVKIKSLEVTSLGELGQLMGQLQRVEVSMEPIASLSQYYDQPLRCFTFEDFQLVPTVKELEEILGCQLGGRKPYLFFGFYPSTTRVAKANGLSFIDILALLIFGVVLFPNMEGLVDLAVIDAFLAFHHGKESPVVAILAMYDTFDRGCEKSGARIVCCALALYVWLVSHLFLQEGRPVYPLQGHRSCVEKGKANWDQLLASMEGRLGCINYNPILAIRQLGYPMRGVPSDESITPFIARGFSDPNAR

SEQ ID NO: 119400 - protein, 180 aa, Glycine max
  Coding DNA Sequence Number=SeqID_27715
MTLLLSNILPSDRNADLPLRKYQLGSHPQDTQWTRKSPTGPWGFQLWLRASISPTRCPYPPGKGSRLQDTQWTRRSPTGSWRVQALITGLCQFYGVPVTSSKGIRPPTNRAFIKKYCVSRQAQGETPQQPGDGRQRATDAPPSPLEFTSAHPQKGLSIAYTTWPTNRRPSPKPKDAPSCS

SEQ ID NO: 119401 - protein, 115 aa, Glycine max
  Coding DNA Sequence Number=SeqID_27716
  Gene Ontology: Mol. function=phosphoprotein phosphatase activity; Biological process=intracellular signaling cascade
  Homolog annotation: Hit_ID=A7PHV0; Match level="QueryCoverage=97%, HitCoverage=35%, E-value=2e-20, Identity=42%"; Hit description =Chromosome chr13 scaffold_17, whole genome shotgun sequence
MWAWEQCPTLAPKRTPSQVENKPLGHRWLRRGNQHIGNDDVRVFRRKLDIMKRHEFVWEPYTATVISLLPPICVLRSVAWYAVVPLICFQVIEWHQPDKVLRQFGMQQPIPESPS

SEQ ID NO: 119402 - protein, 139 aa, Glycine max
  Coding DNA Sequence Number=SeqID_27717
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=73%, E-value=5e-25, Identity=66%"; Hit description=LacZ protein
MDLCIRDEWGTFVIAKTTTIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 119403 - protein, 51 aa, Glycine max
  Coding DNA Sequence Number=SeqID_27718
MAEINQGTDASGDGVTTDQSLPLPGAKQAENVAARQPSILYGCSFFYYCLF

SEQ ID NO: 119404 - protein, 243 aa, Glycine max
  Coding DNA Sequence Number=SeqID_27719
  Homolog annotation: Hit_ID=Q2HW90; Match level="QueryCoverage=76%, HitCoverage=47%, E-value=3e-20, Identity=31%"; Hit description =Putative uncharacterized protein
AITSLTQYYDQPLRCFTFGDFQLVPTIEEFEEILGCPLGGRKPYLFSGCLPSLSRIATVVKDSARGLDRVKQTRNGIAGLPRKYLEDKARDMANQEDWVPFMDVLALLIFGVVLFPNVDGLVDLAAIDAFLAYHHSKESPVVAVLADLFDTFDQSAINWFPRWKEGKEGVLFSCGDYPNIPLIGTRGRPAGMQAWHWPSFYNVVTGKTLALPNLIALQHIPLSPAGVIAKRPAPIALPNSCAA

SEQ ID NO: 119405 - protein, 52 aa, Glycine max
  Coding DNA Sequence Number=SeqID_27720
MDEDQGMYDSVMSEKVYMNDQNEDEGGVNEEHVDCSDAFNTFQVFATRDDVL

SEQ ID NO: 119406 - protein, 118 aa, Glycine max
  Coding DNA Sequence Number=SeqID_27721
  Gene Ontology: Mol. function=NADH dehydrogenase (ubiquinone) activity; Cellular component=integral to membrane; Biological process=ATP synthesis coupled electron transport
  Homolog annotation: Hit_ID=P0AFE9; Match level="QueryCoverage=100%, HitCoverage=23%, E-value=2e-59, Identity=94%"; Hit description=NADH -quinone oxidoreductase subunit M
MIAHGLSAAGLFILCGQLYERLHTRDMRMMGGLWSKIKWLPALSMFFAVATLGMPGTGNFVGEFMILFGSFKVVPVITVISTFGLVFASVYSLAMLHRAYFGKAKSEIAAQELPGMSL

SEQ ID NO: 119407 - protein, 76 aa, Glycine max
  Coding DNA Sequence Number=SeqID_27722
MMITKDDDKGDDKKLKDQSKNNSSESKINQRTTQVNQEQFKSSRSQESRSIFETQDSGIKRRLNQDKYEKFFSKIE

SEQ ID NO: 119408 - protein, 249 aa, Glycine max
  Coding DNA Sequence Number=SeqID_27723
  Homolog annotation: Hit_ID=Q2HW90; Match level="QueryCoverage=48%, HitCoverage=29%, E-value=1e-07, Identity=25%"; Hit description =Putative uncharacterized protein
ILGCPLGGRKPYLFSGFYPSLARISKKVQISAQELDRQRQVENGVVGIPRKYLEGVLFPNVDGLVDLAAIDVFLAYHNHKESPVVAMLADLYDTFDRRCEESNAMIVCCTTALYVGLVSHLFLQEGRPVYPLQGYRSCVEKGKANWDQLLASMGGRLLIGSLARRKEESRFYLHAKDDKELRGSSNGSIGGYHKWLRVRTQGLDWLPNLKIVRDDEVKASEESDEVQALKADLERAWVVEEKFKSIAIK

SEQ ID NO: 119409 - protein, 75 aa, Glycine max
  Coding DNA Sequence Number=SeqID_27724
MTLTIPELFLRPYQVTWDTTVFGVFNPDFSFYIEHEDRELYANGLESRIGLGLESIIGLGLEESRLFYSTKSYLI

SEQ ID NO: 119410 - protein, 108 aa, Glycine max
  Coding DNA Sequence Number=SeqID_27725
  Homolog annotation: Hit_ID=A8ARU6; Match level="QueryCoverage=30%, HitCoverage=42%, E-value=4e-10, Identity=84%"; Hit description =Putative uncharacterized protein
MAYERGGDFLEDARKILNREAFPPGGSLVRSPVPAFRFTGVIPLLWPRLSHSTPDTQFRGRAVRSKLGLYARTPPFSPTAAPYPVTIVLSPTRKDMQKHHWQQPLVID

SEQ ID NO: 119411 - protein, 242 aa, Glycine max
  Coding DNA Sequence Number=SeqID_27726
  Pfam annotation: Domain name=Transposase_23; Domain location=137-207; Score=-3.3; E_value=0.0028; Accession=PF03017.5; Description =TNP1ENSPM transposase
FKEQASQGSFIPHGRQDILTATIGRPEHPGHVRAARADATIKQYFGSTPRTSCSSSSLPPEELQQLTQQIRDQLEESITEKLTRQLMASFSQIQSQFQFQMQSQGLTLPPEPLVGPSGPRVSTKESCVDPSGNDPRTSDSDRCSLYIEANPVCLVALGRVYEGSTVVHNTPLLPGQVKVGVEEVKDPDAPIPVPTDEVSLVGLAIHIFLAWPTHLVKPLSHQLCLQQNHLKSRIRRSMILFI

SEQ ID NO: 119412 - protein, 227 aa, Glycine max
  Coding DNA Sequence Number=SeqID_27727
MDWDQLLAGIGGVVLITIPTLAIRQLGYPMRGAPTEESMSPFLVRDLGRTKFPRLYKESIRHGKPRLRKDQELRGIRNGIIGGEENFEAPEEDEEVQALKSELGKAKLAKEKFKLAATHVRKECAGLWEENAITARALEQETKRARKEEYGRNKFRGALWGSNNEIKLRREERDQSRAHSMVLKEELIACSRSKRSLSQRLCETETNMLAIIAKYQEELGLGHGPRA

SEQ ID NO: 119413 - protein, 97 aa, Glycine max
  Coding DNA Sequence Number=SeqID_27728
MFEFDAESESEFDIDYMSGDVLPLEIDFLGSDRTNHASGSSYTSDFLYEVQAEKPSLSTTIQPPTPELKPLPSNLKYAYMDDSKNFPVIIFVSLADE

SEQ ID NO: 119414 - protein, 294 aa, Glycine max
  Coding DNA Sequence Number=SeqID_27729
  Homolog annotation: Hit_ID=Q84VH5; Match level="QueryCoverage=100%, HitCoverage=46%, E-value=1e-127, Identity=77%"; Hit description =Envelope-like protein
MIPGPGPVPEKLVPKRQQRVKISENPSFATSPREEDTEMDKKIRSLVNSILKNASVPDADKDVPTSSTPNAEWRGINRGRRSSHRRDPAPRAPEPAPGDLIDLEEVESDEEPIANKLAPGIAARLQGRKGKAPITRSGRIKTMAQKKSTPITPTTSRWSKVAIPSKKRKEISSSDSDYDVELDVPDIKRAKKSGKKVPENVPDAPLDNISFHSIGNVERWKFVYQRRLALERELGRNALDCKEIMDLIKAAGLLKTVTKLGDCYESLVREFIVNIPSDITNRKSDDYQKVFVRG

SEQ ID NO: 119415 - protein, 157 aa, Glycine max
  Coding DNA Sequence Number=SeqID_27730
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=93%, HitCoverage=16%, E-value=1e-54, Identity=92%"; Hit description=DNA -directed RNA polymerase subunit beta''
MDSVGIRSANPYLATPGATVHGHYGEILSEGDILVTFIYEKSRSGDITQGLPKVEQVLEVRSIDSISMNLEKRVDTWNGRITKILGIPWGFLIGAELTIAQSRISLFSRTARVLSKAALRGRIDWLKGLKENVVLGGMIPVGTGIQKNNEPFKAKAI

SEQ ID NO: 119416 - protein, 152 aa, Glycine max
  Coding DNA Sequence Number=SeqID_27731
  Homolog annotation: Hit_ID=Q9LKS8; Match level="QueryCoverage=51%, HitCoverage=22%, E-value=8e-07, Identity=34%"; Hit description =Putative uncharacterized protein T15F17.m
MCRSSAGELVPLDLEIEATFRRNNVERKRKLLHDRIIAPILEEAYFSESSSSNSPTFGESQTAEFESEVMVEEQPRRVNLEDYSRTSKPQYFSSVAWPEVQAQNLTYPPSLIQLIQCNLFHGLPNEDPYSHLATYIEICNTVKLASAPEDAI

SEQ ID NO: 119417 - protein, 171 aa, Glycine max
  Coding DNA Sequence Number=SeqID_27732
  Pfam annotation: Domain name=G-patch; Domain location=1-42; Score =16.8; E_value=0.0017; Accession=PF01585.14; Description=G-patch domain
MEVRVMLRNGFEPGMGLGKDCLGNADVVDIKGNSYKYGLGYEPEMPGRRNVPSRFQADRVWPGRISQCFTSAGMVSEEEVAAIEEEFPQDPPSFLQPCHPDSQVGNWRVISQSEVYTADSICEGRFFEDPNNECLTIDFDRDISQMINEERGRGRPCHLSWRGWSLRKNVK

SEQ ID NO: 119418 - protein, 107 aa, Glycine max
  Coding DNA Sequence Number=SeqID_27733
MLCTRLPWLREQLYFEVYVEAKLHDESRLIQICFDDNQGDDKKLKGQSKNEFKMFKIKSRKNEFKIESRTLQDSRIKLPRIKIKIQESREDLIKISMKRFFQKLSST

SEQ ID NO: 119419 - protein, 33 aa, Glycine max
  Coding DNA Sequence Number=SeqID_27734
SPGRAEAVMSASEADSTEDSGPGEMAISGDSSS

SEQ ID NO: 119420 - protein, 237 aa, Glycine max
  Coding DNA Sequence Number=SeqID_27735
MERSMIDATSGGALGDMTPAEARNLIEKMASNSQQFSAISDAIVIRGVHKVATNSSSSAEIKKLEDSGLCSSADYHMDLCPSVQQFEAIEQPEAYAANIYIRPPQPQQQNQPQQNNYDLSSNRPYVPQPIQQQTVEAPPQPSLDELVRQMTMQNMQFQQETRASIQSLTNQIGQLATHLNQQQSQNSDRLPSQSVQNPKNVSTIALRSGKQCQGPQPATSSSSANEPAQLHSTPKKR

SEQ ID NO: 119421 - protein, 114 aa, Glycine max
  Coding DNA Sequence Number=SeqID_27736
MVTQNNESDKFLLWDRECAELIGQIADDVNRVKIEDGDLDLNASPQALDKLLGHVLAFKACSKIDPSNVDCDDATHAECQSLSVTAYHDPVVGLPLTPKKRMSSDEADDELGSS

SEQ ID NO: 119422 - protein, 68 aa, Glycine max
  Coding DNA Sequence Number=SeqID_27737
MTLHLALVKPADKIILDQMNGTRATRNSERKDKSWDIPETGGMAEETKKQSFFRSVPYITSEFDDNKE

SEQ ID NO: 119423 - protein, 204 aa, Glycine max
  Coding DNA Sequence Number=SeqID_27738
  Gene Ontology: Mol. function=oxidoreductase activity, acting on paired donors, with incorporation or reduction of molecular oxygen, NADH or NADPH as one donor, and incorporation of one atom of oxygen; Biological process=...
  Gene Ontology: Biological process=ubiquinone biosynthetic process
  Homolog annotation: Hit_ID=Q8YJC1; Match level="QueryCoverage=82%, HitCoverage=39%, E-value=4e-80, Identity=85%"; Hit description=2 -OCTAPRENYL-3-METHYL-6-METHOXY-1,4-BENZOQUINOL HYDROXYLASE
MPVKKRAAQGKCNPVPMVGSGRAARQNIGFHARRYVPKHCAKDGFWKGTTMAGQKKVDAPRNNDVVIAGGGYVGLVTAVAIKSAAPHLVLTVIDGAPAGAWKNDPRASSIAAAASRMLDQLGCWQEILPEAQPITEMVITDSRTSDPVRPVFLTFEGEVEPGEPFAHMVENRVLNTALHNKAETLGITFLEATSVDSFNTLPEG

SEQ ID NO: 119424 - protein, 35 aa, Glycine max
  Coding DNA Sequence Number=SeqID_27739
MLMHNPPIWALQKIPPEGGCFWRKQPCSPGRAELA

SEQ ID NO: 119425 - protein, 97 aa, Glycine max
  Coding DNA Sequence Number=SeqID_27740
  Subcellular localization annotation: CTP_CleavageSite=44; ConfidenceScore=5.16e-01
MAVHGGNFVFSARTSRCRPPFVTGASLPELVTAVCAGVSLPEVVAAACACGCGCRGSLRVWGAGGTRLVQGRLAVGFSLRWKVVLNHRAVLEGLLAE

SEQ ID NO: 119426 - protein, 78 aa, Glycine max
  Coding DNA Sequence Number=SeqID_27741
MEHISKLENGGHMNDNPIHSWLRKKMRMEDCLEGHLLGNHGTQLQTRKAIMEHSSKLESGGHMNSPKTIIHSCGSGKG

SEQ ID NO: 119427 - protein, 55 aa, Glycine max
  Coding DNA Sequence Number=SeqID_27742
MDEDQWRYDFAMSQEVHMDYDYDNQEECGVNEPHVDCSNAFNTSQGCVVGIRYSR

SEQ ID NO: 119428 - protein, 200 aa, Glycine max
  Coding DNA Sequence Number=SeqID_27743
MVMKHTRGNPNIPTTTRSRSPKSRMGKDHGDWNGFSVQRGYRRKRTHYQKPHGESSMRRSRRLDDLSVYQGLLNRTSRVATAHTYGGVRDERHYGNECTLRARKTITREREITDTARRLDKLHKSATLAPVEVTTLNIGQHLSKLWGLEKLVTLLLVKATALDTRQSPSTPDNLFHSQAGSKLGGLMYCPGSTKWMWQLT

SEQ ID NO: 119429 - protein, 195 aa, Glycine max
  Coding DNA Sequence Number=SeqID_27744
LHVLALIGLHVLTIRGLHALTSRGLHVLALRGLHALTLGLHVLTTRGLHALTSRGLHVLALRGLHALTLGTSYPHCSEDYMSSPSKGYTSSAFERATRPHLKGLVTLHLEGLHASPSEDYTGLHVLALRGLHVLTIRGLHALTSRGLHVLALRGLHALTLGTSYPHRQRTTRPRLERTTRPHHQRAARPSPPEDY

SEQ ID NO: 119430 - protein, 49 aa, Glycine max
  Coding DNA Sequence Number=SeqID_27745
MEDTLTALSNNIHVAPKRGVRMEDCLEGPHLGNHETQLQTRKWRTHEQP

SEQ ID NO: 119431 - protein, 82 aa, Glycine max
  Coding DNA Sequence Number=SeqID_27746
TLVSTATPLGLEVIPQVKELLDEGVPTDPKRIKVIPEWPTPPTPLIELVRNHVPSWEDAQEMGVEGRSPEYEEPRIEVKSFP

SEQ ID NO: 119432 - protein, 16 aa, Glycine max
  Coding DNA Sequence Number=SeqID_27747
MGMKVVTETTDRQKKD

SEQ ID NO: 119433 - protein, 161 aa, Glycine max
  Coding DNA Sequence Number=SeqID_27748
MILIIVIKRKGHALRRPYRTRARARVMGEAEEVQEKMKADMEAMKEKMATMIEAMMSVKKIMEANAVAIAATSVVAKVNLMSLSGINQMNHPTSDMVGKDLGSTGSPHNVQIQNEHAFPPYGLPLNYTPPKVAYTPNKNVNNSTPIPIESQQPQTDHAHVS

SEQ ID NO: 119434 - protein, 170 aa, Glycine max
  Coding DNA Sequence Number=SeqID_27749
MAKFDPDIVLEFYANACPTEEGVRDMRSWVRGQWIPFDADAIDQLLGYPLVLEEGQECEYGQRRNRRRVRIMRTNMTTLTQIWMTLLLSNIQPSDHNSDLPLPKCQLVYAILTRMSIHVAQLIADAIYIFEGMAPTRHPLDPDKSNRALGFSALITGLCQSFGVPVAPSK

SEQ ID NO: 119435 - protein, 101 aa, Glycine max
  Coding DNA Sequence Number=SeqID_27750
MKESLKRLTLNSHTSMGRTIQDEAATSPSSSESEEAKREESSEEIYPQEEGKPLMVKEECKETLVSIATPFGLEFIPQVKELLDEGLVRKSFKSLCFVVPK

SEQ ID NO: 119436 - protein, 270 aa, Glycine max
  Coding DNA Sequence Number=SeqID_27751
MERSRSPSRTAHDGKGDDHNCGYMPTNFADLVFAGERIESGLRKGKFEYAANMAPNNNRRAPAMGARKKEGDAHAVTTAPTWMKAPQNIQSSYQPNPPNFLIRAGNSLPTQVKGPPAAERAPAQRTAPAAPRPVNNTAPGATYKYAQHPKDNFPPIPMAYSELWPSLLENHLVVAIPGKVLQPPYPSGMIRCQEGPYVKTNPLSSHGGASVNVIQNDGPSRTIRLGDVATSRRFIYQSLRAAGMVSRGGGEEDECLFLLEESHDMETCPT

SEQ ID NO: 119437 - protein, 105 aa, Glycine max
  Coding DNA Sequence Number=SeqID_27752
MTRTRGLGRVIDRVVGRDRATDEDADDVPERRRPTASARRLRVHQMTTEGRDMAEDVADMTDDVPEQPTEALEMRADAQGADSGEGSDGDDVAEGSNSCSPGDPL

SEQ ID NO: 119438 - protein, 66 aa, Glycine max
  Coding DNA Sequence Number=SeqID_27753
  Subcellular localization annotation: CTP_CleavageSite=41; ConfidenceScore=5.06e-01
MCCKAIKLGRRQGFPSHDVVKRRPVNCNTTHYRANRSSTAVAAALELVDPPGCRNSIRRWRIHEQR

SEQ ID NO: 119439 - protein, 152 aa, Glycine max
  Coding DNA Sequence Number=SeqID_27754
  Subcellular localization annotation: CTP_CleavageSite=14; ConfidenceScore=5.21e-01
MTTRPRLQRATRPRLQRAAHPPLQRATRHCLQRVACPRLQRATHLCLQRTTRPHLQRSTRPPLQRATGPRLQRTTGPLPLEDYMSSPSEDYTSSPLEDYMSSPSEDYTSSPSEDYTSSPSEGYMPSPSEDYNFSPSKGYRSSPSEDYTSSPS

SEQ ID NO: 119440 - protein, 139 aa, Glycine max
  Coding DNA Sequence Number=SeqID_27755
  Homolog annotation: Hit_ID=A5BSR3; Match level="QueryCoverage=74%, HitCoverage=33%, E-value=4e-12, Identity=38%"; Hit description =Putative uncharacterized protein
DVRKKAQAIQKQNTAPHVLSHGGYDYLEQKLMAEKTKKRLEEAAQSGSTEGVIDPLSPIRRHVKWKMARTEKTGQMTSEIVKEIAKKIDSLEEQASQGLFVPHGRPDLLTAAIGRPEHPGRVCAAGSDVTIKQYFGSAP

SEQ ID NO: 119441 - protein, 172 aa, Glycine max
  Coding DNA Sequence Number=SeqID_27756
MQKVYTDNHSGISGRQREAKVSMTDLVSVEDNLNLHVSTRACRPRLTKAQKTTVVSACYHGFSSYRQQKVYTDNHSGISGRQRDSKVSMTDLVSAEDNVNLHVSTGLSAAIDEGRRRRHSKTFIRITTRVFPARQRDSKVSMTDLVSAEDDVNLRVPTGLSIAIDEGRRTRR

SEQ ID NO: 119442 - protein, 99 aa, Glycine max
  Coding DNA Sequence Number=SeqID_27757
MADQQATKSKAKYRLKAQVEKNEGPSGEGQSPRIYQGNPCGVYRDLSSFTGSGVYPDLSSFTGSGVYPDLSSFTGSGIIQNLRSLYQTIRSYSGSHQCA

SEQ ID NO: 119443 - protein, 336 aa, Glycine max
  Coding DNA Sequence Number=SeqID_27758
MSGRGHITSQCPTKKTMIMRGQDIYSSLDEATTSPSSSKSEEAKGEESSEEIYPQEEGQPLMVKEECKEVSVSSKRLAKKERHFEIKTNIKEISLLRQPPHFLLCKKTLVSIATSLRLEFIPQVKELLDEGLLRKRLNPCALLVPKIGFPTPKDPLYKILDELRSLKLWKEKQERKEKGKKRVEEISQDEKEKIKEDERRKILKELRKEKHASYSSHNSYKSLSDELRDYYEGRHRAHLRPHSHRREKERKPQEANINLPCFHGKDNVVANLDWEIRVEQQLKKKSTSKSYGSHSYPKKDRGQGILGVTPSKTKDDKGKTIEKQPLKASMQERLAP

SEQ ID NO: 119444 - protein, 40 aa, Glycine max
  Coding DNA Sequence Number=SeqID_27759
MESWRTALRNNFAGLSRGSRLEGGGCMNSARQVFYPIPKP

SEQ ID NO: 119445 - protein, 233 aa, Glycine max
  Coding DNA Sequence Number=SeqID_27760
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=92%, HitCoverage=42%, E-value=1e-112, Identity=98%"; Hit description=ATP synthase subunit alpha
  Pfam annotation: Domain name=ATP-synt_ab; Domain location=19-218; Score=338.8; E_value=9.7e-99; Accession=PF00006.16; Description=ATP synthase alphabeta family, nucleotide-binding domain
KFSKATGRIAQIPDVANEELIIGDRQTGKTAVATDTILNQQGQNVICVYVAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGSMTALPIVETQSGDVSAYIPTNVISITDGQIFLSADLFNAGIRPAINVGISVSRVGSAAQIKAMKQVA

SEQ ID NO: 119446 - protein, 115 aa, Glycine max
  Coding DNA Sequence Number=SeqID_27761
MDGILISSVAVLSLLRCWWLIHDSLDRIWVFTQQTQFVPSDADEAHSMFPLACMPLVLWGVVRLVVSSLANVRVLTIGSCVAYLPNGIRVASQTHSIQASLLGTLEDFKVPHVNH

SEQ ID NO: 119447 - protein, 79 aa, Glycine max
  Coding DNA Sequence Number=SeqID_27762
MNEAQRLPSRELSLVEIRTKCIGGLAILLSPVYNWGTPTTNNKKGSSTLASVYMDGTTSLRLNNQLFLLRARNKETGLW

SEQ ID NO: 119448 - protein, 121 aa, Glycine max
  Coding DNA Sequence Number=SeqID_27763
MELQRLNQNEEINKKKRSIALKASSSMKKENEEEELEHKEDFSLFVKKFQKLVKKRRIEKRQNFNNGRRSQEDSQIPRCYKCNQLGTSKKIVLQMRNGLRKVIRKGMKKEGPRRPTLHGMT

SEQ ID NO: 119449 - protein, 128 aa, Glycine max
  Coding DNA Sequence Number=SeqID_27764
NSMKARLAKEKFKSAATHIQKECAELQEENAATVRALEQETKRARKEEYGREKFRGALWGSNNELKLRREERDRSKRSLAQHLEATEQNMLAIIGQYKEELNQSMAHEQKLVEVFAQMYAEKEARGEG

SEQ ID NO: 119450 - protein, 28 aa, Glycine max
  Coding DNA Sequence Number=SeqID_27765
MADKCILDEWKRESLEEPNKKLFIAMAG

SEQ ID NO: 119451 - protein, 93 aa, Glycine max
  Coding DNA Sequence Number=SeqID_27766
  Subcellular localization annotation: CTP_CleavageSite=61; ConfidenceScore=5.39e-01
MAHPRPPPAAHPRAGSRAQYPAVKSHAAASAVGCDRKNPRPCLSVVPARQMPPAVAAGFLACNAKKAGDRAQTGAAPAERPASFAATVWQSAV

SEQ ID NO: 119452 - protein, 232 aa, Glycine max
  Coding DNA Sequence Number=SeqID_27767
  Gene Ontology: Mol. function=hydrolase activity, hydrolyzing O -glycosyl compounds; Biological process=carbohydrate metabolic process
  Homolog annotation: Hit_ID=A1R1F0; Match level="QueryCoverage=39%, HitCoverage=17%, E-value=4e-29, Identity=61%"; Hit description =Xylosidase/arabinosidase
  Subcellular localization annotation: CTP_CleavageSite=58; ConfidenceScore=5.37e-01
MSGRTLGVNSQHPSFFASASSQAAQDQASVHVATHLPNAPSPRAPRAHEPTGHLSRPREATGTVCLHSVGNRLLVRFPQRCGGGSTSLVPAGPSAASDPSTRPQRAPPWGLSVRTRRTSPVGGEKLEHRSNPVLDADWPDPDVLRVGDDYWMIASSFHRAPGLPVLRSQDLVTWEHVSNALPALVPEEHYALPRRGSGVWAPSIREHAGTFHIVYPDPDHQAYRYRRPRGGA

SEQ ID NO: 119453 - protein, 60 aa, Glycine max
  Coding DNA Sequence Number=SeqID_27768
MMHSMRGWIKWRIEIIMKKKGGEEGMMVFLDKTELMGKNDPEAYLEWEMKIEHVFSCNNY

SEQ ID NO: 119454 - protein, 85 aa, Glycine max
  Coding DNA Sequence Number=SeqID_27769
MCDTYPTLFNTELKNPNRATRGVLESTRNATIANEECLSDYIEKIHFQHRLFRTFYIDFKTDVESDDVECMNVNIGFGEPMLTYI

SEQ ID NO: 119455 - protein, 68 aa, Glycine max
  Coding DNA Sequence Number=SeqID_27770
MKMLLIPHDVAPCGACRPWIFFINGFLCFLKMNGSGMEKEERDYRRCHFKEKMSQEEAHHYRKPWIRA

SEQ ID NO: 119456 - protein, 122 aa, Glycine max
  Coding DNA Sequence Number=SeqID_27771
MLLCKFVMTKMLKPCSNVFNNKNQISVLELYIEKDVVGGSMFHFANSLTSCRNNLSNNEAQPPTNVSNLHGDEDDDDDDDYLVSNSYVEESLDEDDSVDGISDTDNEVTDMIQPVRIVHPTE

SEQ ID NO: 119457 - protein, 109 aa, Glycine max
  Coding DNA Sequence Number=SeqID_27772
  Subcellular localization annotation: CTP_CleavageSite=43; ConfidenceScore=5.37e-01
SLPPVSLSSSCGIRTNLSNGTTTAKWHLAVATYPSAGGRRVTRGMRVPRKEYARSRHQRLFEENVGKTGKDEIYELFSERFGSCIYARGRVFPFAPTYSSIWDEKIRPT

SEQ ID NO: 119458 - protein, 247 aa, Glycine max
  Coding DNA Sequence Number=SeqID_27773
  Gene Ontology: Mol. function=ATP binding; Cellular component=integral to membrane
  Homolog annotation: Hit_ID=Q1DA34; Match level="QueryCoverage=78%, HitCoverage=23%, E-value=2e-20, Identity=36%"; Hit description =Putative permease
MGMDLDWSIPYLDTIQRGSEQFSAVTGYQSREMGRADSAGNVVATVQAVLAEPQLFLMLGARAEAGRLFSDDDARPGAEPVALVSAALWKSEFGGNPATLNQKLWLGGIGYRIVGVLPPSFSFPQRDVRIWLPLGFTEEQTAMSNAGSFGNLAAMARLTRTTDSNAARTGIKALVGAQPTLAAISEQIGLKIGVEPLRSIWLEDRSTTLISMMGAGLLVFAVTLANVYNLSNSCSPGDPLVLERPPP

SEQ ID NO: 119459 - protein, 394 aa, Glycine max
  Coding DNA Sequence Number=SeqID_27774
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=98%, HitCoverage=13%, E-value=3e-59, Identity=32%"; Hit description=CTV.20
MGIDAAVLMCLRDIRHNKFEDSLIGTVETSLGQGLVYFNCYPNKTVSLMDRNILDSMFLNIHFHDLDMKEGSIPAALIYRIQYKVMNTCASRVLLQPQKGETTLFITDMTKANVSLKRIIKWDEVTLPEKWVMEKATPSDPRPAPIIEDIKQDNSGKVEITFNRRNSFSSRIEASRSEYELARRSFSFPTVNLQGLDTTSSIPSTTYNQDQEDDQKSIQSPTYSSMDLMILSDNFSIDKETLRKDFYSPENEPQRRWFFQHYKGTNRKQIQDKFYEFVERVKINVLFFDWFHAYAIRKNIDYPWKQDIIGDPTTNVITNWQVKDGELIQSELPPATQYQLPNIKDSNNKPVMAIPFKTKDVNEEVTSRDIKSLMEQANYTNKYLQAIGETIKTK

SEQ ID NO: 119460 - protein, 99 aa, Glycine max
  Coding DNA Sequence Number=SeqID_27775
MKADMEAMKEQMATMMVAMMSMKKIMEANAVAVAATSVVAKVNPTPPFGLNQMNHPTSDMVGKDLGGTGDPHLVRKTTMPSHHMACLPTIHHPMWHTLP

SEQ ID NO: 119461 - protein, 136 aa, Glycine max
  Coding DNA Sequence Number=SeqID_27776
MTEREMITIMVDTLPTFYYEKLIGYMPANFVDLVFAGERIKRAPVVGTQKKEGDTHAVTTAPTWMKAPQNAQKSYQHNPPNFSIRVGSSLPTQVEGPPAIEKTPAQHTAPATPRPANNTTPGASYNNAWRSPPPPG

SEQ ID NO: 119462 - protein, 129 aa, Glycine max
  Coding DNA Sequence Number=SeqID_27777
MTQRAGSPRRHLLPFRHSRVRWHAEINYGHSAPLCHLEAAGPMTCGDKLWSFRTPFAIQTQSCPMARRDKLWSFCTLLSSRGGGTDDMRRQIMVIPHTFCHSDTVVSDGTQRQIMVILHPFVIQRRRAR

SEQ ID NO: 119463 - protein, 163 aa, Glycine max
  Coding DNA Sequence Number=SeqID_27778
RNEWAPFIDVLALLIFGGVLFSNVDGLVDLAAIDAFLAYHNHKESPVVAMLADLYDTFDRGCEKSSARIVCCALALYVLLVSHLFLQEGRPVYPLQGHRSCVEKGKANWDQLLASMEGRLLIGSLARRKEESGLYLHAKDVQMFPGWEHGVVLIMLVLSSTEL

SEQ ID NO: 119464 - protein, 64 aa, Glycine max
  Coding DNA Sequence Number=SeqID_27779
MGHATLPPFSCYSCLNMCPPSARYRDNIHRFRSTEHQQRFETIKGWSFHKERRVQLRDNEYTDF

SEQ ID NO: 119465 - protein, 144 aa, Glycine max
  Coding DNA Sequence Number=SeqID_27780
SRPLWWACGVLIPSPCVNNVEEKLHDESRLIQRCFDDNKDDDKGDDKKLKGQSKNEFKMFKIESRTLQDSRGKLNSRIKNQDSRIKLPRIKIKIQESREDLIKISMKKFFFQKLSSTWIFLKTCLPKSFYSLVIDYQIVVIDYQ

SEQ ID NO: 119466 - protein, 65 aa, Glycine max
  Coding DNA Sequence Number=SeqID_27781
MTLGAEFNVESLTCRDWNTSSKASQKVCVQFCARKKRTTYISMKFSRFKKLGLGFDMLMKDRDTG

SEQ ID NO: 119467 - protein, 73 aa, Glycine max
  Coding DNA Sequence Number=SeqID_27782
MARSVSASCPYSRELKRLLVIIPKVVISLLMVSRVPSESPTVATYPSAGGRRVTREMRVPTKAIRAESPPTFI

SEQ ID NO: 119468 - protein, 129 aa, Glycine max
  Coding DNA Sequence Number=SeqID_27783
MVKSWNLLRADQRLIFAKSWPRASRYQQGHQDLFILRSDPSVTAPPDISAGKCSGPAARNPPTPAALNAPLQGASHSPFRLRNCWEGRSVRASSLLRQLAKGGCAARRLSWVTPGFSQSRRCKTTASEL

SEQ ID NO: 119469 - protein, 116 aa, Glycine max
  Coding DNA Sequence Number=SeqID_27784
  Homolog annotation: Hit_ID=Q6WAY4; Match level="QueryCoverage=85%, HitCoverage=18%, E-value=8e-10, Identity=36%"; Hit description =Putative uncharacterized protein
MGSSQMPSLKRRFYQVKVKSLGTTSLKELGQLMGQLQRQAFRKAYGKIWDLAMEEVSTEASASLAQYYDQPLRCFTFGDFQLSPMVEEFEEILGCPLEGRKPYLFSGFYPFPLLRN

SEQ ID NO: 119470 - protein, 179 aa, Glycine max
  Coding DNA Sequence Number=SeqID_27785
  Homolog annotation: Hit_ID=Q84VH5; Match level="QueryCoverage=83%, HitCoverage=23%, E-value=1e-74, Identity=87%"; Hit description =Envelope-like protein
AKTSGKKVPGNVPDAPLDNISFHSIGNVERELGRDVLDCKEIMDLIKAAGLLKTVTKLGDCYESLVREFIVNLPSDITNRKSDEYQKVFVRGKCVRFSPAVINKYLDRPTDGVVDIAVSEHQIAQEITAQQVQHWPKKGKLSAGKLSVKYVSYPNFVRGPLLDDMPPFFGPCEVLGTHH

SEQ ID NO: 119471 - protein, 152 aa, Glycine max
  Coding DNA Sequence Number=SeqID_27786
GLHVLTLRGLHVLTIRGLHALTSQRTTCPRPEGCTPSPLRGLLSSLDFSRGLHVLAVLTIRGLHALTIRGLHVLALRGLHALILGLHVLTIRGLHALTSRGLHVLALRGLHALTLGLHVLAIRGLHALTFRGLHVLALRGLHALTLGTSYPH

SEQ ID NO: 119472 - protein, 137 aa, Glycine max
  Coding DNA Sequence Number=SeqID_27787
MASRKRKSIGTRPTSQYDTRRFSSLDVWTRYTDNVLGRNILPMRKVELYHTELDDFKAELERRHLVKIDANSLNTFLETPVVLAEGETLPAYSKYCRLPTDFREIEAALCIPDRGFILNSEGQPGKILRKDLTTLAQ

SEQ ID NO: 119473 - protein, 76 aa, Glycine max
  Coding DNA Sequence Number=SeqID_27788
HQPLLSSFHQEVLRLQASAEQNTTAAWGCRQRATDAPPSPLKFTSGHPQKGLSIAYTTWPANRRPSPKPKDAPSCS

SEQ ID NO: 119474 - protein, 72 aa, Glycine max
  Coding DNA Sequence Number=SeqID_27789
  Gene Ontology: Biological process=transposition, DNA-mediated
  Homolog annotation: Hit_ID=Q1J7G7; Match level="QueryCoverage=47%, HitCoverage=48%, E-value=7e-12, Identity=97%"; Hit description =Transposase
MVKVGTSYVPINVSFRQKLAQGFPVLQWLLFLSAVPPVQLLTGWCVTAKAPPDISAGKCSGHAARNHHTRRA

SEQ ID NO: 119475 - protein, 139 aa, Glycine max
  Coding DNA Sequence Number=SeqID_27790
  Gene Ontology: Mol. function=nucleoside-triphosphatase activity
  Homolog annotation: Hit_ID=A1G0G1; Match level="QueryCoverage=100%, HitCoverage=22%, E-value=3e-40, Identity=61%"; Hit description=ABC transporter related
MVSHDRHLIGLVCDTYWRVADGVVEPFDGDLDAYAAWLRTRPQAQGTKARMEQVEEPVVVKTAPVAQVVQKKPVNPHKLAAAEAKVAELEGALAELARQLADPANYADATRMAVLGRDRETAAAQLEKAEAAWMELLES

SEQ ID NO: 119476 - protein, 24 aa, Glycine max
  Coding DNA Sequence Number=SeqID_27791
MGEENKGMDVGGEDDINHVIGSWA

SEQ ID NO: 119477 - protein, 562 aa, Glycine max
  Coding DNA Sequence Number=SeqID_27792
  Gene Ontology: Mol. function=transporter activity; Cellular component= cell outer membrane; Biological process=transport
  Homolog annotation: Hit_ID=A7VMQ2; Match level="QueryCoverage=99%, HitCoverage=67%, E-value=1e-99, Identity=38%"; Hit description=TonB -dependent outer membrane receptor
  Pfam annotation: Domain name=TonB_dep_Rec; Domain location=249-562; Score=99.3; E_value=1.2e-26; Accession=PF00593.15; Description=TonB dependent receptor
MRWHSDAALINGVIDAGGSGRIIGTLDFYRKSSRESAPMYKKLNSSAPRESIVGSHGQKNSTQRDSISLAHVFTPGNNTLIDTMESKVFYQRTRVGDDTVSAQDIVTSSRWRSTGMETENPLENVSTFSDMNTKTYGLQSEITKDYGAQALNYGVNFSITDFSRPFEQVGADHPTLQPQGNNRTYDTNVWLSDTITIGALSVMPGLKYSWHKINPQGFEAPSDDKALGALTLAEINEIHGKTFTDGKLLPSLTVMYASKQGFNTYLQYKRGVSYPTSSQIAGIWLHPRIGRASPAMVGNSDLKSETSNQFELGVVGKAARGLTVRGNVFYNSYDNFIYNRKYALRDYQTGAPKPGVQSLLARLPASISSLTIAENRDKAYIYGAEVVTRIDYGALFGAAHGLSSTFAVGYNQGKSKSSYSGDGWVELDSVLPVKAIASLAWDDPQNRYGASLTATFIKGKQAVDPVRQNFPNNGSLSFEEYSGKYEKNYLRVPGYSIFDLTAYYNVKKHLTVAMGVYNLTNRRYWEYASNRKMTTTSEQDLRDIALGAAPGRTYQLSVTAMF

SEQ ID NO: 119478 - protein, 122 aa, Glycine max
  Coding DNA Sequence Number=SeqID_27793
  Homolog annotation: Hit_ID=Q6WAY6; Match level="QueryCoverage=57%, HitCoverage=12%, E-value=3e-11, Identity=42%"; Hit description =Putative uncharacterized protein
MDWDQLLAGIGGRTISWFPRWKEGKEGVLFSCGRYPNIPLIGTRGCINYNPTLAIRQLGYPMRGAPTEESMSPFLVRDLGAQNQDYTKILRQKPRVEEVQALKSELGKAKLAKEKFKLAATT

SEQ ID NO: 119479 - protein, 155 aa, Glycine max
  Coding DNA Sequence Number=SeqID_27794
MKREKHASYSSHNSCKSLSEELCDYYEGRHRSHLRPHSHRREKERKPQEANIKLSYFHGKDNVEANLDWEIRVEQQLKKKSTSKSYGSHSYPKKDKGQGILGHITSQCPTTKTMIMRGQDIYSSQDEATTSPSSSESEKAKGEESSEEIYPQEEG

SEQ ID NO: 119480 - protein, 36 aa, Glycine max
  Coding DNA Sequence Number=SeqID_27795
  Homolog annotation: Hit_ID=P62538; Match level="QueryCoverage=100%, HitCoverage=14%, E-value=5e-12, Identity=100%"; Hit description =Replication initiation protein
MAEIAVINHKKRKNSPRIVQSNELTEAAYSLSRDQK

SEQ ID NO: 119481 - protein, 193 aa, Glycine max
  Coding DNA Sequence Number=SeqID_27796
  Subcellular localization annotation: CTP_CleavageSite=48; ConfidenceScore=5.02e-01
MSISPYGSIRWFVSFRHRGRAHKIPSGPEGAQQGSGVSSSGYRPLSVLQGARSPQQGIVPTRHPVDSEEPNRALGFPALVTGLSVSPTRCPFPPARSRHHDVGVAPTRHPMDPEEPNRALGSPARVTGLCQSYRAPIPPASSCHRDIGKDHARKPPSGPEEVQQGLGVASSDYGPLSVLRSACRPHQGHQAPY

SEQ ID NO: 119482 - protein, 86 aa, Glycine max
  Coding DNA Sequence Number=SeqID_27797
MTTLTQTWMMLLLSNILPSDHNSDLPLPKCQLVYAILTRMSVHVAQLIADAIYLFAGMPPTRHHLDPDKSNRALGFPALIYERVGC

SEQ ID NO: 119483 - protein, 38 aa, Glycine max
  Coding DNA Sequence Number=SeqID_27798
IVIIKKGEIVEGDCRMSYPNFVRGPLLDDMRPFFGPCE

SEQ ID NO: 119484 - protein, 150 aa, Glycine max
  Coding DNA Sequence Number=SeqID_27799
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
ECHVVISLIQCASAHEETGCQPPQCPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 119485 - protein, 73 aa, Glycine max
  Coding DNA Sequence Number=SeqID_27800
  Homolog annotation: Hit_ID=P03845; Match level="QueryCoverage=47%, HitCoverage=83%, E-value=2e-11, Identity=88%"; Hit description =Putative uncharacterized protein 1
MDTSSPPFSPWANIYAGDKVLMRWRFSGCCQWCSLHVFPGWTQDDSYRIRRSGRTERGVRAYSPAWSELPTRN

SEQ ID NO: 119486 - protein, 221 aa, Glycine max
  Coding DNA Sequence Number=SeqID_27801
  Homolog annotation: Hit_ID=A5B5G6; Match level="QueryCoverage=31%, HitCoverage=20%, E-value=5e-08, Identity=44%"; Hit description =Putative uncharacterized protein
  Pfam annotation: Domain name=zf-CCHC; Domain location=91-108; Score =22.6; E_value=0.00058; Accession=PF00098.14; Description=Zinc knuckle
MKREKHASYSSHNSCKSLSEELRDYYEGRHRSHLRPHSHRRENERKPQEANINLPYFHGKDNVETYSDWEIRIEQKLKRKSTSMQEKTSSIKCFKCLGRGHITSQCPTKKTMIMRSQDIYSSQDEATTSPSSSEIEEAKGEESSEEIYPQGEGQPLVFKEEYKEKLVSIATPLGLEFIPQVKELLDEGLVRKSLNPCALSVPKIGIIRHQIPKIGGMMMFE

SEQ ID NO: 119487 - protein, 87 aa, Glycine max
  Coding DNA Sequence Number=SeqID_27802
MRGSGEFVPFSDTTSRGSEMPQRTFLRRRHGPSVGLFTVGIKTEPICNAYANDTMRGIIPFEEHIVAVGTTSNNRFSKRKALDEGSL

SEQ ID NO: 119488 - protein, 113 aa, Glycine max
  Coding DNA Sequence Number=SeqID_27803
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=75%, HitCoverage=7%, E-value=7e-43, Identity=100%"; Hit description=DNA -directed RNA polymerase subunit beta
  Pfam annotation: Domain name=RNA_pol_Rpb2_1; Domain location=14-106; Score=-27.6; E_value=4e-05; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGFNFGKVVGIKLIDTVDPRGGGPDQLLSL

SEQ ID NO: 119489 - protein, 144 aa, Glycine max
  Coding DNA Sequence Number=SeqID_27804
  Homolog annotation: Hit_ID=O52175; Match level="QueryCoverage=56%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCARLKLN

SEQ ID NO: 119490 - protein, 95 aa, Glycine max
  Coding DNA Sequence Number=SeqID_27805
MGPGSIATKTFENIKFPRGRSGIKSFDAELVDQEGNSIPSTTKILPWSPNPKLRRPENAFFQETKAHVMVAFFHIIGDLEYNHEEQPRNSVIFLL

SEQ ID NO: 119491 - protein, 205 aa, Glycine max
  Coding DNA Sequence Number=SeqID_27806
MAPRKLASKRSRKDKAAEGTSSAPEYDSHRFRSAEHQQRFEAIKGWSFLRERRVHLRDDEYTDFQEEIVRRRWASLVTPMAKFDPDIVLEFYANAWPTEEGVRDMRSWVRVLEEGQECEYGQRRNRADGFDEEAIAQLLCIPGQDFSRTAAGRRVRIMRTNMTTLTQIWMTLLLSNIQPSDHNSDLPLPKCQLVFGAYQAPSGPG

SEQ ID NO: 119492 - protein, 270 aa, Glycine max
  Coding DNA Sequence Number=SeqID_27807
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLEFMRRNPTSMLKIFKACNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 119493 - protein, 236 aa, Glycine max
  Coding DNA Sequence Number=SeqID_27808
MAPRKLASKRSRKDKAAEGTSSAPEYDRHRFRSTKHQQRFEAIKGWSFLRERRVQLRDDEYTDFQEEIVRRRWASLVTPMAKFDPDIVLEFYANAWPTEEGVRDMRSWVRGQWIPFDADALSQFLEYPLVLEEGQECEYGQRRNRSDGFDEEAIAQLLCIPGQDFARTAAGRRVRIMRTNMTTLTQIWMTLLLSNIQPSDHNSDLPLPKCQLVYAILTRMSIHVAQLIADAIYLFA

SEQ ID NO: 119494 - protein, 53 aa, Glycine max
  Coding DNA Sequence Number=SeqID_27809
MKRKKREIKSEALPEENLSRGAAVTLPRHFREQIHEDFPSFFTVIRSFCGLQS

SEQ ID NO: 119495 - protein, 275 aa, Glycine max
  Coding DNA Sequence Number=SeqID_27810
  Homolog annotation: Hit_ID=Q6WAY6; Match level="QueryCoverage=53%, HitCoverage=23%, E-value=3e-12, Identity=34%"; Hit description =Putative uncharacterized protein
MTVKTSDTCSSRRRSQLVCKRMPGADKPVRARQRMRKEKIPHQAPFAIQAAQLLGRAIAAGLFAITPAGERGMCCKAIKLGNARVFPVTTLDLRMTDRRKEAIPFFWVLSFDGENSRGDQDLGMRIRLSEAKLVDLAAIDTFLAYHHSKESPVIAVLADAYDTFDLRCEKSSARIVYCTPAFYVWLVSHVFNHESRSVCPLQGHRICVEKDKANWEELLAGMTRASISWFPWWKEGGEGVLCSCEGFPNVPWMGTRGCINYNPMLAIRQLGYPMR

SEQ ID NO: 119496 - protein, 109 aa, Glycine max
  Coding DNA Sequence Number=SeqID_27811
MFIDGLRPQTKQLLDASAEGKIKLKTPKEATELIENMSVNDHAILRDRVHQPTKKSLLELSSHDALLAHNQLFYRKLEILSETLGNQQRQGHTQGGFSGFQQGPYNRQG

SEQ ID NO: 119497 - protein, 123 aa, Glycine max
  Coding DNA Sequence Number=SeqID_27812
MSWKRTHYFSMPHQENHDYEGQDIYTVAKMRLLLHLPLVKVKKQKGKNLVKRSTTKKKDNFKWLRRSVRRQPPHILLGKKTFVSIATPGRLEFIPQVKELLDGGLVRKSLNPCALLVSKIGTH

SEQ ID NO: 119498 - protein, 170 aa, Glycine max
  Coding DNA Sequence Number=SeqID_27813
MSHHSSSVNGEGTSHKDPLSRILDELSSLKLWKEKQERKEKGKKKVEEISQDERKKIREEERRKIMKEMKREKYAYYSSHNSCESPREELRDYYEGRHRSHLRLHSHRREKERKPQEDNINLPYFHRKDNVEANLDWEIRVEQQLKKKSTSKSYRSHSYTKKDQGQGILG

SEQ ID NO: 119499 - protein, 108 aa, Glycine max
  Coding DNA Sequence Number=SeqID_27814
MAPKKFSTKRSRRDATGEDSSTTSETNHRGQVQIHECLYQFSLSQQGHGSAPFVCPTPEQFGAKVAWPGDWPDAQAGEEPTKSPGEADEPHRDEDMTDLLGFLGRSEA

SEQ ID NO: 119500 - protein, 82 aa, Glycine max
  Coding DNA Sequence Number=SeqID_27815
MSKIVLGDGQIPGQTQRQRQIEGENEPVDAKRPTSSSVPFVIQGQRVRFLLPLSRNIQAQRRAGFFSVGQRRSGAMAKGSVV

SEQ ID NO: 119501 - protein, 46 aa, Glycine max
  Coding DNA Sequence Number=SeqID_27816
MTKARQKGGTEREKREVVAAQLAQASWVASTRRHHLLLEDPGRPKA

SEQ ID NO: 119502 - protein, 59 aa, Glycine max
  Coding DNA Sequence Number=SeqID_27817
  Subcellular localization annotation: CTP_CleavageSite=23; ConfidenceScore=5.29e-01
MSASSPPGAVVCSKAWAVRPLKRASGSTAETAMGSLPQRGWSERSFENSREGHGETSRF

SEQ ID NO: 119503 - protein, 132 aa, Glycine max
  Coding DNA Sequence Number=SeqID_27818
  Homolog annotation: Hit_ID=B0HC01; Match level="QueryCoverage=25%, HitCoverage=72%, E-value=1e-11, Identity=100%"; Hit description =Putative uncharacterized protein
GAGAYGKTPATRPFYGSWPFAGLLLTCSFLRYPLILWITVLPPLSELIPLAAAERPSAASHWHDRFPDWKAGSERNAINETAMTMITNSSSVPSLKVALADLPVPLLSRFWAVLPPAAYSFTASMPRAIIYI

SEQ ID NO: 119504 - protein, 64 aa, Glycine max
  Coding DNA Sequence Number=SeqID_27819
MSRASSSSVFVLPGNTQDLEGKSHIFVLFTLRLIYFLLEINGRVPGISTFEGLVVGSGVLSVKK

SEQ ID NO: 119505 - protein, 129 aa, Glycine max
  Coding DNA Sequence Number=SeqID_27820
  Pfam annotation: Domain name=Transposase_23; Domain location=51-121; Score=-10.1; E_value=0.015; Accession=PF03017.5; Description =TNP1ENSPM transposase
  Subcellular localization annotation: CTP_CleavageSite=34; ConfidenceScore=5.26e-01
MASFSHMQSQLQSQMQSQGLVVPPEPLVGPSGPRVSTKGSCVDPSGNDPETGDSDRCDLYIEADPARLVAIGRDSEGSTVVHNTPLLSGQVTVSVAEVTDADAPVPVPTDEVSIVRQTLHTFLAWAKHL

SEQ ID NO: 119506 - protein, 93 aa, Glycine max
  Coding DNA Sequence Number=SeqID_27821
LGRIDGDSVLRETRIWATWEYMSSVGGGQQGMSGTWRYVAGVRRPWGRQVGRAPGSQQIKGTKTTKQGGWCGGWASCESCVIYGLWALVIDYQ

SEQ ID NO: 119507 - protein, 15 aa, Glycine max
  Coding DNA Sequence Number=SeqID_27822
MEDARREPLRRSPAE

SEQ ID NO: 119508 - protein, 138 aa, Glycine max
  Coding DNA Sequence Number=SeqID_27823
AQLGTVTQLPVHPASPVLLTRNGPLGALDSMARLNRAAAPYPEGNFGGNQRLHGIVHHLSGPDRYALTRTLHRRSGSVGGATHRGIPPISFLAPYGPTPGARMCRGTPRARAAFHNRDDDVSMSISAARAWATIAIPR

SEQ ID NO: 119509 - protein, 168 aa, Glycine max
  Coding DNA Sequence Number=SeqID_27824
MSRNFMDYATIPSLTSRMLRNFTDCPTMLPFDFRHVSELHGLPNDGFNIPTSGTSAIALDRPWMTKGAEDDVSLCASTGSFALDRRKVRVTIRQPRMSPDFMGQGDKRLMVRKTTLVSTCQWAHTAIDKRVQIKGAEDDVSLRVSTDSKRMFTGHRWVSPHVTGLLGH

SEQ ID NO: 119510 - protein, 86 aa, Glycine max
  Coding DNA Sequence Number=SeqID_27825
MVKEECKEISVSSKRLAKKESHYVIKTKIKETSVPRQPPHLLLCKKTLVSIATPLGLEVIPQVKKLLDEDFVRKNLYPCALLVPKI

SEQ ID NO: 119511 - protein, 162 aa, Glycine max
  Coding DNA Sequence Number=SeqID_27826
MWAFHTGRQLDWAHLVRYRMHKALRLNAPLPYPHLVTLFFCHFGIPLDSEPYVPIKRSFLIGAAVIASFGYRKEHDGSWVKKGAQPADDEGNLQVEDNSSLLRRLMDKFDGLQTFVGDKFDAMELQVDMRFDAMESRITKVEEDVSFIRTCFDPPPPPPSSS

SEQ ID NO: 119512 - protein, 113 aa, Glycine max
  Coding DNA Sequence Number=SeqID_27827
KWIRPPFTRAFIEKYCTPRQAQGDVPQVADAPLPPHQVDPAGSLGMERYLQHLVRQQTTNHRGQFRAEVAWPGDWPEDQTEEAPAGAPDDAEDARMDEEMTDLLGFLGGSGAT

SEQ ID NO: 119513 - protein, 143 aa, Glycine max
  Coding DNA Sequence Number=SeqID_27828
DSASRFGVPVTPSKVIRPPITRAFIEKYCTQRQVQGDAPQSADAPPPHQAGPAGLFDTEQYLRHLVRQQAANHRAHSQGFTSFPCPTPDQFRAEVAWPGDWPEAQAGEAPVGAPAEAPDEVDEAREDEETTDLLDFLRGSGAT

SEQ ID NO: 119514 - protein, 155 aa, Glycine max
  Coding DNA Sequence Number=SeqID_27829
MMIWKQRAKLVMATARWALKHPVYGIVILRLGIYTNRPNVSKLCSFISSMNPSILISVIQENKLLASVPCFQKICLLSTNDLCFLTITCRPSSISFLNDHIEEILGVVTYPSAGGRRETRGMRVPRKEYARSRHQRLFEENVGKTGKDAIYELLS

SEQ ID NO: 119515 - protein, 58 aa, Glycine max
  Coding DNA Sequence Number=SeqID_27830
MTKLGLCVPSDTTVSEWQRGTDNRKNDQTWSLLVIGPPPLDDKRGANNHKVSPRATGS

SEQ ID NO: 119516 - protein, 256 aa, Glycine max
  Coding DNA Sequence Number=SeqID_27831
  Homolog annotation: Hit_ID=UPI00016621D1; Match level="QueryCoverage =52%, HitCoverage=34%, E-value=4e-07, Identity=30%"; Hit description =UPI00016621D1 related cluster
MPSPSEDCTSSPSEGCMPSRLEDYTSLPSEGCTSSPLEDYMSSPSEDYTSSPSEGHTPSPSEDCTSSPSEGCTPSPSEACMPSSSEDCTSSSLDCCSPLPSEDYTSSPSEGCTPSPSEDYTGLHVLTFKGLHTLTFRGLHALAFRGLHVLVFRGLLGLAFRGLHVLAIRGLHVLTFGGLQVLAIRGLHVLTFRGLHALVFRGLHVLVFRGLHILAFKGRHVLNFRGLHTLAFRGLRVLTFIGLHIRTLREFKVLYS

SEQ ID NO: 119517 - protein, 180 aa, Glycine max
  Coding DNA Sequence Number=SeqID_27832
MQSQLQSQMQSQGLAMPPEPKVGPSAAHVSTNGSCVDPSLTDPETGDLDKCGLYIEQNPSRLVALGRVYEGSIVVHNIPLLHGQVKVGVEEVKDAEVPVPVPNDEAAVSPAKPPDRPNPEVDDPLYLMTLTIPQLFLKPLQVMRDATVFRVFNPDFPLYIKHEDLSEIAHDGQCLNISVI

SEQ ID NO: 119518 - protein, 91 aa, Glycine max
  Coding DNA Sequence Number=SeqID_27833
  Homolog annotation: Hit_ID=A5B4U1; Match level="QueryCoverage=100%, HitCoverage=17%, E-value=1e-20, Identity=49%"; Hit description =Putative uncharacterized protein
MNIDYGIRKDEPSVITETSELDVVDLYERDLLKAIDGQFTTSEKSHATTLIMQFSSIKLTGTRGMCDHIMHLRDIVAQLKTLEVTMSKSFL

SEQ ID NO: 119519 - protein, 205 aa, Glycine max
  Coding DNA Sequence Number=SeqID_27834
  Gene Ontology: Cellular component=mitochondrion
  Homolog annotation: Hit_ID=Q6R9L5; Match level="QueryCoverage=41%, HitCoverage=71%, E-value=2e-31, Identity=76%"; Hit description =Putative uncharacterized protein orf121-a-ct
GFLIWDPGEEDQVGPCVQLDALSPFNPLSDMWQKELRDHPKDAFGIQGSRTDHRTLFKKRYALAIRSQVGQISRGLRGGGLPCGGCQRFESAYLQLVNLVDTKLYDSTSIFPIRQFDLCYDLSFMDVDKILPSSSTLGWHSLKVKGEVQTKKGLWWIPRHPETRKGVVSDEMLRGVENKRRSGDSRYRSTFRTAAESTGRQETTW

SEQ ID NO: 119520 - protein, 91 aa, Glycine max
  Coding DNA Sequence Number=SeqID_27835
MPMLDQFHPCIHDFIENIINVKLDGNYRYRAIAILLGIGEDSWYLICNHLLKELAKWSDEYINLLDGIDRFKELKWSLLVNGLSWLPWISG

SEQ ID NO: 119521 - protein, 191 aa, Glycine max
  Coding DNA Sequence Number=SeqID_27836
MGDQEEIQEQMKADMSALKEQMASMMDAMLGMRQLMENNVATAAAVSSATKADSTLPATAHHLLPNVVGREKSTLGHISNPHLGYNRVAYPYGLPPNYTPLVMRDDAAHVPSPILERESFRQSDEVHEDRREYAQGDIYFYPPVPMEGPTPNTLPQPNLTGEPRNLPAQPIFLSTEGPPPATKEKRKLDLI

SEQ ID NO: 119522 - protein, 152 aa, Glycine max
  Coding DNA Sequence Number=SeqID_27837
MAPTPCTHIEILGPTPRSMKEHALRDPYRMRARARVMGETDEVQEWIKANLEPMKKQMTTMMKAMMSMKKIMKVNTAVVAATSAITKVELTPTSGLNQINHAISDMVGQIGKELGSTGGPHFVQVQNKHSFPPYGLAFNHTPPNVAHTPNED

SEQ ID NO: 119523 - protein, 97 aa, Glycine max
  Coding DNA Sequence Number=SeqID_27838
MWTTTGEELATQLAQASKVASSRSNNLLEEGSGRPKSYENSRIAKNTSFRFSPHYGISRIAQARFFFIFGTSRDFIYCATKDAKYLKAANQRLHVIK

SEQ ID NO: 119524 - protein, 165 aa, Glycine max
  Coding DNA Sequence Number=SeqID_27839
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRLRPPDEHHKIDAPVRGGETRQDY

SEQ ID NO: 119525 - protein, 401 aa, Glycine max
  Coding DNA Sequence Number=SeqID_27840
  Gene Ontology: Mol. function=helicase activity; Biological process =viral genome replication
  Homolog annotation: Hit_ID=Q2A9E0; Match level="QueryCoverage=99%, HitCoverage=28%, E-value=1e-90, Identity=43%"; Hit description =Putative uncharacterized protein
MWYDERISKYKNCLNPRFSLCCGDDKVELPLLQNPPQYLQQLLFHDDTIDSKNYQHNSRAYNMMFAFTSARIKLDKTINNSRGPPTIRIQGQPCHRIGSLLPMPRKKPKFAQLYIFDTANEVQNRINVMSFKSHARSTQSHAKSFRMARDRLTADQANNIKLQLIAARGKDGRVYNMPNVPKIAALIVGDFHPGSKRDIIVETQNGELQRIHELHPSYLPLQYPLLFLYGEDGYRADILHRCTSSSKKRKQNRLTMREWFAYRLQSRSNEAQTLLHSRKLFQQFIVEGYTMVESERLSYIRNNQKKLRVDKYSSLQTSLDTGTAKGLTKGKRVILPSTFVGSPRYMNQLYFDGMTICSHVGFPNLFITLTCNPNWPEIRRLLSPLNLKPTDRPDIVSRISD

SEQ ID NO: 119526 - protein, 57 aa, Glycine max
  Coding DNA Sequence Number=SeqID_27841
MEASLHNSVRFRNIPIFLQKDVASGGSNLARLGELSSPGRAELAWASWAATTSPILL

SEQ ID NO: 119527 - protein, 89 aa, Glycine max
  Coding DNA Sequence Number=SeqID_27842
MAKFDPDIVLEFYANAWPTEEGVQDMRSWVRGQWIPFDADAISQFLGYPLVLEEGQECEEASANHAHQHDHPDPDMDDVAAQQHPAQRS

SEQ ID NO: 119528 - protein, 119 aa, Glycine max
  Coding DNA Sequence Number=SeqID_27843
MASGNRLPMVCNRLHRVIGHWNPHAHFSSLWSGYYSTPTSYRLVEPVQVIEVSSSEEDLEEDLEELPPDPAMDTLDLPEDDEDPLPDVDSLEDIMSASEADSTEESGPRGTANSDDSSS

SEQ ID NO: 119529 - protein, 28 aa, Glycine max
  Coding DNA Sequence Number=SeqID_27844
VDCAEDDVNLRVSTGSLAAIDKGCRRRR

SEQ ID NO: 119530 - protein, 220 aa, Glycine max
  Coding DNA Sequence Number=SeqID_27845
  Gene Ontology: Mol. function=ATP-dependent helicase activity; Cellular component=cytoplasm; Biological process=ribosome biogenesis and assembly
  Homolog annotation: Hit_ID=A6T885; Match level="QueryCoverage=99%, HitCoverage=47%, E-value=1e-108, Identity=89%"; Hit description=ATP -dependent RNA helicase
  Pfam annotation: Domain name=Helicase_C; Domain location=109-185; Score=115.0; E_value=2.2e-31; Accession=PF00271.22; Description =Helicase conserved C-terminal domain
MDEADRMLDMGFSDAIDEVIRYAPASRQTLLFSATWPEAIAAISSRVQRDPQTIEIDSVDALPSIEQQFFDVSQSGKIKLLQKLLSHHQPASCVVFCNTKRDCQAVCDALNAAGQSALSLHGDLEQRDRDQTLVRFANGSARVLVATDVAARGLDIKSLELVVNFELAWDPEVHVHRIGRTARAGESGLAISFCAPEEAQRANILAEMLQITLNWVNAPA

SEQ ID NO: 119531 - protein, 122 aa, Glycine max
  Coding DNA Sequence Number=SeqID_27846
MWEGQLDIEAEEGVLLRESAEERGEGSSARSGGRRFRRFFRWIQRKMVPEVLLWAPAEELCLPRIPRKNLRNLLPQATFPARGRTYGTFFRRQAILLTEEHSKLLPRSMFWCFLVIFFENFV

SEQ ID NO: 119532 - protein, 281 aa, Glycine max
  Coding DNA Sequence Number=SeqID_27847
MAKFDPEVLLEFYANACPTEEGVRHMRSWLRAQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGPANTRHPLDPDKSNRALGFPALITGLCQSFGVPVFYKGGQPPEHKYGPHDCLYQMSLSMQSQGFASFSCPTPDQFRAEVAWPGDWPEAQAGEAPPEAPGDGEEAHEDEEMADLLDFLGGSGDT

SEQ ID NO: 119533 - protein, 612 aa, Glycine max
  Coding DNA Sequence Number=SeqID_27848
  Gene Ontology: Mol. function=peptidyl-dipeptidase Dcp activity; Cellular component=cytoplasm; Biological process=proteolysis
  Homolog annotation: Hit_ID=A7MLC4; Match level="QueryCoverage=54%, HitCoverage=47%, E-value=1e-143, Identity=71%"; Hit description =Putative uncharacterized protein
  Pfam annotation: Domain name=Peptidase_M3; Domain location=1-350; Score=301.0; E_value=2.3e-87; Accession=PF01432.11; Description =Peptidase family M3
FPLRAWDWNYYAEQVRTAQYALDEGQIRPYFEFNTVLEKGVFWCASQLYGIRFEQRHDLPVYHPDVNVYEIFDADGAPLALFYTDFFTRDNKSGGAWMGNFVDQSTLLESRPVIYNVCNYSKPQPGQPALLSWDEVITLFHEFGHTLHGLFATQRYASLSGTATPRDFVEFPSQINEHWASQDQVFAHYARHYQTGEAMPAALRDKMVRAAKFNKGYDMTELLAAALLDLQWHSLSPHDNPQDVSHFEQQALAAENIALSAVPPRYRSSYFRHIWGGGYAAGYYAYIWTQMLADDGYQAFVERGGLTRENGQRFREQILSRGNSSDLQHLWLAWRGPPSGAAGWPARLSQRTAFNGVAHAGQHALAGFLFQSGIPFRGDRRIFGVGDITTLARFQHQITGARHAPRLIAQQAVLNAQRVGGQGLRQYHRIFHGRTAALTDIRRGAVCRIPQQRHTPSDKATEGFDIMNLHAIGGLCVNAGDQPLDRFGPAGKIAAQIRDIKEKVEAVTAHRHQRDALALADKRGPLIGGRDAFIDSDQAIPVDVACVAALDVFAQHVMANHRVGAVGGHHKIPFSLAAVIKPGGHAAGMLLHSHNAFAKANAFAAVAVDQQR

SEQ ID NO: 119534 - protein, 77 aa, Glycine max
  Coding DNA Sequence Number=SeqID_27849
  Subcellular localization annotation: CTP_CleavageSite=64; ConfidenceScore=5.39e-01
MIKSRQFQVKKRLSHEVQKRASTAKRSFNALSTTEESSRASISRPRAKREITVLSVVVVFSQAQCMTDAKFKSTYSR

SEQ ID NO: 119535 - protein, 169 aa, Glycine max
  Coding DNA Sequence Number=SeqID_27850
MAESSKKRKGSSSTIAAEGHHRHGPSEAPTTPIHPPLSSPRSPTLFSSDDQHLWYLSQFSSRIILDLKYLDIDFFNDETFDCYQVFQNFGLVDFMSLKLPYYPELVKVFYCNLKIQDGIISSEVHGIFMIIDQSLFFSLTKLPSQGAPFEGTIVDDWKFDYSCHDARRM

SEQ ID NO: 119536 - protein, 139 aa, Glycine max
  Coding DNA Sequence Number=SeqID_27851
MRTCFSKETKLPTDQSNICLLDEGQCVYRGRRHFVSKRPFRGNTGSNKDRRKSLKVYQSHTMRGEKVASAQDFVGNQRERTTLGRGQGLTFSPWVKVYDKLGFWLKACRTTGHDICQGLASGSRIKGMPYIISMIHMQQ

SEQ ID NO: 119537 - protein, 75 aa, Glycine max
  Coding DNA Sequence Number=SeqID_27852
  Homolog annotation: Hit_ID=A6FJQ2; Match level="QueryCoverage=50%, HitCoverage=84%, E-value=3e-11, Identity=92%"; Hit description=50S ribosomal protein L5
MTVKPLTHAAPGDGHNLSMRKEKIPHQAPFAIQAAQLLGRAIGAGLFAITPAGERGMCCKAIKLGNARVFPVTTL

SEQ ID NO: 119538 - protein, 15 aa, Glycine max
  Coding DNA Sequence Number=SeqID_27853
MALERTWMPRVLLEQ

SEQ ID NO: 119539 - protein, 133 aa, Glycine max
  Coding DNA Sequence Number=SeqID_27854
MELQVDMRFDAMESRITKVEDDVSFILLFDVAKGGENLELGDCHHQKGGDCRQRIKMNVLMMPKDHMFLKALFKTKKSKIFKMDDQDSLYSLRKSILNRKGIPIEVAKGLAKKFKLKSVFQEIYSLVIDYQRM

SEQ ID NO: 119540 - protein, 132 aa, Glycine max
  Coding DNA Sequence Number=SeqID_27855
MDQLKHLSIPSGMLRFSNHASYPRLGHPTRKNQHAQGQADILIARFPNLNYGVKMGFRSLPKPQAKLEILLRLKGSSRCGFSMENNDGLWWLMVDVGDGESTWNFRNGFGRKKEEEMAFFLSYKKAKAEMLK

SEQ ID NO: 119541 - protein, 147 aa, Glycine max
  Coding DNA Sequence Number=SeqID_27856
  Gene Ontology: Mol. function=endonuclease activity
  Homolog annotation: Hit_ID=Q9AY32; Match level="QueryCoverage=40%, HitCoverage=90%, E-value=3e-25, Identity=96%"; Hit description=RRNA intron-encoded homing endonuclease
  Subcellular localization annotation: CTP_CleavageSite=55; ConfidenceScore=5.07e-01
QSKSLNEDPLEGKSGASSRARSWTLGWVDRSASGVHRSARPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 119542 - protein, 125 aa, Glycine max
  Coding DNA Sequence Number=SeqID_27857
  Subcellular localization annotation: CTP_CleavageSite=43; ConfidenceScore=5.46e-01
DKPFFSPSLDYPSSLQQVLPVPYPCPLGTPSQNVSAIPSPPPSSTEVVPPPLITYQCRTRKIGSTVPESSPRDSHPPPTDPQTMDPYSSTSSHHSDSDWPIVIRKGGSILLRLGLMVRLIGIRLG

SEQ ID NO: 119543 - protein, 76 aa, Glycine max
  Coding DNA Sequence Number=SeqID_27858
  Subcellular localization annotation: CTP_CleavageSite=57; ConfidenceScore=5.10e-01
MRGYVMVTRTFCQQGANEPVDARRVTSSSAPFVILSRQGYLMVTRTFRQPGANELVDARELTSSSAPFVVLPREVK

SEQ ID NO: 119544 - protein, 172 aa, Glycine max
  Coding DNA Sequence Number=SeqID_27859
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSPTGQISSTIGCYQSSSSPSSTHCCRGRR

SEQ ID NO: 119545 - protein, 81 aa, Glycine max
  Coding DNA Sequence Number=SeqID_27860
MVVILPKEHLVPKSKAPARWIVVKCNKQKGSTKCGYYVMHWMSTIILGSFRNNWETYFNNARPLEPERLKALRIQWAQYYL

SEQ ID NO: 119546 - protein, 166 aa, Glycine max
  Coding DNA Sequence Number=SeqID_27861
  Homolog annotation: Hit_ID=UPI0000ECBAF8; Match level="QueryCoverage =21%, HitCoverage=42%, E-value=2e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMHASVALAVVYNVVTGKTLALPNLIALQHIPLSPAGVIAKRPAPIALPNSCAA

SEQ ID NO: 119547 - protein, 75 aa, Glycine max
  Coding DNA Sequence Number=SeqID_27862
  Homolog annotation: Hit_ID=A6T884; Match level="QueryCoverage=80%, HitCoverage=18%, E-value=7e-27, Identity=88%"; Hit description=Zinc transport protein zntB
MDYSRFLQACINGGSVDAIKGSELKVPDAIFAWVLDGQGGVKPLADDDIIDKSSPCWLHLNYTHTDSADWLAGTP

SEQ ID NO: 119548 - protein, 68 aa, Glycine max
  Coding DNA Sequence Number=SeqID_27863
MTYLWMQAKHVSEHVWNGKEDGNYTSDELSPHIKGKKKYQRKLFLFFDNVNCWESDHRKVNFKAVWLN

SEQ ID NO: 119549 - protein, 257 aa, Glycine max
  Coding DNA Sequence Number=SeqID_27864
  Gene Ontology: Mol. function=iron ion transmembrane transporter activity; Cellular component=integral to membrane; Biological process=high-affinity iron ion transport
  Homolog annotation: Hit_ID=A8GDQ1; Match level="QueryCoverage=100%, HitCoverage=65%, E-value=1e-137, Identity=91%"; Hit description =Periplasmic binding protein precursor
  Pfam annotation: Domain name=Peripla_BP_2; Domain location=1-201; Score=-43.7; E_value=0.045; Accession=PF01497.9; Description =Periplasmic binding protein
MIAQLRSKPSLSQTGVLDKLKALNVPVLFIDTMLKPVENTPKSVTLLGETLNRESEAKQYTDYYQQHYQAILAKTQAVEPKPLVFFEAKAGLNGLESCCFTHAHVGWGALVEAVGARNIGSALLPGATGDVALEKVIAMKPDAYIVSGSQWASKTNAAVPFGYGVTQQQVDEAFNRMKQRPGFAQVSAVKEGRFYGIYHNFYNHPYNIVGLEYLAKFIYPAQFPDLDPAKTYSEILSRFTEVPEGKGILGAQAPTGK

SEQ ID NO: 119550 - protein, 99 aa, Glycine max
  Coding DNA Sequence Number=SeqID_27865
  Gene Ontology: Mol. function=feruloyl esterase activity; Cellular component=intracellular; Biological process=regulation of transcription, DNA-dependent
  Homolog annotation: Hit_ID=A5FNR6; Match level="QueryCoverage=96%, HitCoverage=82%, E-value=8e-31, Identity=66%"; Hit description =Transcriptional regulator, HxlR family
  Pfam annotation: Domain name=DUF24; Domain location=3-94; Score =131.3; E_value=2.9e-36; Accession=PF01638.8; Description =Transcriptional regulator
  Pfam annotation: Domain name=PadR; Domain location=2-79; Score=-5.2; E_value=0.006; Accession=PF03551.5; Description=Transcriptional regulator PadR-like family
  Pfam module annotation: Pfam domain module=DUF24::PadR; Domain location=3-94::2-79
MKFIGGKWKAVILYHLIEGAKRYNEIRKDIPTITERTLSLQLKQLEEDGIISRKVYTEKPPLVVEYALTDFGKTLLPVLNEITRWGDEAIANSKKITRN

SEQ ID NO: 119551 - protein, 122 aa, Glycine max
  Coding DNA Sequence Number=SeqID_27866
KRNANIQNLIYGYGGFHQQTLLPRKHRDFFKSHKSPELRRSEFLIGGYVGARASLLSTTPPFVTMTQELVARGDTLRLSAPRHSVTPSVIDEQRPIWSSAPFLEMSSFSDGDFSSLTSSRTT

SEQ ID NO: 119552 - protein, 56 aa, Glycine max
  Coding DNA Sequence Number=SeqID_27867
MTKLKTTLSPETKAVAPKWIEVKWFANDTPLDIDIITTIRKKWATFFLKTAISKNG

SEQ ID NO: 119553 - protein, 36 aa, Glycine max
  Coding DNA Sequence Number=SeqID_27868
LRIKIGRKIKIRKSFSSKERAKGVRSLSLRVKGLLE

SEQ ID NO: 119554 - protein, 157 aa, Glycine max
  Coding DNA Sequence Number=SeqID_27869
  Gene Ontology: Mol. function=symporter activity; Cellular component =integral to membrane; Biological process=auxin mediated signaling pathway
  Homolog annotation: Hit_ID=Q5G1R5; Match level="QueryCoverage=26%, HitCoverage=8%, E-value=8e-16, Identity=95%"; Hit description=Auxin influx protein
DAGSRQARQGASAGVGGCRGWLNYAASEQIVLRVHHMRAIGAGLFAITPAGERGMCCKAIKLGNARVFPWFEVLDGLLGPYWKAVGLAFNCTFLLFGSVIQLIACASRETCRASCINESANARGEAVCVLGALPLPRSLTRCARSFGCGERYQLTQR

SEQ ID NO: 119555 - protein, 94 aa, Glycine max
  Coding DNA Sequence Number=SeqID_27870
  Gene Ontology: Mol. function=heme transporter activity; Cellular component=mitochondrion; Biological process=cytochrome complex assembly
  Homolog annotation: Hit_ID=Q5U6B0; Match level="QueryCoverage=82%, HitCoverage=37%, E-value=5e-20, Identity=66%"; Hit description =Cytochrome c biogenesis
  Subcellular localization annotation: CTP_CleavageSite=88; ConfidenceScore=5.52e-01
CLLLAKDPTSTIGRSPGSLVFTLLCGIHSRLALGITSSSGWNSSQNPTTSPTSLPPTVSRTSIETEWFHVLSSIGYSSPFVSLFPIAVSMSLQD

SEQ ID NO: 119556 - protein, 189 aa, Glycine max
  Coding DNA Sequence Number=SeqID_27871
MLESFQQQDQMSVLELYIEKDVAGGSIFNSANSLTSCGNNLSNNETQLPRNVSNLHGDEDDDDDDYLVSNSYVEESLDEDDSIDGISDTDDEVIDMIQPVRIIHPAEGVQGIQNPFWNDVLHYNNINWSHPDEEDICGLEMPSSFNVGLELYVGMDFDSKDAVKNAVKQYLMKVHQSFKVVESKWNKYV

SEQ ID NO: 119557 - protein, 154 aa, Glycine max
  Coding DNA Sequence Number=SeqID_27872
VWRLPRHPLDPDKSNRALRFPSLITGLCQSFGVPVAPTKAAGAPPPPHQAGQAGSSDMEQYLRHLVRQQAANHWAHVQTHDCLYQMSLSMQSQGFASFSCPTPDQFRAEVAWPRDWPEAQAGEAPPEAPDGGEEAHEDEEMADLLDLLGGSGAT

SEQ ID NO: 119558 - protein, 120 aa, Glycine max
  Coding DNA Sequence Number=SeqID_27873
  Homolog annotation: Hit_ID=A6FJQ2; Match level="QueryCoverage=31%, HitCoverage=84%, E-value=3e-11, Identity=92%"; Hit description=50S ribosomal protein L5
MQLPETVTALSVSGCREQTSPSGRVSGCWRMRKEKIPHQAPFAIQAAQLLGRAIGAGLFAITPAGERGMCCKAIKLGNARVFPVTTLIPLAGAAVVWYTNLEASRIRTWKDLITAFLRKY

SEQ ID NO: 119559 - protein, 128 aa, Glycine max
  Coding DNA Sequence Number=SeqID_27874
MYPPLELIHKRCTLSCSQSTTQVDVPSTCTTKDVPSNVLRQRSQAVKPLKLCEWGYKRILRREKGDTKELRRLVLSFFWKRERETQKEFRRLVLGEFFLAKGEEMKRMNSTSFQGLENQKTLESFLAQ

SEQ ID NO: 119560 - protein, 66 aa, Glycine max
  Coding DNA Sequence Number=SeqID_27875
MRNQKDQQFIQSEKSEPSSMLQDGESGGAAPSSEDSLKTIIRGGAGGGDNISNSGEGGGSTTGGYG

SEQ ID NO: 119561 - protein, 134 aa, Glycine max
  Coding DNA Sequence Number=SeqID_27876
MVGCDPKGTFSVGAKLSRSRIFFGFLSDSPYEVASLLVDDSPPFMGIMVSVPYVLDPYPCQEVFVSLSFELSVVVGDDSIWEVVLGDKVVRRSAWNVCKLLTSSASLGKVEGVYPKCWLVVARSHRFSGQGASS

SEQ ID NO: 119562 - protein, 158 aa, Glycine max
  Coding DNA Sequence Number=SeqID_27877
  Subcellular localization annotation: CTP_CleavageSite=15; ConfidenceScore=5.41e-01
MATPPASPPPPPSVVALVSPSTLKWKCKVTRLRSLATRLPGVERPVVHVDPAIGKANGPHKKKLRTYLGIIARDKVDVTYETWKEVPAAQKDLIWEDIQKKAQAIQKQNTALHVLSRGGYEYLEQKLMAEKTKKKLEKLLSSEALRASLTLHLPSDDT

SEQ ID NO: 119563 - protein, 64 aa, Glycine max
  Coding DNA Sequence Number=SeqID_27878
MATPLGITLLMRWLIKSSLELVDTRYYTQTRLSYGHCWTGSSPAIRQYPEVVNDFGNLVEPVIQ

SEQ ID NO: 119564 - protein, 138 aa, Glycine max
  Coding DNA Sequence Number=SeqID_27879
MVKKKEFNDQEIEKEVEKEKENKKIKKDEKNENEKKSRSEKVVNEVAEVPYPVETGDNYALRRRITVHATLLQILEGYVNMETEITMSNHKSTESALKNLEVQVGHLAKQIADKSSNSFVEKYREESQGGMQSCDDKK

SEQ ID NO: 119565 - protein, 31 aa, Glycine max
  Coding DNA Sequence Number=SeqID_27880
YFNDPRPLEPERLKALQIQWAQYYLRVRAES

SEQ ID NO: 119566 - protein, 38 aa, Glycine max
  Coding DNA Sequence Number=SeqID_27881
MLPRRFREQFREDYPLFFIVLRRSSVFNRIKSNQSFTS

SEQ ID NO: 119567 - protein, 82 aa, Glycine max
  Coding DNA Sequence Number=SeqID_27882
MRVPRKEYARSRHQRLFEENVGKTGKDAIYELFSEKVRESYLRTGKGVSLCSYVSYPNFVRGPLLDDMRPFFGPCEVLGTHH

SEQ ID NO: 119568 - protein, 85 aa, Glycine max
  Coding DNA Sequence Number=SeqID_27883
MAEHGHGMYYTPQTFAQYPTQMHRYPFQGHHTDTSASVDLRHELSAEADEEEAGRHRGRRNLDCQARRWDRPCGKSSRHHGHQNE

SEQ ID NO: 119569 - protein, 131 aa, Glycine max
  Coding DNA Sequence Number=SeqID_27884
MKADPAHLVTLGRVYEGSTVVHSTPLLLGQVKVGAEEVIDADAPVPVPTNEAAVSLAKPPQKPDPEVDDPLYLMTLTIPELFMRPYQVTWDATMFGIFNPDFPLYIKHEDLSEIAHGGQCLSISVLQLWIL

SEQ ID NO: 119570 - protein, 75 aa, Glycine max
  Coding DNA Sequence Number=SeqID_27885
  Pfam annotation: Domain name=Transposase_23; Domain location=1-63; Score=-14.9; E_value=0.051; Accession=PF03017.5; Description =TNP1ENSPM transposase
MSDSDKCRLYIEENPPRLVALGRVYDGSTTIHNIPLLHYQVKVGVEKVKDTDAPFPVPTDEGTVRPTKPANRSDH

SEQ ID NO: 119571 - protein, 57 aa, Glycine max
  Coding DNA Sequence Number=SeqID_27886
MAFVDNWAVSKEKTHIDPFTSKDQIRKALKVPLELPGLSTFGRILLKDSCPLFAHVL

SEQ ID NO: 119572 - protein, 72 aa, Glycine max
  Coding DNA Sequence Number=SeqID_27887
  Subcellular localization annotation: CTP_CleavageSite=12; ConfidenceScore=5.02e-01
MLQVDSRGSRVRVVMLVRMTRTRLFAAVRVKSCPGMHSSCVIASLSGCARTVGHPSISGGGPGTDKRKLLAP

SEQ ID NO: 119573 - protein, 114 aa, Glycine max
  Coding DNA Sequence Number=SeqID_27888
MERSMINAASGGALGDMTPAEARNLIQKMASNSHQFSARNDAIVIRGVHEVATNSSSSAKTKKLEGNLYALVNLVSYLAMNQKSAPVAKLCGLCSSADHHTDLCPSMQQSEVIE

SEQ ID NO: 119574 - protein, 246 aa, Glycine max
  Coding DNA Sequence Number=SeqID_27889
  Gene Ontology: Mol. function=dihydrodipicolinate synthase activity; Cellular component=cytoplasm; Biological process=diaminopimelate biosynthetic process
  Homolog annotation: Hit_ID=A9HXM3; Match level="QueryCoverage=25%, HitCoverage=20%, E-value=9e-26, Identity=95%"; Hit description =Dihydrodipicolinate synthase
  Pfam annotation: Domain name=DHDPS; Domain location=94-245; Score= -151.2; E_value=0.053; Accession=PF00701.13; Description =Dihydrodipicolinate synthetase family
RASGSRWRWPACRSTGADGAEPAADSAAGWGTHPFQPAAQPPGLAILENRAVWAGNRGGAAGDRRALDIDASGIGFGNDDRSVVPLGFWPISVKLSGQHGGPRHPDAARRQPGLRCLPVVDRLAYPGRNRCAGGGGHHRGVATVSMEEHAELIRVAVEHAAGRIPVIAGVGANSTDEAIHLTRHAKAVGAQAGLSVVPYYNKPSAGRPVPPLPRHRRSRGPADHPVQRAGPHRGRHEQRNGAALGA

SEQ ID NO: 119575 - protein, 157 aa, Glycine max
  Coding DNA Sequence Number=SeqID_27890
MEESMSPFLVRDFGAQNFKAIQRIHKAWETPLRKDQELRGIRNGAIGGYHEWLKVHIRGLDWLAKLKVVSEESFEAPEEDEYAQVYAEKEARGRVIDSLHQEATMWMDRFALTLNGSRELPRLLANAKAMADTYSAPEEIHGLLGYCQHMIDFNGPT

SEQ ID NO: 119576 - protein, 43 aa, Glycine max
  Coding DNA Sequence Number=SeqID_27891
MTAEWRRKKDDWRRHFKEKMSQEEAHHYSVATYPSAGGRRETH

SEQ ID NO: 119577 - protein, 59 aa, Glycine max
  Coding DNA Sequence Number=SeqID_27892
  Gene Ontology: Mol. function=protein serine/threonine kinase activity; Biological process=protein amino acid phosphorylation
  Homolog annotation: Hit_ID=O82667; Match level="QueryCoverage=59%, HitCoverage=5%, E-value=9e-09, Identity=82%"; Hit description=MAP3K alpha 1 protein kinase
MYWSPSPLEAIVAALLVINFSFHRDIKGANILVDPNGEIKLTDFGMAKHVRNYKHCLVW

SEQ ID NO: 119578 - protein, 135 aa, Glycine max
  Coding DNA Sequence Number=SeqID_27893
MGEGEEVKEQMKADMEAMKRANGHNDGGHDEHEKDNGIHAVIVAATSTVAKVNPMPPSGLNQMNHPTSDMVGKDLGSMGDPHYAQIQNEHAFPPYGLPPNYTPPNVACTPSENVNNSTAIPIESQQPQTDHAHVS

SEQ ID NO: 119579 - protein, 138 aa, Glycine max
  Coding DNA Sequence Number=SeqID_27894
MYVVDDIDGYYSRQVFALACRISKFGSKLYVNADITEIHEFRQSLSVPFYSGGMINDKDGSQSQSSQSNVVEKFLQNAQVVSIGEINNLRQDCYCLTVGTVDEIIIDAPWSYDSCPNCTTTFDPLKGGSACRSCHTSV

SEQ ID NO: 119580 - protein, 83 aa, Glycine max
  Coding DNA Sequence Number=SeqID_27895
MAFIMSSFIHFILKFRDWCKDYYSMLVVHSQFKIALSPVKQNHQEFKIPETDPVYPESEHPPHLSDGKQGNQREQQLLQMLTL

SEQ ID NO: 119581 - protein, 46 aa, Glycine max
  Coding DNA Sequence Number=SeqID_27896
MEILVDGEFDANRLFDEAVFLTWTWLRHFEKHFSTHLNQWASNISQ

SEQ ID NO: 119582 - protein, 120 aa, Glycine max
  Coding DNA Sequence Number=SeqID_27897
MVIQLTNAFYGVGELQAIEIGEATAVDAVPRVVAVKDAPEGEDDIISVKSAGRFKPVGSLELDLIAQVEAVGGAVIKHFPAFRQLRHQTIGIRVDVEQAIVDLGGEGVDNQAAADFLRVK

SEQ ID NO: 119583 - protein, 58 aa, Glycine max
  Coding DNA Sequence Number=SeqID_27898
MAEDQPRRVTLENYFGSTVPQFFTSIAWPEKYFPESKIAEGKATISSFHQFLDESGIL

SEQ ID NO: 119584 - protein, 154 aa, Glycine max
  Coding DNA Sequence Number=SeqID_27899
MTDLVSAEDDVNLACQQACRPRLTKGAEDDVSLCVLSDFSSYRRAKKNVFTDNHSGISARQRDSNVSMADLVSAEDDRAKKKAYTDNHSGISARQRDSNVSMTDLVSAKDDVNLRVSTGLSATIDEGRKRRRWSLRAIRLFVLTDSKKRMFYTE

SEQ ID NO: 119585 - protein, 275 aa, Glycine max
  Coding DNA Sequence Number=SeqID_27900
  Gene Ontology: Mol. function=aminoacyl-tRNA ligase activity; Cellular component=cytoplasm; Biological process=tRNA aminoacylation for protein translation
  Homolog annotation: Hit_ID=Q5PJB8; Match level="QueryCoverage=100%, HitCoverage=28%, E-value=1e-156, Identity=96%"; Hit description =Valyl-tRNA synthetase
  Pfam annotation: Domain name=tRNA-synt_1; Domain location=13-275; Score=110.3; E_value=6e-30; Accession=PF00133.13; Description=tRNA synthetases class I (I, L, M and V)
MEKTYNPQDIEQPLYEHWEQQGYFKPNGDTSQESFCIMIPPPNVTGSLHMGHAFQQTIMDTMIRYQRMQGKNTLWQAGTDHAGIATQMVVERKIAAEEGKTRQDYGRDAFIEKIWQWKAESGGTITRQMRRLGNSVDWERERFTMDEGLSNAVKEVFVRLYKENLIYRGKRLVNWDPKLRTAISDLEVENRESKGSMWHIRYPLADGVKTAEGKDYLVVATTRPETLLGDTGVAVNPEDPRYKDLIGKEVILPLVNRRIPIVGDEHADMEKGTGC

SEQ ID NO: 119586 - protein, 98 aa, Glycine max
  Coding DNA Sequence Number=SeqID_27901
  Gene Ontology: Mol. function=N-acetyltransferase activity; Cellular component=intracellular; Biological process=metabolic process
  Homolog annotation: Hit_ID=Q6DA69; Match level="QueryCoverage=69%, HitCoverage=40%, E-value=2e-21, Identity=76%"; Hit description =Putative acetyltransferase
MMTTATPLNLQVRPIIAADNPRIAQVIRDVSAEFGLTADKGYTVSDPQLDRLFELYSAADSAYWIVEHEEDVFPAVGARTGVSARTGAARNGFCPPAR

SEQ ID NO: 119587 - protein, 143 aa, Glycine max
  Coding DNA Sequence Number=SeqID_27902
PLELVRKLPFIVGGIVPLPKGTLKIIPILYWRIPMNISFPNKGSPPIEGIPLEAKGSQWNFSLFANMVASKELLSARLALSSNPLTPAKREGGAKRNVVNSKPDAIIPRKVPVTRAMTKRLQDDWARAANGSLLVGLLWRLDL

SEQ ID NO: 119588 - protein, 334 aa, Glycine max
  Coding DNA Sequence Number=SeqID_27903
GRAVEALVVVVVLSHEHGRTAVRELVGDRRRPQVLDHRVGVVGAHAGEQRRVRGPGEPARQRNDPEREHGDTDDRDRALREAEPRDGAPDPLEDGGDGLGHQACIRMISLNASTPLLRTAATSSRVTAAREDAIMAEWMSSRSPVTAATLRASDWDCRERNSSMAPVTLFAKAVSSAVLAGAVGGARVNPEEMPSMPASASISCVRSAARIPDISVGVGERVIGLVHQAAFGAALHGAGHVDAGGLVAGLDGDVPGPEGVPVGRGRRVDVGDVVADGVEPLAVHGQSGAGDADRVERHEVLIAVRIDENGPVHGLGRELVAQHRVDAGEGLGVQ

SEQ ID NO: 119589 - protein, 114 aa, Glycine max
  Coding DNA Sequence Number=SeqID_27904
MTLLLCNILPSDRNADLPLRKYQLGSRPQDTQWTRKKSNRALGFPALVMGLCRPYRAPISPSQFMSSWHRDCARKTPSGPEEGQQGLGVASSKYGSLSVLGSACRPQQGHQAPY

SEQ ID NO: 119590 - protein, 61 aa, Glycine max
  Coding DNA Sequence Number=SeqID_27905
MGEVEEVQEKMKADMEAMKEQMATMMEAMMIMKKIMEANAVAVAATSTLLRKRFGKYGRSP

SEQ ID NO: 119591 - protein, 178 aa, Glycine max
  Coding DNA Sequence Number=SeqID_27906
  Homolog annotation: Hit_ID=Q4L2U6; Match level="QueryCoverage=73%, HitCoverage=43%, E-value=2e-09, Identity=30%"; Hit description=TrwI -like protein
MAAPTTGVQLFSLGWIADWIDKSITTMLTDVVTPLVASVTEKIMPVVGLGLSIALIWYGWLIMNGTIQTPILQATRKLVSIAVIVGIAGAGGLYQRQIAGVMLDLPTDVAKIFTGTIKTPAQIMDDAANNGTEISTRLQERAPTERASGHDECRPDKRVWHADRTDILHDVRTANART

SEQ ID NO: 119592 - protein, 109 aa, Glycine max
  Coding DNA Sequence Number=SeqID_27907
DRACKTPSGPERIPTESWSCQALITGLCQFYGVLVTSGKGIRPPTNRAFIKKYYAPRQAQGETPQQPGDGQQWATDAPPSPLEFTSAHPQKAIKRPAQDVKEALLGGNL

SEQ ID NO: 119593 - protein, 73 aa, Glycine max
  Coding DNA Sequence Number=SeqID_27908
MEAMKEKMATMIEAMMSMKKMIEVNTNTVITTCTTTEVDPIHSSGINQASRLASHTVGKGGEALGSMGGPHVV

SEQ ID NO: 119594 - protein, 144 aa, Glycine max
  Coding DNA Sequence Number=SeqID_27909
  Gene Ontology: Mol. function=aspartic-type endopeptidase activity; Cellular component=chromatin; Biological process=chromatin assembly or disassembly
  Homolog annotation: Hit_ID=A5BZW2; Match level="QueryCoverage=83%, HitCoverage=10%, E-value=2e-07, Identity=28%"; Hit description =Putative uncharacterized protein
MADNTRLKELSVNMSKMLEMLEADRQENKARFETLETAMDTLLKSNNVGVNLHMNVAGNNSIGGSSSPPPFQVRNVKLDFPRFDGSEVVQWIFKAEQFFDYYNTPDTQRLTIAAIHMEKEDLFMIITLSSLLLQTAYKVLLVKL

SEQ ID NO: 119595 - protein, 86 aa, Glycine max
  Coding DNA Sequence Number=SeqID_27910
ALKGLDDAPQPKSKAATRWIVVKCNRQKGSIECGYYVMHLMSIIILGSFRNNWEAYFNDPRPLDPERLKALQIQWAQYYLRVRAQS

SEQ ID NO: 119596 - protein, 163 aa, Glycine max
  Coding DNA Sequence Number=SeqID_27911
MGDQEETQEQMKADMSALKEQMASMMEAMLGMRQLMEKNVATAAAVSSAAKADPTLLATARHPPSNIVGWGRNTLGHDGNPHLGYNRAAYPYGLPPNYSPPVLQDDAGHIASPVLEREPPQQPDEVHEDPQDYARRDVEFYPPILKRPAPSTLPQPNVTTQPI

SEQ ID NO: 119597 - protein, 104 aa, Glycine max
  Coding DNA Sequence Number=SeqID_27912
MEKSKVDTLIAISPNTWHASKFIHISPQDKGICDLWRQQTKATFLPKKSEYAIYGDNKQRPLDQQPQQLEVGSSYWKLKVTNGSWKLEVEVTGSRKLEMKVIGS

SEQ ID NO: 119598 - protein, 334 aa, Glycine max
  Coding DNA Sequence Number=SeqID_27913
  Homolog annotation: Hit_ID=Q6WAY6; Match level="QueryCoverage=81%, HitCoverage=47%, E-value=9e-15, Identity=22%"; Hit description =Putative uncharacterized protein
MDWDQLLVGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGVRNGIIGGYHEWLKVRIRGLDWLAKLKVVSEENFEAPEEDEEVQALKSELGKAKLAKEKFKNAITARALEQETKRARKEEYGRNKFRGALWGSNSELKLRREERDQSRAHGMVLKEELVACSRSKRSLSQRLCETETNMLAIIAKYQEELGLAAAHEHRIADEYAQVYAEKEARGRVIDSLHQEATMWMDRFALTLNGSQELPRLLAKAKAIADTYSAPEEIHGLLGY

SEQ ID NO: 119599 - protein, 217 aa, Glycine max
  Coding DNA Sequence Number=SeqID_27914
  Gene Ontology: Mol. function=glutamate-5-semialdehyde dehydrogenase activity; Cellular component=cytoplasm; Biological process=amino acid biosynthetic process
  Homolog annotation: Hit_ID=P54888; Match level="QueryCoverage=41%, HitCoverage=12%, E-value=2e-28, Identity=77%"; Hit description=Delta- 1-pyrroline-5-carboxylate synthetase B (P5CS B) [Includes: Glutamate 5-kinase (EC ...
  Homolog annotation: Hit description=2.7.2.11) (Gamma-glutamyl kinase) (GK); Gamma- glutamyl phosphate reductase (GPR) (EC 1.2.1.41) (Glutamate-5- semialdehyde dehydrogenase) (Glutamyl-gamma -semialdehyde dehydrogenase)]
MGVQIAPRPIWALQNIPPEGAEALPKRFRNVFREESRKGFNRSSTFFIRSSSFFDLQRRLEAKAAAAARVQAKLEAEKGQGKGKASLAIQSGNGLLLKGGKEARRSNAILHKVITQAIPDTVGGKLIGLVTSREEIPKLLKLDDVIDLVIPRGSNKLVSQIKSSTKIPVLGHAGKTIMLNGTCTLDCVILVPQKRLESLTEAEKQALLEEVEEENNH

SEQ ID NO: 119600 - protein, 344 aa, Glycine max
  Coding DNA Sequence Number=SeqID_27915
  Gene Ontology: Mol. function=RNA-directed DNA polymerase activity; Biological process=RNA-dependent DNA replication
  Homolog annotation: Hit_ID=Q2HRM6; Match level="QueryCoverage=10%, HitCoverage=9%, E-value=1e-08, Identity=69%"; Hit description=RNA -directed DNA polymerase
DPHGLPPSRSIEHQVDLLPEASLPNRPTYKSNPQETQHKDAHAKVEYVKRLYDQVNVQIAKKNESYTKQANKKRKEVVLEPGDDPRHLRANVFQEVGNDENLETGQIQAKGPSGEGRRPNSLLNHSQTYQGSPCGVYPDLSSFTGSGVIQTSVACIKRSAPTQRVISLSAQHRLAKCNHALSAIPSLSRPLCELGPAEYDKFQRELERRCLRKALTRQMDGHIDVALVKELYANLYDPEDKSPRQVKVQGKLIKFDAESLNAFLETPVILEPGEHYITYTRFYGCALEASKEGPHYSRPDLECVDAILPRKGPVTIAMSKRLQEDWARATEEGPRVLMNLRIDF

SEQ ID NO: 119601 - protein, 152 aa, Glycine max
  Coding DNA Sequence Number=SeqID_27916
  Homolog annotation: Hit_ID=A5BSR3; Match level="QueryCoverage=52%, HitCoverage=25%, E-value=9e-12, Identity=46%"; Hit description =Putative uncharacterized protein
MAEKIKKRLEEAAQSGSTKGIIDSLSPIRRHVKWKMARTKKTGLMMSEAAKEIADRIDSLDEQVSQGSFIPHGRQDILTAAIGRPEHPDHVRVVGAGVTIKPRTADPTNQRPTGGVSHRKSDSKDDGILQPDAVPVLVSDAITGTCTTSRAR

SEQ ID NO: 119602 - protein, 202 aa, Glycine max
  Coding DNA Sequence Number=SeqID_27917
MGMIHNLYLLLSQGNLCLVIQLESFFLAASHTSKRGQTLLATILMSAAMDLCRRRGCNKEEGGRDCGIGADLRRGMKGVSSVDSPSNEEEVGSSLFPMKETDHSLSPIYGLALVALVLTYHGMAKGGTDAHGSSGATTFRFWRATHTSPSPSSLVSLMPFNLCATGFIAGGLAGANMADSCLLLVWCSYTNNYSSSSSFTNN

SEQ ID NO: 119603 - protein, 110 aa, Glycine max
  Coding DNA Sequence Number=SeqID_27918
MVFQNCKQLSTNPMSEGYPQKAILTLVINSLIWKSFLLLELLSWDLKLVLVQIEDYKDLGEYINDKGGQVAKGSVRREREGEASNGEKVARGKAGAEKDGYAAKGREGQM

SEQ ID NO: 119604 - protein, 128 aa, Glycine max
  Coding DNA Sequence Number=SeqID_27919
MRAGNSNVYGFLEPQSIQRSGQSQFESESYMKSSKRDVYLGAYLNGALKGLDDTPQLKSKAGARWIVVKTIGSREIEGASHPVGTILSQSEAREDPRAGKLGPNYESPFRVTTSLDNRAYKLQELDDK

SEQ ID NO: 119605 - protein, 93 aa, Glycine max
  Coding DNA Sequence Number=SeqID_27920
MASDMYAQAHYYDSSACHLSYPNFVRGPLLDDMRPFFGPCEHPGPFGPSRRFLQKAVASGGSNPARLGELGGNHLPYFAINRGGNEEGRGPAP

SEQ ID NO: 119606 - protein, 225 aa, Glycine max
  Coding DNA Sequence Number=SeqID_27921
MDEDVLRQREEIYGGPEARKQMRICSNASLPSHQTISWCDKLATESRKNWDSYSSSKDATIGAEKAQSHQTLEGRESMIKEFPPRQTIALNPNSLIFYQWPTDIKMYPSGASEIQLETPEESLNFQDWELSSYDLELRMKLSAYKEEIRSGQAEEIQLETPQESLNFQDWELSNYDHELRMKLYAYKKEIRSRKANCYKGKELLIEYDEDTPIIRFVKAPPGHLF

SEQ ID NO: 119607 - protein, 101 aa, Glycine max
  Coding DNA Sequence Number=SeqID_27922
MTFLLDGDFILTILLVTLTDAILPRKGPVTRAMSKRLQEDWARVDKEGLRVLMNLRLSSSFSRKLLKELLKEVFSKKLLKEVFLRKLLKEVFLRKLLKEAT

SEQ ID NO: 119608 - protein, 203 aa, Glycine max
  Coding DNA Sequence Number=SeqID_27923
  Gene Ontology: Mol. function=ATPase activity; Cellular component =chromosome; Biological process=chromosome organization and biogenesis
  Homolog annotation: Hit_ID=A7PMV4; Match level="QueryCoverage=64%, HitCoverage=12%, E-value=7e-27, Identity=50%"; Hit description =Chromosome chr14 scaffold_21, whole genome shotgun sequence
MVVSYSRDKIQDSKQTLKELETTHNNYMKRQEELDNDMRKCKEEFKEFERQDVKYREDFKHVNQKIKKLEDKVEKEEGSHSLWQLKVKDSSKIEALIKEGEESTVLIPKLKDNIPKLQKLLLDEEKVLEEITESSKGGHCLVEVGKGNAEIALSLVGYEEELQSAMEYVFGSTFVCKAIDAAKEVAFNREIHTTSVTLEGDIF

SEQ ID NO: 119609 - protein, 234 aa, Glycine max
  Coding DNA Sequence Number=SeqID_27924
  Gene Ontology: Mol. function=identical protein binding; Biological process=negative regulation of catalytic activity
  Homolog annotation: Hit_ID=Q2HV71; Match level="QueryCoverage=38%, HitCoverage=11%, E-value=4e-27, Identity=66%"; Hit description =Protease-associated PA; Proteinase inhibitor I9, subtilisin propeptide
MEACLWGFYGGWIFELQWDPLMVIFHHGDAAEDKGKEELHHQDEPWIRSLVGCFNGGKERGREKERGQHEIEGIKEGEKWNFEASSGDLRRLPQAPLSPPSLCRDLRIMPQAPLPFVIVIVYLTQSQQPTASGRCADTPSVIKYAKSNKKPIATIKFQQKFVGVKLAPAVNFNSSRGPSTSYHWVLKPHIMAPGSNVLVAYVPTEPTTRIGTNVMLSSGYKLLSGTPTKHLIQV

SEQ ID NO: 119610 - protein, 201 aa, Glycine max
  Coding DNA Sequence Number=SeqID_27925
MEPRKNEVIVILGINNEKDAKNVFLEDSFIHGGWVSFQSLEEEGFTIKGFFDCIRWMSFLQNFSVWYYGPYALFWGTSCQNKVSISGTVKGKGCKVYVSDRDRFCTYKMMVGKKVDLLEVIFYYWMQTFKGRFNPKVKKNHVPYAYKKAKLDETLERKEAQELEESFLSSMKALSTEENKKKLAKYARLATLVGKISEKIP

SEQ ID NO: 119611 - protein, 49 aa, Glycine max
  Coding DNA Sequence Number=SeqID_27926
MWLFNQTQIPWCRGTCAVDFALSMFPITCWVLLEIDTYILIILMFDLFI

SEQ ID NO: 119612 - protein, 320 aa, Glycine max
  Coding DNA Sequence Number=SeqID_27927
  Gene Ontology: Mol. function=structural constituent of ribosome; Cellular component=intracellular; Biological process=translation
  Homolog annotation: Hit_ID=A7QH77; Match level="QueryCoverage=43%, HitCoverage=14%, E-value=3e-30, Identity=48%"; Hit description =Chromosome chr18 scaffold_96, whole genome shotgun sequence
  Pfam annotation: Domain name=PPR; Domain location=113-147; Score =18.3; E_value=0.029; Accession=PF01535.11; Description=PPR repeat
  Pfam annotation: Domain name=PPR; Domain location=148-182; Score =21.9; E_value=0.0024; Accession=PF01535.11; Description=PPR repeat
  Pfam annotation: Domain name=PPR; Domain location=43-77; Score=4.9; E_ value=2; Accession=PF01535.11; Description=PPR repeat
  Pfam annotation: Domain name=PPR; Domain location=78-112; Score=11.8; E_value=0.31; Accession=PF01535.11; Description=PPR repeat
  Pfam module annotation: Pfam domain module=PPR::PPR::PPR::PPR; Domain location=113-147::148-182::43-77::78-112
MGSEIYPEVHESPEAFFSSSSPILLEPPAHGSSDWSLPREDCIRKNAIFDGLIRTSDFDKAHCVLQVLSKSGYVPTNKQYITLINGMCRVRNIKGALKFQDEMKTLGINSHNVVVSLIVRGLANSKKIDNAIWVLDLMLEMQIIPIVDTFTTLMHVYYKEAYVTKALELKSIMEDCHVKLDKIDSLYPNWKVVLEALKNLIWDDIVGTFDIPEVSNAKKKKNMMEDKRKKKQEESIESGGSTIVDPLSPIERHVKWKMTRTKHFGNMTSVEAQQISDRIANQMTQGSFVPHGCQDILATAIGQPEHSGRVCAVGLGVTIS

SEQ ID NO: 119613 - protein, 70 aa, Glycine max
  Coding DNA Sequence Number=SeqID_27928
MAFPYSKHNRVHNYLEVDRERLSTSRIISCCRGFGTVEYRNANFKVEKLKLEQDRVEFDKDKKLFADEEA

SEQ ID NO: 119614 - protein, 109 aa, Glycine max
  Coding DNA Sequence Number=SeqID_27929
MAPSKPGIMRLLEDKARRDVAEVVAAKVVAAAANDTTGGSVTPTNNLVEKENDDSQRRNVLRHDVRKNDLINLGESQDHPGSTKSDLQSPVDANVGDNWDFQDFQWMRM

SEQ ID NO: 119615 - protein, 90 aa, Glycine max
  Coding DNA Sequence Number=SeqID_27930
MGVQIAPRPTWALQKIPPEGCCFWRKQPGSPGRAELAWASWAASISPILKSKPRRFRNVSVTFSVKNFAKVSTVLRRSSFVLHRSSIFNG

SEQ ID NO: 119616 - protein, 132 aa, Glycine max
  Coding DNA Sequence Number=SeqID_27931
  Gene Ontology: Mol. function=protein disulfide oxidoreductase activity; Cellular component=cytoplasm; Biological process=cell redox homeostasis
  Homolog annotation: Hit_ID=A7Q168; Match level="QueryCoverage=78%, HitCoverage=81%, E-value=8e-34, Identity=68%"; Hit description =Chromosome chr10 scaffold_43, whole genome shotgun sequence
  Pfam annotation: Domain name=Glutaredoxin; Domain location=42-105; Score=51.2; E_value=3.7e-12; Accession=PF00462.15; Description =Glutaredoxin
  Subcellular localization annotation: CTP_CleavageSite=6; ConfidenceScore=5.24e-01
MQVMKSATQVEATPPPPSSISLGLNKMRSYEMVHHLVSCNAVVVFSMSDCCTSTVAKRLLFSLGVGPTVVELDEQADGPGIRSVLYQLAGSHQPVPAVFIGGKFLGGVQTLMASHINGTLVPLLKEAGALWL

SEQ ID NO: 119617 - protein, 111 aa, Glycine max
  Coding DNA Sequence Number=SeqID_27932
MDREELEVETYDDTDSGRETLCVFTFPLFPATDPRPFLEDADTADLLVFSLVCFKLLSPDDEVSFLLLELEVMQSYPARALDRKQQVDWARDAREGPRVLMSLRVDFGPMG

SEQ ID NO: 119618 - protein, 107 aa, Glycine max
  Coding DNA Sequence Number=SeqID_27933
  Gene Ontology: Mol. function=protein serine/threonine kinase activity; Cellular component=integral to membrane; Biological process=protein amino acid phosphorylation
  Homolog annotation: Hit_ID=A9PJX6; Match level="QueryCoverage=32%, HitCoverage=5%, E-value=4e-10, Identity=80%"; Hit description =Putative uncharacterized protein
MEKGLLYLHEDSRLRVIHRDLKASNILLDHQMNPSVALVFATLISMAFVDSFVELRCSTPVTAQSKGSLSVLIKNTKGYQGRGQKGLFLDFSRSQLSQPTLRREGDA

SEQ ID NO: 119619 - protein, 180 aa, Glycine max
  Coding DNA Sequence Number=SeqID_27934
MYSKALSSKAKGKEKEEKDSSKKIVKKENHFATKCDIKRALLLKQSFYHPLSRETSLSPAIPLELEVIPQVKELLDEGLVRIMRHRIPMIGGMVNVLNGATLFCKITYASNIFMIHLHRDSLGSDQRVPTNPKRIKVIPEWPTPPSVEGRSPEFQEPLDLRSNSFQGGGNDAILTPKDIG

SEQ ID NO: 119620 - protein, 422 aa, Glycine max
  Coding DNA Sequence Number=SeqID_27935
  Gene Ontology: Mol. function=oxidoreductase activity, acting on sulfur group of donors, disulfide as acceptor; Cellular component =endoplasmic reticulum membrane; Biological process=protein thiol -disulfide exchange
  Homolog annotation: Hit_ID=A7Q169; Match level="QueryCoverage=82%, HitCoverage=76%, E-value=1e-159, Identity=76%"; Hit description =Chromosome chr10 scaffold_43, whole genome shotgun sequence
  Pfam annotation: Domain name=ERO1; Domain location=43-386; Score =639.9; E_value=2.1e-189; Accession=PF04137.6; Description =Endoplasmic Reticulum Oxidoreductin 1 (ERO1)
MLHYQAFQLLSKCGVDVECVTGRWWTLPYKHHAVADEATKDEHHAVPAISSYLLVKLWCDCPFWPDDGMCRLRDCSVCECPENEFPESFKKPDRRLSMTDLVCQEGKPQAAVDRTLDSKAFRGWTEIDNPWTNDDETDNDEMTYVNLQLNPERYTGYTGPSARRIWDAVYSENCPKYPSQELCQEEKILYKLISGLHSSISIHIASDYLLEEATNLWGQNLTLMYDRVLRYPDRVRNLYFTFLFVLRAVTKASDYLEQAEYDTGNPNEDLTTQSLIKQLLYNPKLQAACPIPFDEANLWKGQSGPELKQKIQQQFRNISALMDCVGCEKCRLWGKLQVLGLGTALKILFSVDGQENSSHTLQLQRNEVIALTNLLNRLSESVKFVHEVGPTAERIMEGGHFSAHTRTLISSWKKIWSYVSKT

SEQ ID NO: 119621 - protein, 143 aa, Glycine max
  Coding DNA Sequence Number=SeqID_27936
MVVSNFFSLFLLLPHVSKKEILGGGVCIREVYVVRHGSGIRPHGNQIEPAPTLTDKNRVDRVWSRIRVFPDNPKRGRGRSLYLPLFASHKFTNLRRYSSSVLTLPLLYFNLLSDLDSAIDEDTKVSLSLLTIHGIALDNFISF

SEQ ID NO: 119622 - protein, 60 aa, Glycine max
  Coding DNA Sequence Number=SeqID_27937
MGTYFLIPAGIGGGVKDRLQSRGWEMQYPSLFHPVVMPKGGGIQDVGYDVLTSGPKILDI

SEQ ID NO: 119623 - protein, 120 aa, Glycine max
  Coding DNA Sequence Number=SeqID_27938
  Subcellular localization annotation: CTP_CleavageSite=102; ConfidenceScore=5.10e-01
MGPKSTLRLMRILGPSLASLAQSSWSFLSNALVGHKLGFNPGGFAGYQQGANFNQNQGQWRSHPGNQFNKDQGGPSNLPQNQAPSLYERTTKLEETLAQFMQVSMSNHKSTESAIKNLEI

SEQ ID NO: 119624 - protein, 165 aa, Glycine max
  Coding DNA Sequence Number=SeqID_27939
  Subcellular localization annotation: CTP_CleavageSite=54; ConfidenceScore=5.08e-01
MDMDVGSFISGQISQMAQSNSSRLGFPALITTLCIARGVVPDSLNFESLSPAINLAYIRENCWNPDDPMITFPRTHKTRARGPDASAPSSSAPLAPTPPPPALVPAPSSSSTQSTDILVPMLQSFHHGLCLATPEAEEEAEETPDVTFVATPIEDIDYAVDMAAT

SEQ ID NO: 119625 - protein, 56 aa, Glycine max
  Coding DNA Sequence Number=SeqID_27940
MAAHGGHRWSWGVEEEFLGWFGRIFEREMREIISLSELVSLSENEFLALSANPSRV

SEQ ID NO: 119626 - protein, 157 aa, Glycine max
  Coding DNA Sequence Number=SeqID_27941
  Pfam annotation: Domain name=zf-CCHC; Domain location=38-55; Score =18.6; E_value=0.0023; Accession=PF00098.14; Description=Zinc knuckle
MMISDFVKRFNKFLRNKRNQRKSNINQKKKEEDFSLTPKCYECDLPGHMRFNCPVFKRRMEKSDQRNFKEKKEKKAYITWEDNDINSSSDPENKIINLGLMLKDYESGEEQVGSGSDWKLKVGNGSWKWKLLEVEVGSGSWKLEVGSWKLEVEVTGS

SEQ ID NO: 119627 - protein, 520 aa, Glycine max
  Coding DNA Sequence Number=SeqID_27942
  Homolog annotation: Hit_ID=A5BSR3; Match level="QueryCoverage=12%, HitCoverage=21%, E-value=8e-09, Identity=48%"; Hit description =Putative uncharacterized protein
  Pfam annotation: Domain name=Transposase_23; Domain location=215-274; Score=0.9; E_value=0.00093; Accession=PF03017.5; Description =TNP1ENSPM transposase
MAEKTKSRLNEGDNSQNANMVVDPPSPIARHEKWKKARTNKFGQMTSAAAQEIANKIDELQEQAKQGAFVPHGRQDILNTSIGRPEHPGRVPVSGHGVTITSYFRHASCGSHSSSPAITAERLVEIIQTIKQEVKKEVEDENKDRMDKMKMELDEIKSELSQIHTQQSAPPRPSNPDVFVARVSTKESCAKVANNVVGSERSTFDTCSMGFYIVCGDSTQLVAGGKVFGVGGTIHTVAYGDDVVRVCVDTVYDAKAIVPLPTSEIQYVRDAVNSFIGWPRHLVKPLSYDSDLNVRKPVEHSSDAKLAGESDPLGELMKILFYVYQNPMEVPWEAHQFGLPEIGAKFYITHADLAEIISGDKCLNIAILQLWAIFMNECGRSKADQSLYGLLEPQSIQNAKERRQQCQQYIETWVKESQRQLYLGAYLHQAHWQLFVLHLRENTVVWFCSLRKKPDISIKGAINSAMKTITSSFEGMSNQGAPRWVEPKWFSDGSSLDVEVITTIRQKWATYFLSFRKSSC

SEQ ID NO: 119628 - protein, 323 aa, Glycine max
  Coding DNA Sequence Number=SeqID_27943
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum membrane; Biological process=fatty acid biosynthetic process
  Homolog annotation: Hit_ID=P48631; Match level="QueryCoverage=93%, HitCoverage=79%, E-value=1e-165, Identity=91%"; Hit description =Omega-6 fatty acid desaturase, endoplasmic reticulum isozyme 2
  Pfam annotation: Domain name=FA_desaturase; Domain location=29-280; Score=332.8; E_value=6.2e-97; Accession=PF00487.15; Description =Fatty acid desaturase
MAAETPSTNPLIELAIVSSLPTNMRGLGFHAVQGCILTGVWVIAHECGHHAFSDYQLLDDIFGLVLHSGLLVPYFSWKYSHRRHHSNTGSLERDEVFVPKQKSCIKWYSKYLNNPPGRVLTLAVTLTLGWPLYLALNVSGRPYDRFAYHYDPYGPIYSDRERLQIYISDAGVLAVCYGLFRLAMAKGLAWVVCVYGVPLLVVNGFSVLITFLQHTQPALPHYTSSEWDWLRGALATVDRDYGILNKVFHNITDTHVAHHLFSTMPHYHAMEATKAIKPILGEYYRFDETPFVKAMWREARECIYVEPDQSTESKGVFWYNNKL

SEQ ID NO: 119629 - protein, 61 aa, Glycine max
  Coding DNA Sequence Number=SeqID_27944
MEAPAAIVVGDGEGNLTGGPLMMIFHHGDAAEDKGEEVRGGAIHKGISHGRRSFTTKMSLG

SEQ ID NO: 119630 - protein, 38 aa, Glycine max
  Coding DNA Sequence Number=SeqID_27945
MELQRKIKEKSLAHGKLPGEARKVASLGSYRKKAALRR

SEQ ID NO: 119631 - protein, 667 aa, Glycine max
  Coding DNA Sequence Number=SeqID_27946
  Gene Ontology: Mol. function=nucleic acid binding; Cellular component= nucleus; Biological process=metabolic process
  Homolog annotation: Hit_ID=A7Q172; Match level="QueryCoverage=96%, HitCoverage=89%, E-value=0.0, Identity=49%"; Hit description =Chromosome chr10 scaffold_43, whole genome shotgun sequence
  Pfam annotation: Domain name=PPR; Domain location=125-159; Score =25.2; E_value=0.00024; Accession=PF01535.11; Description=PPR repeat
  Pfam annotation: Domain name=PPR; Domain location=226-260; Score =41.9; E_value=2.3e-09; Accession=PF01535.11; Description=PPR repeat
  Pfam annotation: Domain name=PPR; Domain location=26-60; Score=18.6; E_value=0.023; Accession=PF01535.11; Description=PPR repeat
  Pfam annotation: Domain name=PPR; Domain location=327-361; Score =36.5; E_value=9.4e-08; Accession=PF01535.11; Description=PPR repeat
  Pfam annotation: Domain name=PPR; Domain location=430-464; Score =41.0; E_value=4.2e-09; Accession=PF01535.11; Description=PPR repeat
  Pfam annotation: Domain name=PPR; Domain location=465-499; Score =15.8; E_value=0.1; Accession=PF01535.11; Description=PPR repeat
  Pfam annotation: Domain name=PPR; Domain location=567-601; Score=3.2; E_value=3.3; Accession=PF01535.11; Description=PPR repeat
  Pfam module annotation: Pfam domain module=PPR::PPR::PPR::PPR::PPR::PP R::PPR; Domain location=125-159::226-260::26-60::327-361::430 -464::465-499::567-601
MDCYAKFGLLNTSQRLFHFTENPDSVLYSAILRNLHQFGEYEKTLLLYKQMVGKSMYPDEESCSFALRSGSSVSHEHGKMVHGQIVKLGLDAFGLVGKSLIELYDMNGLLNGYESIEGKSVMELSYWNNLIFEACESGKMVESFQLFCRMRKENGQPNSVTVINLLRSTAELNSLKIGQALHAVVVLSNLCEELTVNTALLSMYAKLGSLEDARMLFEKMPEKDLVVWNIMISAYAGNGCPKESLELVYCMVRLGFRPDLFTAIPAISSVTQLKYKEWGKQMHAHVIRNGSDYQVSIHNSLVDMYSVCDDLNSAQKIFGLIMDKTVVSWSAMIKGCAMHDQPLEALSLFLKMKLSGTRVDFIIVINILPAFAKIGALHYVSYLHGYSLKTSLDSLKSLKTSFLTSYAKCGCIEMAKKLFDEEKSIHRDIIAWNSMISAYSKHGEWFRCFQLYSQMKLSNVKLDQVTFLGLLTACVNSGLVSKGKEIFKEMVEIYGCQPSQEHHACMVDLLGRAGQIDEANEIIKTVPLESDARVYGPLLSACKIHSETRVAELAAEKLINMEPKNAGNYVLLSNIYAAAGKWDKVAKMRSFLRDRGLKKTPGYSWLELNGQVHEFRVADQSHPRWEDIYSILKVLELEAGDMEDDLELFDPSVIKGCELHMNQLNQL

SEQ ID NO: 119632 - protein, 197 aa, Glycine max
  Coding DNA Sequence Number=SeqID_27947
MEAAEAQNTVTFEPLQKDLNMEIIVDVVNRDRLNSMEKQVRKIRSDQRLLFSNIDQLQRIMNEFFARFLRLEEWIPNKERPILIPKVALMQYEPPPPPRATTPPSSSSSSKNSSPNMHDWFTPFVPPFYFLLDDKEGEVYERLTRHNDHVGVRELAEAPREKAEEFENLDRGGAKACDDNIPWLNMGKVAKVEDESL

SEQ ID NO: 119633 - protein, 53 aa, Glycine max
  Coding DNA Sequence Number=SeqID_27948
MQLRMTHKLNSINEIDNSRETKKLAMRIINIWSVQIPARLIVDMIFMDKNIMA

SEQ ID NO: 119634 - protein, 55 aa, Glycine max
  Coding DNA Sequence Number=SeqID_27949
MSSIVEAKLSCLALVVVQYERFFDVSVRNAENTKKGGQKGHLEAFSGPWPAYATK

SEQ ID NO: 119635 - protein, 118 aa, Glycine max
  Coding DNA Sequence Number=SeqID_27950
MALLTNFPSLVLSSNCNLITVYTNHLASESLSFILNHHRKDFIDNREFITKSLKELSNKIMLVIAFSETTTRNKREKMVKLITQDHKLLLEVHQCGEDFHEKNIPSSHSIYQWHNQDR

SEQ ID NO: 119636 - protein, 134 aa, Glycine max
  Coding DNA Sequence Number=SeqID_27951
MKKYFYYGNQDEVRNATKFDLPNKDRKDSQGICFLGKVCGVSSSFTSYLFHGAEFGSKRKYMFRKVTIQLKLVEGDSAGTGPFLSQCIELFSSADNPICINELNITSLGIMEIPICLGGSISSTGSTLYVLMFS

SEQ ID NO: 119637 - protein, 71 aa, Glycine max
  Coding DNA Sequence Number=SeqID_27952
GAVLRILDVPGEVFQLFWVKNNCFREENPSRGASVTLPRGFHKQIREGFPPLFTVLHPFFILRSSFFVLQR

SEQ ID NO: 119638 - protein, 35 aa, Glycine max
  Coding DNA Sequence Number=SeqID_27953
MVVSFSLKVSCKKKMKVQVLVFGEEITKMDIVGIG

SEQ ID NO: 119639 - protein, 36 aa, Glycine max
  Coding DNA Sequence Number=SeqID_27954
MVVFHHGDAAEDKGEEETQVTDLWDYGLPFDVVWGI

SEQ ID NO: 119640 - protein, 94 aa, Glycine max
  Coding DNA Sequence Number=SeqID_27955
  Homolog annotation: Hit_ID=A5BEV8; Match level="QueryCoverage=85%, HitCoverage=10%, E-value=8e-15, Identity=45%"; Hit description =Putative uncharacterized protein
MDKWMNITHMGYVIASRYNAILFFLSLQQSMTFFPLRSQLPRDSSVYHIISIGHLYDNHFVQVFLRDGCPLPLVALLWSNTLSLSRKNVAYSLY

SEQ ID NO: 119641 - protein, 132 aa, Glycine max
  Coding DNA Sequence Number=SeqID_27956
  Homolog annotation: Hit_ID=Q69FA4; Match level="QueryCoverage=46%, HitCoverage=4%, E-value=4e-07, Identity=48%"; Hit description=Gag -pol polyprotein
MYKDKRAYLAHGPEIYPKAHENPKAFSCISGPIFLESFIQCPCGLKYKHKQMSLLDVITHIIIEDTNRKENAAARTKAMSAKANTVQEKPFHKRYKVMRNDNPPKPRANLVEGDDIIDVVIYQVNVVTNVNK

SEQ ID NO: 119642 - protein, 338 aa, Glycine max
  Coding DNA Sequence Number=SeqID_27957
  Homolog annotation: Hit_ID=Q5NRP4; Match level="QueryCoverage=27%, HitCoverage=6%, E-value=3e-07, Identity=33%"; Hit description =Putative gag-pol polyprotein, identical
  Pfam annotation: Domain name=zf-CCHC; Domain location=60-77; Score =21.5; E_value=0.00084; Accession=PF00098.14; Description=Zinc knuckle
VEQQLKRKSTSKSYGSHSYPKKDQGQGILGVRPSKPKDDKGKTIEKQPLKASMQEKTSSMKCFKCLGRGHITSQCPTKKTMIMRGQDIYSSQDEATTSPSSSKSEEAKGEESSEEIYPQEEGQPLMVKEECKETLVSIATSLRLEFIPQVKELLDEGLVLKRLNPCALLVPKIGIIRHQIPKIGGVMNALGGATLFCKITHAPNIFMICAHRDSLAPLIELVRNHVPSWEDAQEMSFQTLPYFNILNTTNTYGEGIPHDASSIGACRPRIFFINGFLCFLEDEWQRNGERERERRRHFKEKMSLEEAHHHRRPWIRAWRKKEMNEGRRREEHEILCSK

SEQ ID NO: 119643 - protein, 170 aa, Glycine max
  Coding DNA Sequence Number=SeqID_27958
MAKKKGSLVGLLCLITALGARRDIDITNDIAQSYVDLKTFGKGLVAHLATSYLFLSQEEMLAAMGWLTLSGDQAQESQMGGEATNGVGAGAEDVANDGNDGSMLLNLLLTMKLEQRKRLMLRKLLRLYLKRTTMERNLKLLNGPTLSYSLFLPYFFILSILFDSEQFNVL

SEQ ID NO: 119644 - protein, 199 aa, Glycine max
  Coding DNA Sequence Number=SeqID_27959
MEQWCSSMHSCDASSTVTRVNKNERNDMISTEEEEEKKKKERWHSAVHGRELPWRNHFSHEIEETNLGLLLLSASKITTQFNKTLLVLATRSIVDATGRFPLMTSQKRSSSKPTCKVWDPTFAASTLTCPGSGFRLEHLASTVEPRTRSGLRRETPLEDSHPHSAAVVDMDILRLLQNRIAKMEQRHEEELTKLKADHD

SEQ ID NO: 119645 - protein, 552 aa, Glycine max
  Coding DNA Sequence Number=SeqID_27960
  Gene Ontology: Mol. function=nucleic acid binding; Cellular component= ribosome
  Homolog annotation: Hit_ID=A2Q6B4; Match level="QueryCoverage=37%, HitCoverage=83%, E-value=4e-24, Identity=31%"; Hit description =Ribosomal protein L33; Nucleic acid-binding, OB-fold
  Pfam annotation: Domain name=DUF223; Domain location=128-225; Score= -15.8; E_value=0.089; Accession=PF02721.5; Description=Domain of unknown function DUF223
MAVALCNTLASSALHQMSRQENPFLHLYHPLPLPSSVFFSLVVVECPHEEASSRQAWWLLNVVTKKHPAGKVFVPFALIIIARILDKIKDIDGSKETLKLVVRITDLWFVGMPNKSEQAEMIIVDSDFVSYFAHDQGDQIHVVCKRDQLKSWKSVLKENCTHVMHNFKVMKNDGQYRVCDHQYKLVFTGVIVLRQTHLDNVPLKKKYNFTQFSNIIVGHFQPGLLVDIIGVVDEVVFRHVSSRSTRVVFKLKDLSEQLLSCTLWEDYCLQFLEYLNECQSDGPIIVLLTHARIKEAQGSYPPSVSNSLKASKLVSNELVDEIQEFKDRLSELGIEVHSVMTPRGQGSSQLSACIQCHKKTDIDTIVFTCACGKYNEQAMLRYRLEVMVSHKEESTKFLFWDHECTNLIGQSADEVNRLKIVDGDVDLNASPKGLDKLLGYVFAFKVKVQPKFRNVVVLKYSRDLSLINTIMELLPDAEASSKIDIAIPDSNDPYHHESQSMSGTADHDPLLGLPLTPTKRQPSQECDDEARSSQISPAQLSSNKLVKHAKIE

SEQ ID NO: 119646 - protein, 218 aa, Glycine max
  Coding DNA Sequence Number=SeqID_27961
MYVLRFLWTPYDTPKIRPLINDVEVSMIVQAEVSHICFAIVEWHPIDRYYPYYPDHHQHQSYAEPNVPPIHVPGFMSQHHPSQAQYQLAAFSRYASQGCQQSFQLVEFSSYMPQYSFQVSSTSNVFYGPSQMFVTTFNTPPFAYNLSSAYNLPPSTSCYRPSLPTQMRDLGHEDEDDDDDVGDDDDDNGGDHVPQQQHTITREHLRTRGGRGCRPRGQ

SEQ ID NO: 119647 - protein, 213 aa, Glycine max
  Coding DNA Sequence Number=SeqID_27962
MTLLLSNILPSNYNTDLPLRSISWDHAHKTPSGPREVQQGPGVFSSSYGPLSVLQGARPPQQGIVPARHPMDPEKSNRALRKAQGETPQQAGDGQQQAIDAPPPPPEPLSSSTKARALPTTCGRPASDQVQSQRYLAPIVTQSVRFRNMLEIKRKHCYAILEVPQHSESQKGDDYVIRKVPVQIATRLTWAFQDVPPEGGCFWRKQPSSPGRA

SEQ ID NO: 119648 - protein, 466 aa, Glycine max
  Coding DNA Sequence Number=SeqID_27963
  Gene Ontology: Mol. function=motor activity; Cellular component=cell projection
  Homolog annotation: Hit_ID=UPI00016621D1; Match level="QueryCoverage =99%, HitCoverage=40%, E-value=2e-16, Identity=34%"; Hit description =UPI00016621D1 related cluster
FAFRGIYALGIRGLHEIPFRGLHVLAIRGLHVLAFRGLHTLPFRRLHFLTFRGLPVLTFRGLRILTFRGLHALTFRMLHVLAFRELHGLAVRGLHVLAFRGLHVLVFRGLHALTFRGLHVLTFRGLRALTRSPSKGFTPSPLEDYTSSPSEVYTSSPSEGYTSPPSEDYTSLPSEGYMSSPLEDYTSCPSEDYTSSPSEDSTSSPSDCYRASPSEDCASSPSEGYTSTPSEAYMPWPSENYTSWPSKDYTSMPSEENTSSVCRGLHFFTFRGLHALTPSCPHLQRTSRPRLQRATRPRRLHVLTFRGLHILTFRGLHVLPFRGLHVLASGGLHVLAFIGLHVLTFKGLHALAFRGLHVLPFRGLRVLTIRRLHVLTFSGLHVLPFRGLHALTFRGLCILTFKGLHALALRGLHVFAFRGLHVLAFRELHVLPFSGLRVLAIRGLHVFTFRELHVLPLRGLHALTLK

SEQ ID NO: 119649 - protein, 217 aa, Glycine max
  Coding DNA Sequence Number=SeqID_27964
MQVRVRGHLTKFDVDSLNTFLQTPVVVEGFVLNAEGLPWKILRKDLTTLAQTWSVLSYSNLALTSHTSDLNLDRARFHSLLSPTPRGFDFQPYHCLVQGPRSHPRRIAGTWMTLRSLFQGPKNPGLEDLRPYLLQLPLLPLLLLPLLLLSHHHQQLQFFQVPQLRAFHVYDAEPAPRAAPDYAEFAGCGPAAASYEPDRVCSEGGLARSSAFSFGRG

SEQ ID NO: 119650 - protein, 60 aa, Glycine max
  Coding DNA Sequence Number=SeqID_27965
MRFLSAISAYKHHKHHHKNPKTEWKWWPKVEALLEASMENEEEESYVREGEKRLLNFCFG

SEQ ID NO: 119651 - protein, 93 aa, Glycine max
  Coding DNA Sequence Number=SeqID_27966
MTLQLVDRSITRPYGAIEDVLVRVKHFIFPADFMAIHFNCKLVDMGRKKLEMGFEDQKIDFDLFVEDKPALEQNVCLQVMEVGQEVLKVRTKT

SEQ ID NO: 119652 - protein, 161 aa, Glycine max
  Coding DNA Sequence Number=SeqID_27967
MAEKTKKRLEEAAQSGSTEGVIDPPSPIRRHDSLVEQASQGSFVPHGRQDVLTVAIGRPKHPGRVYAAGAGVTIKQYFGSAPRTSRSSSSMLPEDLQQLTQQIRDQLEESITEKSDSTGDGILQPDVVPVSVSDAITGTYTTSGARGWSLRCSCQHQGELC

SEQ ID NO: 119653 - protein, 98 aa, Glycine max
  Coding DNA Sequence Number=SeqID_27968
MVPFTCACGKYNKEVVLRYRLEVMINQEMKAQNSCFGTVNADGDVDLNASPQALDKLLGYELAFKIKVQPKFRNFAVLKCSTDSSLINVVMDMLADAE

SEQ ID NO: 119654 - protein, 60 aa, Glycine max
  Coding DNA Sequence Number=SeqID_27969
MEVYNEGVLLNSYLDVGTSCPRMYPCMHNVSGTTYPDNALKLSCAGGGSGTSFDNVSCCS

SEQ ID NO: 119655 - protein, 64 aa, Glycine max
  Coding DNA Sequence Number=SeqID_27970
ASGGRTRRILLGKDRLEWIASRGAAQSAAAGMDHRIRCDLWCLHHNAQKPVVMLEKAILVTFNA

SEQ ID NO: 119656 - protein, 106 aa, Glycine max
  Coding DNA Sequence Number=SeqID_27971
MKENKAKLARVIYEDIDVWNWYDVGNPFWIPSDGQKSSVKLLLHFFFYLQGRFGFSSSSISVLLGNTRDLEAIGAAQCQNSNRAYLGMTKQRCLGSLLAGLLILHG

SEQ ID NO: 119657 - protein, 188 aa, Glycine max
  Coding DNA Sequence Number=SeqID_27972
  Homolog annotation: Hit_ID=Q9AVH2; Match level="QueryCoverage=25%, HitCoverage=16%, E-value=7e-20, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRCKATLPLTIPRRVSKSSAKDSTRRSMGLRFKASRRANPPHRGSPTARAFGGRAPTAVGKRTAGARVASSPDSDLEAFSHNPTHGSFAPLAFQPSAMTNCANQRFLSY

SEQ ID NO: 119658 - protein, 228 aa, Glycine max
  Coding DNA Sequence Number=SeqID_27973
  Homolog annotation: Hit_ID=Q2HW90; Match level="QueryCoverage=93%, HitCoverage=40%, E-value=2e-25, Identity=35%"; Hit description =Putative uncharacterized protein
MASQEKWGPFADILALLIFGVVLFPNVDGLVDLAAIDAFLAYHHSKESPVVAILVDLFDTFDQRCEKNSARIVCCLPALCVWIVSHLFQQDTRHPCPLQSYRSCAQKGRVDWDQHLAGIGGNAINWFPRWKEGKEGVLFSCGDYPNVPLIGTRGCINYNPALAIRQLGYPMRGAPTEESLSPFLMRDLGAKSLKGIQRVHKAWRSPLKKDKELRGIRNGVIGGYHGWL

SEQ ID NO: 119659 - protein, 274 aa, Glycine max
  Coding DNA Sequence Number=SeqID_27974
MRGALTEESMSLFLVRDFGAQNSKTIQRIHKAWETPLKKIKSLEAFVMASLVDWLAKLKVVSKESFEAPEEDKEVQALKSELGKAKLAKEKFKLAATHVRKECAGLREENAITARALEQETKRARKEEYGRNKFRGALWGSNSELKLRREERDQSRAHGMVLKEELVACSRSKRSLSQRLCETETNMLAIIAKYQEELAMAHEHRIADEYAQVYAEKEARGRVIDSLHQEATMWMDRFALTLNGSQELPRLLAKAKAMADTYSTPEEIHGLLGY

SEQ ID NO: 119660 - protein, 83 aa, Glycine max
  Coding DNA Sequence Number=SeqID_27975
KKKRRSRGESRHGLITERVRRTKSMSYLCFPLISDKRYLAPFVAQYVNLETRRKSKGSRVMRSVKFHNVAETKRKCCAIREFL

SEQ ID NO: 119661 - protein, 107 aa, Glycine max
  Coding DNA Sequence Number=SeqID_27976
MENSDKMNFKEKKEKKGYITWEDNVINYSNDSEKKIISLDNKRRPHFSPKKSEYAIYGDNKQRPLDQQPQQLEVGSSYWKLKVKNGSWKLEVEVIGSWKLEMKVIGS

SEQ ID NO: 119662 - protein, 128 aa, Glycine max
  Coding DNA Sequence Number=SeqID_27977
MTGRLLAKSLTFDNRIMHYIIVRILLPRSSNLAQASEEDLILMWAFLTGRQIDWAHLVRYRMHKALWANAHLPYPQLITLFLRHFQIPLDDEPFVQVKRSFAIGASAVTSFGYRKDQNGEERRTPSSR

SEQ ID NO: 119663 - protein, 172 aa, Glycine max
  Coding DNA Sequence Number=SeqID_27978
MVIAVDGAHVRYVGCCVFSRGTKCTDLVGWPICGGPVWLKNLSISEGMLRRFNWSMVFGTCFGPRSYVVCSVCSWGVECTDLVGWPIHGRQAWLKNLSISKGMLRMTVVSQHALLRACEARLTGALSKGGKMCGVATNVDKSGALAPTYPPSKRKSDLRSSSLRVNQAILFT

SEQ ID NO: 119664 - protein, 168 aa, Glycine max
  Coding DNA Sequence Number=SeqID_27979
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAGILESRPAGMQAWHWPSFYNVVTGKTLALPNLIALQHIPLSPAGVIAKRPAPIALPNSCAA

SEQ ID NO: 119665 - protein, 92 aa, Glycine max
  Coding DNA Sequence Number=SeqID_27980
SKSLTFVDHTAFCYHDPRAGSPRRHLTVIRTSSVIDKRRPIWSSAPFLEIGGGPDDTRRYLTVIRTLLSSRGGGPDDTQRQKLVILHPCVIQ

SEQ ID NO: 119666 - protein, 139 aa, Glycine max
  Coding DNA Sequence Number=SeqID_27981
MAPGWWPQMTRPPYAEVPGMWDLRLPYEEKGASEVDAGVEAVEVEGSLASLALTLLAPQIETTTPMALHNTVIRAGNPSLEVLDWAIEVIWPEISAPMFISKIFPGWPSEFKMNPQPGMHKAGSISLKSIGNLQYLEYA

SEQ ID NO: 119667 - protein, 173 aa, Glycine max
  Coding DNA Sequence Number=SeqID_27982
GLALPSEPEDGPLAGRVSTKGSCVDPSGNDPDTGDSDKYGLYIEENPPCLVALGRVYDGSTTVHNIPLLHDQVNVGIEQVKDADAPILVPTDKGAVGPVKLADRSDHEFDDPLYLLTLTSPQPILKSLQVMWDATVFGVFNEDFPLYIKHEDLSEIAHGGQCLSISVKQLWIL

SEQ ID NO: 119668 - protein, 1557 aa, Glycine max
  Coding DNA Sequence Number=SeqID_27983
  Gene Ontology: Mol. function=nucleotide binding; Cellular component =cytoplasm; Biological process=defense response
  Homolog annotation: Hit_ID=A5BH36; Match level="QueryCoverage=99%, HitCoverage=94%, E-value=0.0, Identity=32%"; Hit description =Putative uncharacterized protein
  Pfam annotation: Domain name=AAA; Domain location=175-387; Score= -31.1; E_value=0.011; Accession=PF00004.20; Description=ATPase family associated with various cellular activities (AAA)
  Pfam annotation: Domain name=Dynamin_N; Domain location=176-411; Score=-48.4; E_value=0.1; Accession=PF00350.14; Description=Dynamin family
  Pfam annotation: Domain name=LRR_1; Domain location=1080-1103; Score =4.1; E_value=54; Accession=PF00560.24; Description=Leucine Rich Repeat
  Pfam annotation: Domain name=LRR_1; Domain location=1106-1127; Score =1.7; E_value=1.5e+02; Accession=PF00560.24; Description=Leucine Rich Repeat
  Pfam annotation: Domain name=LRR_1; Domain location=1139-1165; Score =0.3; E_value=2.7e+02; Accession=PF00560.24; Description=Leucine Rich Repeat
  Pfam annotation: Domain name=LRR_1; Domain location=1167-1194; Score =1.2; E_value=1.8e+02; Accession=PF00560.24; Description=Leucine Rich Repeat
  Pfam annotation: Domain name=LRR_1; Domain location=1366-1388; Score =2.8; E_value=93; Accession=PF00560.24; Description=Leucine Rich Repeat
  Pfam annotation: Domain name=LRR_1; Domain location=1390-1415; Score =3.8; E_value=61; Accession=PF00560.24; Description=Leucine Rich Repeat
  Pfam annotation: Domain name=LRR_1; Domain location=1440-1461; Score =0.3; E_value=2.6e+02; Accession=PF00560.24; Description=Leucine Rich Repeat
  Pfam annotation: Domain name=LRR_1; Domain location=569-590; Score =7.4; E_value=13; Accession=PF00560.24; Description=Leucine Rich Repeat
  Pfam annotation: Domain name=LRR_1; Domain location=592-613; Score =0.7; E_value=2.3e+02; Accession=PF00560.24; Description=Leucine Rich Repeat
  Pfam annotation: Domain name=LRR_1; Domain location=615-636; Score =12.7; E_value=1.3; Accession=PF00560.24; Description=Leucine Rich Repeat
  Pfam annotation: Domain name=LRR_1; Domain location=638-661; Score =13.1; E_value=1.1; Accession=PF00560.24; Description=Leucine Rich Repeat
  Pfam annotation: Domain name=LRR_1; Domain location=800-821; Score =2.1; E_value=1.2e+02; Accession=PF00560.24; Description=Leucine Rich Repeat
  Pfam annotation: Domain name=LRR_1; Domain location=866-887; Score =0.1; E_value=2.9e+02; Accession=PF00560.24; Description=Leucine Rich Repeat
  Pfam annotation: Domain name=LRR_1; Domain location=892-913; Score =4.1; E_value=53; Accession=PF00560.24; Description=Leucine Rich Repeat
  Pfam annotation: Domain name=LRR_1; Domain location=916-936; Score =2.6; E_value=1e+02; Accession=PF00560.24; Description=Leucine Rich Repeat
  Pfam annotation: Domain name=LRR_1; Domain location=996-1017; Score =1.9; E_value=1.4e+02; Accession=PF00560.24; Description=Leucine Rich Repeat
  Pfam annotation: Domain name=MMR_HSR1; Domain location=174-276; Score= -17.5; E_value=0.043; Accession=PF01926.14; Description=GTPase of unknown function
  Pfam annotation: Domain name=NACHT; Domain location=174-355; Score= -29.1; E_value=0.011; Accession=PF05729.3; Description=NACHT domain
  Pfam annotation: Domain name=NB-ARC; Domain location=134-455; Score =70.5; E_value=5.4e-18; Accession=PF00931.13; Description=NB-ARC domain
  Pfam module annotation: Pfam domain module=AAA::Dynamin_N::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::MMR_HSR1::NACHT::NB-ARC; Domain location=175-387:...
  Pfam module annotation: Domain location=:176-411::1080-1103::1106 -1127::1139-1165::1167-1194::1366-1388::1390-1415::1440-1461::569 -590::592-613::615-636::638-661::800-821::866-887::892-913::916 -936::996-1017::174-276::174-355::134-455
MDAVSSALLEPVTNSVLDLIKKQVDYIRYRQNIDELDECVKQLKHKKEIVDHKCEEAVKNGHEIEGKVREWLGKVGKFETEVEKYRKDDGHKKTRFSNCLFLYFWHRLGRLAKKMAVEGKKITDDCPNSDEIAYRVYVTSNDAILSNNDLMDFGSRKSIMEQIMATLVEDPTVKMIGVYGRSGVGKSTLIKAIAKIARDKKLFNVVAFSEITDNPNLKQVQEDIAYPLGLKLEGEGENVRADNLRRRLKKEKENTLIILDDLWDRLDLNRLGIPLDGDVDDNDLSKKTNSDNQGPQGPTKEKSLGDYKGCKILLTSRKQNVLTDKMEVKLTFCVEELDEKDALKLFRKEAGIHGEMSKSKQEIVKKYCAGLPMAIVTVGRALRDKSDSEWEKLKNQDLVGVQNPMEISVKMSYDHLENEELKSIFFLCAQMGHQPLIMDLVKYCFGLGILEGVYWLGEARERISTSIKKLKDSGLVLDGSSSIHFNMHDLVRDAALSIAQNEQNVFTLRNGKLNDWPELKRCTSISICNSDIIDELPNVMNCPQLKFFQIDNDDPSLKIPESFFKRMKKLRVLILTGFHLSSLPSSIKCLSDLRLLCLERCTLDHNLSIIGKLKKLRILSFSGSRIENLPAELKDLDKLQLLDISNCSIVTMIPPNLISRLTSLEELYVRKCFMEVSEEGERNQSQNSFISELKHLHQLQVVDLSIPCAEFFAKELFFDNLSDYKIEIGNFKTLSAGDFRMPNKYENFKSLALELKDDTDNIHSQTGIKLLFETVENLFLGELNGVQDVINELNLNGFPHLKHFSIVNNPSIKYIINSKDLFYPQDVFPKLESLCLYKLKEIEMIYFSSGTEMICFSPFTDCSFTKLKTIKVEKCDQLKNLFSFCMVKLLVSLETIGVSDCGSLEEIIKIPDNSNKIEFLKLMSLSLESLSSFTSFYTTVEGSSTNRDQIQITVMTPPLFGELVEIPNLENLNLISMNKIQKIWSDQPPSNFCFQNLIKLVVKDCQNLRYLCSLSVASSLRKLKGLFVSNCKMMEKIFSTEGNSADKVCVFPELEEIHLDQMDELTDIWQAEVSADSFSSLTSVYIYRCNKLDKIFPSHMEGWFASLNSLKVSYCESVEVIFEIKDSQQVDASGGIDTNLQVVDVSYLPKLEQVWSRDPGGILNFKKLQSIHVFSCHRLRNVFPASVAKDVPKLEYMSVSVCHGIVEIVACEDGSETNTEQLVFPELTDMKLCNLSSIQHFYRGRHPIECPKLKKLEVRECNKKLKTFGTGERSNEEDEAVMSAEKIFPNLEFLVIDFDEAQKWLLSNTVKHPMHRLKELRLSKVNDGERLCQILYRMPNLEKLYLSSAKHLLKESSESRLGIVLQLKELGLYWSEIKDIGFEREPVLQRLELLSLYQCHKLIYLAPPSVSLAYLTNLEVWYCYGLRNLMASSTAKSLVQLKSMKIRGCNELEEIVSDEGNEEEEQIVFGKLITIELEGLKKLKRFCSYKKCEFKFPSLEVLIVRECPWMERFTEGGARAPKLQNIVSANEEGKEEAKWQWEADLNATIQKGFNKHF

SEQ ID NO: 119669 - protein, 212 aa, Glycine max
  Coding DNA Sequence Number=SeqID_27984
  Gene Ontology: Cellular component=chloroplast
  Homolog annotation: Hit_ID=Q3BAI2; Match level="QueryCoverage=34%, HitCoverage=80%, E-value=3e-36, Identity=95%"; Hit description =Uncharacterized protein ORF91
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDRYAFRAGRNLPDKEFRYLRTVIVTAAVHRGFGRRLPCHQVTNFLDLPALGRRQPPYMVLRLCGDLCFW

SEQ ID NO: 119670 - protein, 86 aa, Glycine max
  Coding DNA Sequence Number=SeqID_27985
MRLSARSMSDKRVETNSTPFIIQEQRVEWNNKLGGKCAETDSAPFIIQEQQAEWINAYRRILRLLSFWNNKLGGKCAETDFAPFII

SEQ ID NO: 119671 - protein, 467 aa, Glycine max
  Coding DNA Sequence Number=SeqID_27986
  Gene Ontology: Cellular component=integral to membrane
  Homolog annotation: Hit_ID=A6T754; Match level="QueryCoverage=86%, HitCoverage=56%, E-value=1e-177, Identity=79%"; Hit description =Putative efflux transport protein
  Pfam annotation: Domain name=DUF307; Domain location=1-49; Score =84.0; E_value=4.7e-22; Accession=PF03733.4; Description=Domain of unknown function (DUF307)
  Pfam annotation: Domain name=DUF893; Domain location=62-467; Score =326.4; E_value=5.2e-95; Accession=PF05976.3; Description=Bacterial membrane protein of unknown function (DUF893)
  Pfam module annotation: Pfam domain module=DUF307::DUF893; Domain location=1-49::62-467
MFFGWWLCLMHIFSGIAQCLTIIGIPVGIANFKIAAIALWPVGRRVVSVETARAAREANARRRFHAWLYNARIFIALCGTTVAPWWIGEVKLTIPLTLGVVAAALTDLDDRLTGRLRNLAITLVCFFIASASVELLFPWPWLFAIGLTLSTTGFILLGGLGQRYATIAFGALLIAIYTMLGVTLYNSWYLQPLFLLAGAIWYNVLTLAGHLIFPIRPLQDNLARSYEQLAQYLELKSRLFDPDIEDESQAPLYDLALANGKLVAMLNQTKASLLTRLRGDRGQRGTRRTLQYYFVAQDIHERASSSHIQYQTLRDHFRYSDVMFRFQRMLSMQAQACQKLSRAILLRIPYQHDAHFERAFMHLDAALDRVRASGAPQDQVKALGFLLNNLRAIDAQLATIESVQTSVLASNHPENLLADDRPSGFSDIWLRLRSNMTPESALFRHAVRMSLVLCAGYAFIQFTGLNH

SEQ ID NO: 119672 - protein, 96 aa, Glycine max
  Coding DNA Sequence Number=SeqID_27987
  Gene Ontology: Mol. function=transferase activity, transferring glycosyl groups; Cellular component=intracellular; Biological process=carbohydrate metabolic process
  Homolog annotation: Hit_ID=A7ME77; Match level="QueryCoverage=76%, HitCoverage=9%, E-value=4e-31, Identity=90%"; Hit description =Phosphorylase
MANVAESHQPRCARWRSAGENCCIPDYNVSVAEHLIPAADLSEQISTAGKEASGTGNMKLALNGALTIGTLDGANVEIAQQVGEENIFIFGHTVEQ

SEQ ID NO: 119673 - protein, 222 aa, Glycine max
  Coding DNA Sequence Number=SeqID_27988
  Homolog annotation: Hit_ID=Q6WAY6; Match level="QueryCoverage=60%, HitCoverage=31%, E-value=2e-16, Identity=31%"; Hit description =Putative uncharacterized protein
MGTNQNGQRFYQVKVKSLDVTSLKELGRLMGPLQRQAFRKVYGKILDLAAAEVFTEAAVSLAQYYDQPLSKGVGSHEANSERRSGPQKYLEGKARDMASQEKWGPFPDILALLIFGVVLFPNVDGLVDLAAIDAFLAYHHSKESPVVAILADLFDTFDRSAINWFPRWKEGKEGVLFSCGDYPNVPLIGTRGCISYNPALAIRQLGYPMRGAPTEESLSPFP

SEQ ID NO: 119674 - protein, 91 aa, Glycine max
  Coding DNA Sequence Number=SeqID_27989
MKDKSEDFESHEIIKQRTLSPMKQANGHWYQRAQPYEKARDACNIHLEMLVMQKIDCLFLKDVIIHETSSYLFANLFGDSLRVYVLFDLVT

SEQ ID NO: 119675 - protein, 31 aa, Glycine max
  Coding DNA Sequence Number=SeqID_27990
MTAHHSSAQPKASRRVFVGASLGHLIEWYDY

SEQ ID NO: 119676 - protein, 163 aa, Glycine max
  Coding DNA Sequence Number=SeqID_27991
MRGYRMVIRTFCHPETRRQVQWHAGVPYGYPHLLLSRDGMSDDMRGYRMVIPTFREPGQTRPLTRETYVSSAPFVIVETTCPMTCGDGESDDIRGYRMVIRTFHQPGENEPVDMQRLTSPSAPFVIQGQQVRWQAEIPYGHPHLSSTEANKFDDIRMMLVVRF

SEQ ID NO: 119677 - protein, 104 aa, Glycine max
  Coding DNA Sequence Number=SeqID_27992
  Subcellular localization annotation: CTP_CleavageSite=74; ConfidenceScore=5.13e-01
MLVHTICTRLFAAARVKSCPGMHSSCVIASLSGYARAVGPPPISGGGPGTVKRKLLARECSPMMAMTCNPLKVRACSPTKVKAHDPLTARKCSPLKVRACSPLM

SEQ ID NO: 119678 - protein, 159 aa, Glycine max
  Coding DNA Sequence Number=SeqID_27993
MNMFIDRLRPQTKQLLDVTIEGKIKLKTPKEAIELIENMLQVVPSVVRLMKQANVFPLKKTLKKFIIWEINSGKVMTTKDDDKGDEQKPQRSKNKSSESKNISSESRTSQEFKNQEEFKTQEENLESRIKIQDSRSQESRSRFKTQDSRMKKRLPQDKY

SEQ ID NO: 119679 - protein, 172 aa, Glycine max
  Coding DNA Sequence Number=SeqID_27994
  Homolog annotation: Hit_ID=Q2QSQ2; Match level="QueryCoverage=78%, HitCoverage=11%, E-value=3e-07, Identity=27%"; Hit description =Retrotransposon protein, putative, Ty1-copia subclass
MNKGDTNSQAIVIKSVEDEDGVFLTINDEVAKTKWVMNYVVSKHISRDRKMFNTLKTDGQFCHFKLGNGGKLKVECIGSVRIKLHNGAIRTFSNERTSQGYKYVGSKWGCKVYKGIHLVLQGQKNKGNLCYLDGQVLKRNHDNKVKKKVKFSNIVEVLGDTSIRRRVYSLSN

SEQ ID NO: 119680 - protein, 165 aa, Glycine max
  Coding DNA Sequence Number=SeqID_27995
MHERQSIHGAPNKSGEWRIALGNHYAWLQTHWWRIHERQSIHRAPNKSGEWRIALGNHYAWLQTHWWRMHERQSIHGAPNKSGEWRIALGNHYTWLQTHWWRMHERQSIHGAPNKSREWRIALGNHYAWLQTHGWRMHKRQSIHGAPNKSVGRTEWSIGGNIGLS

SEQ ID NO: 119681 - protein, 74 aa, Glycine max
  Coding DNA Sequence Number=SeqID_27996
MGESKKKRKEIPNQRVGESKKKRKEIPNQRVGESKKKRKKIPNRRMGESKKGRRKRKERKFLIKEAEEMCRKVF

SEQ ID NO: 119682 - protein, 75 aa, Glycine max
  Coding DNA Sequence Number=SeqID_27997
  Homolog annotation: Hit_ID=A5BKY7; Match level="QueryCoverage=97%, HitCoverage=13%, E-value=2e-17, Identity=58%"; Hit description =Putative uncharacterized protein
  Pfam annotation: Domain name=zf-CCHC; Domain location=39-56; Score =22.0; E_value=0.00072; Accession=PF00098.14; Description=Zinc knuckle
MGESEMLTTACRKNKAIKSQANQEGNGKIPPQADIKNVTKCFFCKKKEHMKKNCPKFQKWLEKKGYEKLKETSEK

SEQ ID NO: 119683 - protein, 98 aa, Glycine max
  Coding DNA Sequence Number=SeqID_27998
  Homolog annotation: Hit_ID=Q7X9F2; Match level="QueryCoverage=50%, HitCoverage=61%, E-value=9e-14, Identity=79%"; Hit description =Centromere protein
MRQICRGHLIALIFPFTKNGEIGNQSKILERLHCDAQELRNLQITIQDLMKKVDMNEKSTKGKSVEFGEVKGHQSRLTWVHLIPTYCIASKIAESTSW

SEQ ID NO: 119684 - protein, 15 aa, Glycine max
  Coding DNA Sequence Number=SeqID_27999
MDRFKVQGLKRTTFQ

SEQ ID NO: 119685 - protein, 129 aa, Glycine max
  Coding DNA Sequence Number=SeqID_28000
  Homolog annotation: Hit_ID=A5BEV8; Match level="QueryCoverage=69%, HitCoverage=13%, E-value=8e-07, Identity=31%"; Hit description =Putative uncharacterized protein
MDEDQWMYDTIIFEEVDMDDRNEQECGVNEPQVDCSDSFNTSQVFGSRDDVLQWARSVAHENEFVAVIIRSDTNTSSGGRSSFVLIGCERSGEYRCRKKEFVRIDTGTRKCGVPSSFVANQWLEGKVGR

SEQ ID NO: 119686 - protein, 280 aa, Glycine max
  Coding DNA Sequence Number=SeqID_28001
  Gene Ontology: Mol. function=nucleic acid binding; Biological process= DNA recombination
  Homolog annotation: Hit_ID=P33919; Match level="QueryCoverage=100%, HitCoverage=47%, E-value=1e-148, Identity=88%"; Hit description =Uncharacterized protein yejH
VSVLTTGLDAPHVDLIAILRPTESVSLYQQIVGRGLRLAPGKTDCLILDYAGNPHDLYSPEVGTPKGKSDNVPVQVFCPACGFANTFWGKTTADGTLIEHFGRRCQGWFEDDDGHREQCDFRFRFKNCPQCNAENDIAARRCRECDTVLVDPDDMLKAALKLKDALVLRCSGMALQPGADEKGEWLKITYYDEDGADVSERFRVQTPAQRTAFEQLFIRPHTRTPGVPLRWITVADIVHQQALLRHPDFVVARKKGQFWQVREKVFDYEGRYRRANELRG

SEQ ID NO: 119687 - protein, 72 aa, Glycine max
  Coding DNA Sequence Number=SeqID_28002
MTKGAEDDVSLCALTGLLPPWLTKGAEDNGVSAFQRTHSFVTIAKGGAVDKSEAFAPTYPQFVMRNSDLRSS

SEQ ID NO: 119688 - protein, 70 aa, Glycine max
  Coding DNA Sequence Number=SeqID_28003
  Subcellular localization annotation: CTP_CleavageSite=30; ConfidenceScore=5.12e-01
MGVQIATRPTWALQKILQKAVASGGSNPARLGELGGKLLPQFSINRGRSEVSTVLRHSSFVLHRSSAFNG

SEQ ID NO: 119689 - protein, 18 aa, Glycine max
  Coding DNA Sequence Number=SeqID_28004
MREVVSAQLAQELMKHWA

SEQ ID NO: 119690 - protein, 73 aa, Glycine max
  Coding DNA Sequence Number=SeqID_28005
MEGAGDNGGVYHQLDGSQCLLLDAMTTQMQRLLNHNNEELYRRIEGLEHQMNPNAGRVNNGSNRIEGKTELRE

SEQ ID NO: 119691 - protein, 170 aa, Glycine max
  Coding DNA Sequence Number=SeqID_28006
  Homolog annotation: Hit_ID=Q6WAY6; Match level="QueryCoverage=95%, HitCoverage=35%, E-value=4e-11, Identity=26%"; Hit description =Putative uncharacterized protein
GVLFSCGGYPNIPLIGKRGCINYNPALAIRQLGYPMRGAPTEESLSPFLLRGIRNGVVGGYHEWLKVRTRGLDWLPSLRTAKREEVEAPEEDEEVQAQIVKERFKSAALKTRKENAELRDINIATTKALEQETKRARREEHGRNKFREALWGSNNELKLRREERDQSRVD

SEQ ID NO: 119692 - protein, 220 aa, Glycine max
  Coding DNA Sequence Number=SeqID_28007
  Pfam annotation: Domain name=zf-CCHC; Domain location=200-217; Score =10.1; E_value=0.045; Accession=PF00098.14; Description=Zinc knuckle
MSHHSSSVNGEGTSHKDPLSRILDELSSLKLWKEKQERKEKGKKRVEEISQDERKKIREEERRKIMKEMKTEKHASYSSHNSCKSLSEELRDYYEGRHRSHLRRHSHRREKERNPQEANINLPYFHGKDNVEVNLDWEIRVEQQLKRNSTSKSYGSNSYPKKDQGQGILGVTPSKPKYDMGKTIEKQPLKGSMQEKTSSMKCFKCLGRGHFTSQWPTMKP

SEQ ID NO: 119693 - protein, 277 aa, Glycine max
  Coding DNA Sequence Number=SeqID_28008
  Gene Ontology: Mol. function=sugar:hydrogen symporter activity; Cellular component=integral to membrane; Biological process =carbohydrate transport
  Homolog annotation: Hit_ID=Q7XA50; Match level="QueryCoverage=72%, HitCoverage=37%, E-value=1e-90, Identity=86%"; Hit description =Sorbitol-like transporter
  Pfam annotation: Domain name=Sugar_tr; Domain location=11-277; Score=- 162.3; E_value=0.012; Accession=PF00083.15; Description=Sugar (and other) transporter
AQYANRLSPRVGRFSNAAGTTGFPTGKRAVSATQLIYDHDYEFELGTHYGFSKLTLKVGWRMMLGVGAIPSVVLTVGVLAMPESPRWLVMRGRLGEARKVLNKTSDSREEAQLRLAEIKQAAGIPESCNDDVVQVTKRSTGEGVWKELFLYPTPPIRHIVIAALGIHFFQQASGVDAVVLYSPRIFEKAGIKDDTHKLLATVAVGFVKTVFILAATFTLDRVGRRMQAWHWPSFYNVVTGKTLALPNLIALQHIPLSPAGVIAKRPAPIALPNSCAA

SEQ ID NO: 119694 - protein, 194 aa, Glycine max
  Coding DNA Sequence Number=SeqID_28009
  Subcellular localization annotation: CTP_CleavageSite=36; ConfidenceScore=5.08e-01
AKFDIAEATKVKTKVMSTVATRWRQFKSTLTSKFVFAKTEGQQTQDVVTKYGLDPEAWKQFEETRLTPNWEGIRKRAQSIQKHNDCPHVLSRGGYDLLEKKLLDQKRKRIQEEALLSENPASVDEPPSPIKRHVKWKVARTRAVGNMTSDSAQEIADKIDSLEEQQAQVSLLLSTTEGHQGHAAARPRPSANNN

SEQ ID NO: 119695 - protein, 23 aa, Glycine max
  Coding DNA Sequence Number=SeqID_28010
MGESKERKEESSWSKKPEEMCRE

SEQ ID NO: 119696 - protein, 70 aa, Glycine max
  Coding DNA Sequence Number=SeqID_28011
VKHDIKISNGENARNWAANVVLKFQDDPTVNDSEIVVFLRQVRWPARKREGFGRREKKRNCEAEENEESV

SEQ ID NO: 119697 - protein, 297 aa, Glycine max
  Coding DNA Sequence Number=SeqID_28012
MGIIGGYHEWLKVHIRGLDWLAKLKVVSEESFEAPEEDEEVQALKSELGKAKLAKEKFKLAATHIRKECAGLQEENATTARALEQETKRARKEEYGRNKFHGALWGSNNELKLRREERDQSRAHSMVLKEELVACSRSKRSLSQRLCETETNMLAIIAKYQAELGLATAHEHRIADEYAQVYAEKEARGRVIDSLHQEATMWMDRFALTLNGSQELPQLLAKAKAMADTYSAPEEIHGLLGYWKNTITKCATRHPYRIRSKSRTMGDQEETQEQMKADMSALKEQMASMMEAMLGMR

SEQ ID NO: 119698 - protein, 51 aa, Glycine max
  Coding DNA Sequence Number=SeqID_28013
  Subcellular localization annotation: CTP_CleavageSite=29; ConfidenceScore=5.22e-01
MALYGSAFAYSNPLMDTRLPCSGVFRLSRAGKGRRFVNRDPSLYLRPSLST

SEQ ID NO: 119699 - protein, 131 aa, Glycine max
  Coding DNA Sequence Number=SeqID_28014
  Homolog annotation: Hit_ID=A7Q2G2; Match level="QueryCoverage=97%, HitCoverage=47%, E-value=1e-09, Identity=26%"; Hit description =Chromosome chr1 scaffold_46, whole genome shotgun sequence
  Pfam annotation: Domain name=zf-CCHC; Domain location=75-92; Score =20.6; E_value=0.0012; Accession=PF00098.14; Description=Zinc knuckle
MATQENDKKKKKGIALKASSSIQEESDMEYSIDLDNDEELSLFVKRFNKFLRMRETQRRQNFKPKRRIEESSQTPRCYECNQLEHLRVDCPIFKKRMEKFENKNIGEMEAKKAYITWDDNDLESSDDYEKE

SEQ ID NO: 119700 - protein, 165 aa, Glycine max
  Coding DNA Sequence Number=SeqID_28015
  Homolog annotation: Hit_ID=A0ST23; Match level="QueryCoverage=19%, HitCoverage=65%, E-value=2e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLRKMEEGRTWPLRKREEGAFISASEQATSFSGVSGYRARIRNHVGKPVVPAALMNRPTRGERRFAYWALFRFLAH

SEQ ID NO: 119701 - protein, 169 aa, Glycine max
  Coding DNA Sequence Number=SeqID_28016
  Gene Ontology: Mol. function=nucleoside-triphosphatase activity; Cellular component=1-2nm peptidoglycan-based cell wall; Biological process=peptide transport
  Homolog annotation: Hit_ID=B0J149; Match level="QueryCoverage=51%, HitCoverage=33%, E-value=6e-36, Identity=89%"; Hit description=ABC transporter related
  Pfam annotation: Domain name=ABC_tran; Domain location=1-85; Score= -29.6; E_value=0.0002; Accession=PF00005.18; Description=ABC transporter
  Pfam annotation: Domain name=MttA_Hcf106; Domain location=106-164; Score=37.3; E_value=5.6e-08; Accession=PF02416.7; Description =mttAHcf106 family
  Pfam annotation: Domain name=oligo_HPY; Domain location=88-147; Score= -11.9; E_value=0.023; Accession=PF08352.3; Description=Oligopeptidedip eptide transporter, C-ter
  Pfam module annotation: Pfam domain module=ABC_tran::MttA _Hcf106::oligo_HPY; Domain location=1-85::106-164::88-147
IKPTPGRDICRGDNSSAWLIARALAIKPLLMLFDEPTSALDPELVGEVLATMRTLANRGLTMIVVTHEIGFAREAADRVVFMDGGVVVEQGPPEQVIGNPQHPRTQAIAKLLIIGALIVLLFGTNKLRSLGGDLGSAIKGFKKAMKDDESTATKSSAEETPAERVGHKE

SEQ ID NO: 119702 - protein, 99 aa, Glycine max
  Coding DNA Sequence Number=SeqID_28017
IVVPRKIRPERNVVIYHTEFDDFKEELERRNGHEELTSFVEGSIDVAIVKEFYANLYDPEDKLPKQVRVRGHLVNFDEDALNTFLKTLVDAIIPPKGIG

SEQ ID NO: 119703 - protein, 44 aa, Glycine max
  Coding DNA Sequence Number=SeqID_28018
PLDPTSGIRAGVEGRSPEYEKPRDLRSNPFQGRGNDAILSRKGI

SEQ ID NO: 119704 - protein, 174 aa, Glycine max
  Coding DNA Sequence Number=SeqID_28019
MLQVQEAKNKLDVPKDAEEKLCDETKGHKLDITSDRDVQILDDTKSNRRSGTSTMGDEAIKLSGSNRRPHSEITKNSKRGNAKANMETDNLDSVQEPKSETQLNTVPRKRGRKPNSLMNAEEAYDHSWISQETKPGKSANPERLAIAALLIHLLKNLLLERISCIECLKLLVKL

SEQ ID NO: 119705 - protein, 128 aa, Glycine max
  Coding DNA Sequence Number=SeqID_28020
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARISKLIWSTKFRALLSLSLHSSPSSSKLLSMASYGGELLLNSSSP

SEQ ID NO: 119706 - protein, 143 aa, Glycine max
  Coding DNA Sequence Number=SeqID_28021
  Gene Ontology: Mol. function=nucleoside-triphosphatase activity; Biological process=proteolysis
  Homolog annotation: Hit_ID=UPI0000ECBAF8; Match level="QueryCoverage =28%, HitCoverage=48%, E-value=1e-16, Identity=100%"; Hit description= UPI0000ECBAF8 related cluster
AQYANRLSPRVGRFINAAGTTGFPTGKRAVSATQLIYDHDYEFELGTQKVLVLATTNTPYALDQVHLGDTPHNLAESDFEHLTRKTEGFSGMQAWHWPSFYNVVTGKTLALPNLIALQHIPLSPAGVIAKRPAPIALPNSCAA

SEQ ID NO: 119707 - protein, 187 aa, Glycine max
  Coding DNA Sequence Number=SeqID_28022
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=1e-11, Identity=29%"; Hit description= UPI00006A17C9 related cluster
  Subcellular localization annotation: CTP_CleavageSite=67; ConfidenceScore=5.27e-01
VMLVRMIHTRLFAAARVKSCPSMHSSCVIASLSGCACTVGRPPILGGQRTLNSLKVWMWSTLKMRTRSPLKVRACSPLRVRTCSPLRVRTCSPLKVRTCSPLKARTCSPLEVRACSPLMVRTCSPLKARTCSPLKVRVCSPLLARTCSPLKSSKGDKYKYPRVHPYEKARDRLIERAGHPKSTRFGH

SEQ ID NO: 119708 - protein, 85 aa, Glycine max
  Coding DNA Sequence Number=SeqID_28023
MTATMGRDLEKVPRHLDAIRCNRPGHIKAHCPTHESRLEKKSHEERRSKKAYIAWDDNDSPDGSEKEINPLSKDYERDENISQED

SEQ ID NO: 119709 - protein, 307 aa, Glycine max
  Coding DNA Sequence Number=SeqID_28024
  Gene Ontology: Mol. function=nucleotide binding; Cellular component =plasma membrane; Biological process=intracellular protein transport across a membrane
  Homolog annotation: Hit_ID=A4W6K1; Match level="QueryCoverage=100%, HitCoverage=34%, E-value=1e-167, Identity=95%"; Hit description =Protein translocase subunit secA
  Pfam annotation: Domain name=DEAD; Domain location=50-220; Score= -34.6; E_value=0.016; Accession=PF00270.20; Description=DEADDEAH box helicase
  Pfam annotation: Domain name=SecA_DEAD; Domain location=1-230; Score =452.7; E_value=5.1e-133; Accession=PF07517.5; Description=SecA DEAD -like domain
  Pfam annotation: Domain name=SecA_PP_bind; Domain location=194-307; Score=193.2; E_value=6.7e-55; Accession=PF01043.11; Description=SecA preprotein cross-linking domain
  Pfam module annotation: Pfam domain module=DEAD::SecA_DEAD::SecA_PP _bind; Domain location=50-220::1-230::194-307
MEKLSDDELKAKTVEFRARLEKGETLESLIPEAFAVVREASKRVFGMRHFDVQLLGGMVLNERCIAEMRTGEGKTLTATLPAYLNALTGKGVHVVTVNDYLAQRDAENNRPLFEFLGMTVGINMSGLPAPAKREAYNADITYGTNNEYGFDYLRDNMAFSPEERVQRKLHYALVDEVDSILIDEARTPLIISGPAEDSSEMYRKVDKIIPHLLRQEKEDSDTFQGEGHFSVDEKARQVNLTERGLVKIEELLVAEGIMEEGESLYSPSNIMLMHHVTAALRAHALFTRDVDYLVKDGEVIIVDEHTG

SEQ ID NO: 119710 - protein, 133 aa, Glycine max
  Coding DNA Sequence Number=SeqID_28025
  Homolog annotation: Hit_ID=UPI00006A2D9E; Match level="QueryCoverage =62%, HitCoverage=43%, E-value=4e-07, Identity=19%"; Hit description =UPI00006A2D9E related cluster
MPSPSEDYMSSPSEYYTPSLSEDYTSSPLEGYTPSPLEDYISPLQRSTFLTFQGLHVLAFRGIHVLTFKGLHVLAFRWLHTVTFRGQHVLAFRGLHFLAFKGLHILTFRGLHVLTFRGLHAVTFRGLHALTFR

SEQ ID NO: 119711 - protein, 60 aa, Glycine max
  Coding DNA Sequence Number=SeqID_28026
MPFCGRAKARLTRALSKGGKMRRVATNEGISTSHVDKSGAFAPMYPPSKKKSDLRSSFLR

SEQ ID NO: 119712 - protein, 71 aa, Glycine max
  Coding DNA Sequence Number=SeqID_28027
MASYGGDSSKLIFSLKWRLLSLSSFFISLPFIFQEEKESIDEEDPRPTSSNGAYIMWYQEHLHLGSIIFHS

SEQ ID NO: 119713 - protein, 67 aa, Glycine max
  Coding DNA Sequence Number=SeqID_28028
MATTPERSLEGRPEPPTPVVDLSSPQLAADPSTPVLDIPEDQTTLVLALNTSPPATPVLHLTDEEDA

SEQ ID NO: 119714 - protein, 86 aa, Glycine max
  Coding DNA Sequence Number=SeqID_28029
MLSLEISEERKKEGENPSRGAFVTLPRRFCEQIREDFPLFFTILHPFFGLQPNYVGLISSLQLRIRRSKSPAFVDHPQEIVNGPTP

SEQ ID NO: 119715 - protein, 160 aa, Glycine max
  Coding DNA Sequence Number=SeqID_28030
  Gene Ontology: Mol. function=ammonium transmembrane transporter activity; Cellular component=integral to membrane; Biological process=ammonium transport
  Homolog annotation: Hit_ID=A7NYG6; Match level="QueryCoverage=46%, HitCoverage=16%, E-value=5e-14, Identity=53%"; Hit description =Chromosome chr6 scaffold_3, whole genome shotgun sequence
MCFTLSWHTSFAGMCKVVWLSKNNPADSGYGTCKSFNKYLNQENSQVVLAINLYMMRDWPMCRWLLVDHWDAVEACNGFLGGFVAITFGCLVVKAIGWVSVTMGPIFYALHKLEILRIPIDEEVVDLDISSHGGYAYAQEKNESEMIKYEKYNHTWEIKI

SEQ ID NO: 119716 - protein, 127 aa, Glycine max
  Coding DNA Sequence Number=SeqID_28031
  Homolog annotation: Hit_ID=B0HC01; Match level="QueryCoverage=25%, HitCoverage=70%, E-value=1e-10, Identity=100%"; Hit description =Putative uncharacterized protein
LGHHFKNSVAPPTYLALLILLPVAAASGDKSCLTGATLPEGRKADRYPVSGRVGTGERTRELPGGNAWGASLWKNASNAAFYGPGLLLAFAHMFFLRYPLILWITVLPPLSELIPLAAAERPSAASQ

SEQ ID NO: 119717 - protein, 163 aa, Glycine max
  Coding DNA Sequence Number=SeqID_28032
KEGASVNKFPRWKEGRTGALISCGGFPNVPLMGTKGCISYNPVRKAWEMVQKKDKELRGSNNGPISGYRRWLKAHMQSLDWLLSLRTTKGVEVEAPEEDEEVQALRAELEKAQTVKERFKSVALKIRKENAKLRDGSNNELKLRREERDQSRVDSLLLKDELK

SEQ ID NO: 119718 - protein, 120 aa, Glycine max
  Coding DNA Sequence Number=SeqID_28033
MVRTRGLGRALGQVTGRGVGRGDRDDSGDAPQRRRHTASAQRQRVAVTATHDEPVIPAPDVQDDPMEAPTAAEDIVADIPADTGIEAAEDEHKGFSGGPSDPSVFTLYANHVSCSVWTRE

SEQ ID NO: 119719 - protein, 163 aa, Glycine max
  Coding DNA Sequence Number=SeqID_28034
  Homolog annotation: Hit_ID=A5C7Z4; Match level="QueryCoverage=71%, HitCoverage=41%, E-value=8e-09, Identity=29%"; Hit description =Putative uncharacterized protein
MGCHHVRGLNLDFLLYIKHEDLSKIAHGGQCLSISMLQLWILGHWQMVVIVPKEHLVVWFCLLHNRPDNYLKGIIISALKGLDDAPQPKSKAPARWIVAKCNRQKGSTECGYYIMHWMSTIILGSFRNNWEAYFNDPRPLEPERLKALRIQWAHYYLRVRAQS

SEQ ID NO: 119720 - protein, 60 aa, Glycine max
  Coding DNA Sequence Number=SeqID_28035
MAVEWRRRRVERRCNFKEKMSQEEAHHHRKPWIRAWSPLIQDQVQDSPLSVLRCHEACKA

SEQ ID NO: 119721 - protein, 145 aa, Glycine max
  Coding DNA Sequence Number=SeqID_28036
MVIDQSLFYDLTQLPSEGVPFEGTLIDDWKFDFSVHDACRLVCTNQADMTGRILSGSLAFESRILHYLIVRILLPRSSSIAHVFEEDLIVMWAFHKGLQIDWAHLRSFLIGASVIASFGYQKEHDGSWVKKGARHVGEEGHDGED

SEQ ID NO: 119722 - protein, 147 aa, Glycine max
  Coding DNA Sequence Number=SeqID_28037
  Gene Ontology: Mol. function=motor activity; Cellular component=cell projection
  Homolog annotation: Hit_ID=UPI00016621D1; Match level="QueryCoverage =93%, HitCoverage=42%, E-value=5e-13, Identity=34%"; Hit description =UPI00016621D1 related cluster
GGPLSTSTLTFRGLHVLAIKGPHALAIRGLHVLAIRGLHALTFRGLHVLTFRGLHVISFRGLHALTFRGLHVLAFRRLHALAIRVLHALTFRGLHVLTFRGLHVLTFSGLHVLTFRGLRVLTFRGLHIFSFRVNAVKIFSDSQNGLG

SEQ ID NO: 119723 - protein, 41 aa, Glycine max
  Coding DNA Sequence Number=SeqID_28038
MDPKRIKVLPDWPTPPSVEGRNPEYEEPRDLRLLVLSFTEF

SEQ ID NO: 119724 - protein, 101 aa, Glycine max
  Coding DNA Sequence Number=SeqID_28039
MEQFLDKVAWHEAQLPLGRAHEVVPPNPIPTRTEPAPAESQPPVVDPHTSPEVEILSPPPAPPAPPLILIPDDADAETAPPPDSTAYYLEDGSDFSDWMDN

SEQ ID NO: 119725 - protein, 167 aa, Glycine max
  Coding DNA Sequence Number=SeqID_28040
MPISPAEVSVGLCRPDIGRGRAHKTPSGLEEVQQGPGVSSSSYGPLSILQGARTPPPCMVMPSRHRDRARRTPSGTKEVQQGPGVSSSDYGPLSVLRSACHPSKVIRPPTNRAFIKKYCAPMQAEGETPQQPGDGQQQATNAPAPTPEPLSSSIKRLEYCLRHMAEQ

SEQ ID NO: 119726 - protein, 231 aa, Glycine max
  Coding DNA Sequence Number=SeqID_28041
  Gene Ontology: Mol. function=nucleotide binding; Cellular component =intrinsic to membrane; Biological process=defense response
  Homolog annotation: Hit_ID=Q2YE87; Match level="QueryCoverage=90%, HitCoverage=16%, E-value=1e-87, Identity=81%"; Hit description=NBS -LRR type disease resistance protein Rps1-k-2
LASPDFVHLILGKKLSKKLLRKLETTLRVVGAVLDDAEKKQITNTNVKHWLNDLKDAVYEADDLLDHVFTKAATQNKVRDLFSRFSDRKIVSKLEDIVVRLESHLKLKESLDLKESAVENLSWKAPSTSLEDGSHIYGREKDMEAIIKLLSEDNSDGSDVSVVPIVGMGGVGKTTLAQLVYNDENLKQIFDFDFKAWVCVSQEFDVLKRIMLIGVFLRNHSTVGLGEVRFF

SEQ ID NO: 119727 - protein, 147 aa, Glycine max
  Coding DNA Sequence Number=SeqID_28042
  Homolog annotation: Hit_ID=UPI00016621D1; Match level="QueryCoverage =88%, HitCoverage=40%, E-value=8e-13, Identity=40%"; Hit description =UPI00016621D1 related cluster
MRGTVHEPQANLGGGPLDTSTLTFRGQHVLAFAFIGLYVLTSRGLHVLAFRGLHVLTFRGLHALAFRGLYVLTFRGLYVLAFRGLHVLTFRGLHVLTIRGLHVLTIRGLHVLTFRGLHILTFRGLDVLVFRGLHALAIRGLCVLTFR

SEQ ID NO: 119728 - protein, 189 aa, Glycine max
  Coding DNA Sequence Number=SeqID_28043
MTNRLFVGSSAFDCRIMHYIIVRILLPNSSNLAQASKEDLILMWAFLTDCQIDWADLVKYRMHKALRTNAPLPYPQLVTLFLRHFQIPLDDEPFVQVKRSFAIGVGAWNRKQDSPPPVSDEHTLSPLPQRDASSTLMHEVLSELRGLRAFVGDRLDAMDAHFKGMDTRITQLEDDMGFIRRCFDPPAAP

SEQ ID NO: 119729 - protein, 112 aa, Glycine max
  Coding DNA Sequence Number=SeqID_28044
  Homolog annotation: Hit_ID=A0ST23; Match level="QueryCoverage=28%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIAAGLFAITPAGERGMCCKAIKLVGKPVVPAALMNRPTRGERRFAYWALFRFLAH

SEQ ID NO: 119730 - protein, 101 aa, Glycine max
  Coding DNA Sequence Number=SeqID_28045
MGPWGFQLWLRASISPTGCPYPPRQGHVIIGIAPARHPVDPKKSNRVLELSSSKYGSLSVQGSACCPQQGHQAPYQSSFHLEVLRPQAGAGRDTTAALGWT

SEQ ID NO: 119731 - protein, 182 aa, Glycine max
  Coding DNA Sequence Number=SeqID_28046
MDIIPDKYPLSLQHIKFGSKLYVNADITEIHEFRQSLSVPFYSGGMINDKDGSQSQSSQSNVVEKFLQNAQVVSIGEINNLRQDCYCLTVGTVDEIIIDAPWSYDSCPNCTTTFDPLKGGSACRSCHTSVVDTVPRYKLNVKMEHNGDKGNFLLWDATCIKLFGKTAGECRDELIAVGDDIK

SEQ ID NO: 119732 - protein, 175 aa, Glycine max
  Coding DNA Sequence Number=SeqID_28047
MVGYTPSSFTDLVFTSKKIEVDPKRGKFDHPTRTTEKIGANKEGEDEGETHAVTAIPVRPNFPPTQQYLYSADNKLSPYPPPSYPQRPSLNLPQSLSTALPMTNTTFSTNQKHQPRTVTLAKVHQPPFIREYDSNATCACHGEAPGRSIEHGRALKRKVQGLIDTGWLKFEENCV

SEQ ID NO: 119733 - protein, 163 aa, Glycine max
  Coding DNA Sequence Number=SeqID_28048
MIFMDCHHRKGGDCGSKNFQDYFDDAKESRVKQIPKIQESSFKNQDSRFKNQVSRIKIQEQSRSRFKNNQDQDSRLKIQESREDSVKIRYILCGISRGYIYLGCYTENKRGYISCGSVQVEGTSTWLFKENKGGYIPCESLACKGFYKVERNLKNRWLLGDWM

SEQ ID NO: 119734 - protein, 32 aa, Glycine max
  Coding DNA Sequence Number=SeqID_28049
MSGNQCDNLSIVWEARCARFVSETWKGSVAID

SEQ ID NO: 119735 - protein, 253 aa, Glycine max
  Coding DNA Sequence Number=SeqID_28050
  Gene Ontology: Mol. function=transferase activity, transferring nitrogenous groups; Cellular component=cytoplasm; Biological process= biosynthetic process
  Homolog annotation: Hit_ID=Q9RAN0; Match level="QueryCoverage=100%, HitCoverage=58%, E-value=1e-114, Identity=77%"; Hit description =Aspartate aminotransferase
  Pfam annotation: Domain name=Aminotran_1_2; Domain location=1-252; Score=-41.3; E_value=3.7e-05; Accession=PF00155.12; Description =Aminotransferase class I and II
GTARHYVCDEQSGWLPDLKDIENKITANTKGIVIINPNNPTGALYPKETLEGIIEIARHHGLVIFADEIYDKVLYDGNTHTSIASLADDVLFVTFNGLSKNYRACGYRSGWMIISGDKKDAKDYIEGLNMLASMRLCANVPGQLAIQTALGGYQSINDLVAPSGRLCKQRDLAYDMLTSMPGVTCVKPAAAMYLFPKLDPVMYPIEDDQQFILDLLLEEKVLLVQGTGFNWKAPDHFRVVFLPNIDDLTEAMT

SEQ ID NO: 119736 - protein, 208 aa, Glycine max
  Coding DNA Sequence Number=SeqID_28051
  Homolog annotation: Hit_ID=Q84VH5; Match level="QueryCoverage=87%, HitCoverage=39%, E-value=4e-68, Identity=94%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATGKAAASGAVSKDDLIAELKDTCKVLEATIKANTKKKMELERLIKRLSDNGVDDGEAAEEEEDAAEDTESDDDDSDATP

SEQ ID NO: 119737 - protein, 123 aa, Glycine max
  Coding DNA Sequence Number=SeqID_28052
MGAKHLTRTKEWSHVIEQRLVIDYQRPPQSPSSLFKPGNRLHPLELACLGTSQVLTDRLCPGWVRIGQAWFWAIAPHLTSPRSPDPRDISPGTTLWSTNKSRKFHPSTLPHLKLVGLWGTHHM

SEQ ID NO: 119738 - protein, 58 aa, Glycine max
  Coding DNA Sequence Number=SeqID_28053
  Subcellular localization annotation: CTP_CleavageSite=25; ConfidenceScore=5.28e-01
MGVQIATRPTWAFQDVPPEGENPSRGASVTFPWVISRRFSTVLRRSSFVLHRSSVFNW

SEQ ID NO: 119739 - protein, 117 aa, Glycine max
  Coding DNA Sequence Number=SeqID_28054
  Pfam annotation: Domain name=G-patch; Domain location=55-99; Score =27.2; E_value=6.2e-05; Accession=PF01585.14; Description=G-patch domain
MDPLGGSRSLYTPPKIEVRSGGAFGHGIGGGRRLGKLPVLYAICGSRGGSCLSDTAMMVARVMLGYGYEPEMGLGKNNGGKTSLVSTRGNRRRFGVGYKPTQADIRKSIAEGKNKGQ

SEQ ID NO: 119740 - protein, 80 aa, Glycine max
  Coding DNA Sequence Number=SeqID_28055
  Subcellular localization annotation: CTP_CleavageSite=43; ConfidenceScore=5.03e-01
MHKQRLAINLWGSKLNGGGCMNENQFMRLRIRFVGGGCTNSARQSIRGAPDSMIRFVGGGCTNSARQSIRGALDSMVEDA

SEQ ID NO: 119741 - protein, 73 aa, Glycine max
  Coding DNA Sequence Number=SeqID_28056
MFRASSFSVSALPGNTRDLEGKSHILVPFIFRLIRFLLEVDKRVPGISTFGGLVIGSGVLKSKEVNMQMDENG

SEQ ID NO: 119742 - protein, 108 aa, Glycine max
  Coding DNA Sequence Number=SeqID_28057
MDKSEYVWQQTWQWMADDIIFNHRKQAQQLSSTSAIYGAGKFVWNNRYVYSPKWWNFCYPMHASLAVERLYFHLENQQHVYWTDDQQIGEVLSKNTIKESHVHSLDAF

SEQ ID NO: 119743 - protein, 147 aa, Glycine max
  Coding DNA Sequence Number=SeqID_28058
  Homolog annotation: Hit_ID=Q6WAY6; Match level="QueryCoverage=88%, HitCoverage=23%, E-value=2e-13, Identity=32%"; Hit description =Putative uncharacterized protein
MAEVSTEAIASLAQYYDQSLRCFTFGVFQLSLMVEEFEEILGCPLGGRKPYLFSGFYPSLARISKIVQISMQELDHRKQVQNGVDGVPRKYLEAKARILAGKGEWASFIDILALLIFRGVLFPNVDGLVDLAAIDTFLAFHDCKESP

SEQ ID NO: 119744 - protein, 161 aa, Glycine max
  Coding DNA Sequence Number=SeqID_28059
  Gene Ontology: Mol. function=glycerol dehydrogenase activity; Cellular component=mitochondrion; Biological process=glycerol metabolic process
  Homolog annotation: Hit_ID=P45511; Match level="QueryCoverage=100%, HitCoverage=44%, E-value=3e-76, Identity=88%"; Hit description =Glycerol dehydrogenase
  Pfam annotation: Domain name=Fe-ADH; Domain location=8-161; Score= -50.3; E_value=1.5e-12; Accession=PF00465.10; Description=Iron -containing alcohol dehydrogenase
MLKVIQSPAKYLQGPDAAMLFGEYAKNLADSFFVVADDFVMKLAGDKVLNGLHSHNISCHAERFNGECSHAEINRLIAILKQHGCRGVVGIGGGKTLDTAKAIGYYQKLPVVVIPTIASTDAPTSALSVIYTEAGEFEEYLIYPKNPDMVVMDTAIIAKAP

SEQ ID NO: 119745 - protein, 68 aa, Glycine max
  Coding DNA Sequence Number=SeqID_28060
  Subcellular localization annotation: CTP_CleavageSite=16; ConfidenceScore=5.15e-01
MVTRTFRQLGANKPVDAQRLTSSSAPFVIQGQQVRFYSRRPETFKPEDARDSSLLGGDDRVQWRREVS

SEQ ID NO: 119746 - protein, 59 aa, Glycine max
  Coding DNA Sequence Number=SeqID_28061
MDSRITKVEGDVTVVIIKKEEIVEASFMMMNQVDSSSFDDDKKPKRMISRLSQQVQDQD

SEQ ID NO: 119747 - protein, 77 aa, Glycine max
  Coding DNA Sequence Number=SeqID_28062
MGETHEIPHHNLADFKPCLRYATKGQAVGEECLKDIEGGEDYAFAKGVVPNTRTWSFPSSRCQTLTSTRGLLAPRTI

SEQ ID NO: 119748 - protein, 173 aa, Glycine max
  Coding DNA Sequence Number=SeqID_28063
RRFLPQQFHMLPSSVETRGFDRRREIVQAEDFSQQMEQRGHGMYYTPPTFPQYPSQMYQYPFEGHDTDMSASEHSYGGVAETHPHFSWPTMTHSQQHDAPMATPNAPLAPQWNVPGAIPDIGNLLGVDLRHEFSAEAEQQGRRQRARRNPDREARRWDRPCGTGSRHHGHHND

SEQ ID NO: 119749 - protein, 184 aa, Glycine max
  Coding DNA Sequence Number=SeqID_28064
  Gene Ontology: Mol. function=thiamin pyrophosphate binding; Biological process=response to stress
  Homolog annotation: Hit_ID=A5LGI7; Match level="QueryCoverage=41%, HitCoverage=41%, E-value=3e-17, Identity=61%"; Hit description =Pyruvate decarboxylase
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLRVNVLFKHIQDMLSGETAVIAETGDSWFNCQKLKLPKGCG

SEQ ID NO: 119750 - protein, 112 aa, Glycine max
  Coding DNA Sequence Number=SeqID_28065
MSSGPPPLDDKRRSGLEGRRRFVSACHRTRLCLNGEKCVGMTIICLRMSSGHRLWMTKAQNDHNLSLRTIRHDRLMAKRCGMTIICLRMSSGSPPLDDKRAHNDHNLSPRAI

SEQ ID NO: 119751 - protein, 218 aa, Glycine max
  Coding DNA Sequence Number=SeqID_28066
MTQELVARGDTLRLSAPRHLVTPSVIDEQRPMWSSAPFPEMSAVSDGDFSSLTSYPELRRSEFLIGGYVGARPIAFVGRPIIFVIPEAAADDTRDPIRLHPCHPEAAGPMIRGDTLRLSAPFCHPEAAGPMTSRDQVWSFCTLVSSRGGGPDDTRRYRDQVWSFCTLVSSRGGGPDDTRRYLTVIRTLLSSRGGEPDDKQRPSLVILHPCIIQRRRAR

SEQ ID NO: 119752 - protein, 89 aa, Glycine max
  Coding DNA Sequence Number=SeqID_28067
MGGFIHDIVDVKADGNYGYQSIAGLLERFEELRLSILIDGFSKVSVDKWMDITEMGYVIASRYNVYLKDRCPLSPLTLLWSRNCLPQAK

SEQ ID NO: 119753 - protein, 146 aa, Glycine max
  Coding DNA Sequence Number=SeqID_28068
MTLSKKRNAERNIKFLQDIKAAAIQEEPLSSEASSSFPKQRESHTVLIEANIMADEPRRVTLEDYSSTFVPQFFTSIVWLELIQNNLFHGLPNEYQYAYLVTYIEICNTVRIAGVPEDAVRLSLFPIFFVWRGKKMAPIRLKVNKS

SEQ ID NO: 119754 - protein, 95 aa, Glycine max
  Coding DNA Sequence Number=SeqID_28069
MYIHPSILLPHPQCKLPKDICGAITLTFFGNECMSQKNSKYVQTKMPHGLFPYKGHALMPLRHFTEHLVGARLGINSKRTGTVWHVPLLQNALYA

SEQ ID NO: 119755 - protein, 141 aa, Glycine max
  Coding DNA Sequence Number=SeqID_28070
MPGSRQARQGASAGFGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPYKVLNLYATLMQFSWQTTKIF

SEQ ID NO: 119756 - protein, 144 aa, Glycine max
  Coding DNA Sequence Number=SeqID_28071
MPTDTREIEAAWCIPGRGFILNAEGHLRKILRKYLTTLAQVWSVLSYSNLSPTSHTLDLTVDRARTRGVTSDSLIFECLSPVINLAYIRKNCWNPDDPTIIVRGARRPRVRPAETPSTSTAPHPVSTSAAPPPACIATTPSTPI

SEQ ID NO: 119757 - protein, 89 aa, Glycine max
  Coding DNA Sequence Number=SeqID_28072
ELNTADIDPLLHPLKDLLPVLIDGDRHEGQSFRLSEFPSTMPEMFSDALRSGVEKYGSDREVNLLCQGTKLSALSDTELDAAKVPTLAQ

SEQ ID NO: 119758 - protein, 274 aa, Glycine max
  Coding DNA Sequence Number=SeqID_28073
MPSPAAAAADAAGQHLQAIVAGAELHATGTAADGAAVDHAAVACTFEGDAPASGCADLAVVDDAAAPLQIQSVALCRGNAATGSIVDRHHGVGIDATGGAATDGAAGRDAALVVDGAAGRRGDVDRIGVAATQLCAALHVDGNAGGSGAKGDWRCIGVGRGRTTGDGLPGGGGGRIASRPGCRGGQGEQRRRRQDLDQGNGQTTPAEPGRDDMGHTALLGRGSGTADAMYGATHAATGHAFDVKSGSAHAPRISMNAFTIIGPPRASTHGVPMG

SEQ ID NO: 119759 - protein, 202 aa, Glycine max
  Coding DNA Sequence Number=SeqID_28074
MDLGGEFVEQRDLGDRVGGLHLLVQVADAMQHQGADQHRCEHAGDLVADAHQRDAACRSFNRAEDGDVGIDRRLQQGQPTADHEQPAQRAGVPALRREFTEECRAAGHHQQAQAEALLHAGQVEHHQHQEGADLAELEGQLDEGDQRAVEPGKEADQEEQHANDGDGGGHVRARACSGDGGHQEGSCGDGHRMRRRRVAGTT

SEQ ID NO: 119760 - protein, 178 aa, Glycine max
  Coding DNA Sequence Number=SeqID_28075
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTPASAKLACLQVDSRGSPDSLRSVVRLRRAVSAHSKAVIRLSTESGDNAGKNM

SEQ ID NO: 119761 - protein, 73 aa, Glycine max
  Coding DNA Sequence Number=SeqID_28076
MLLSSNVIHICARVVMLVRMIRIRLFATARVKSCPGMHSSWVIASLSGCAHIVGPPPGSGGGPGTDKRKLLAP

SEQ ID NO: 119762 - protein, 138 aa, Glycine max
  Coding DNA Sequence Number=SeqID_28077
MEEGQLCEHTREGGYHAATMHTGANFTRAAAKRRGSHPQDTQWSRKSPTGPWGFQLWLRASISPTGCPYPPGKGSRLQDTQWTRRSPTGSWSCQALITGLCQFYGVPVTSSKGIRPPTNRAFIKKYCVSRQAQGETPQ

SEQ ID NO: 119763 - protein, 97 aa, Glycine max
  Coding DNA Sequence Number=SeqID_28078
  Gene Ontology: Mol. function=nucleic acid binding; Biological process= DNA integration
  Homolog annotation: Hit_ID=A5C528; Match level="QueryCoverage=93%, HitCoverage=15%, E-value=3e-11, Identity=38%"; Hit description =Putative uncharacterized protein
MVLWRGKIDPLKQEKDYALEDDIKAEELEQSKEISKKMPKELPIEWRTQKDLSLDNIIGEISKGVSIRSRVKILCNNMAFVSQVEPRNINEALCDEH

SEQ ID NO: 119764 - protein, 255 aa, Glycine max
  Coding DNA Sequence Number=SeqID_28079
  Homolog annotation: Hit_ID=Q652R5; Match level="QueryCoverage=36%, HitCoverage=37%, E-value=7e-16, Identity=52%"; Hit description =Putative uncharacterized protein P0603C10.50
MLSLEPFTEDQGRSAVQPTGDPTNQLPCALRVYSPVDSHTCQTPWSVFQDGPNGEPTGRRQERAGAEHAKGARCHHNRDDDVSTSISQPGLGPPSQSASVNVPSRSADRLSPFHIRPGHIAGPHPLPSRQFQALFDSLFKVRFIFPSRYLFAIGLSPVFSLGRNLPPDWGCIPKQPDSPTAPRGATGSGHDGALTLSGAPFQGTWARSATEDASPDYNSDAEGDRFSWWAFPGRRALGLMASGATCVQRLDGSRD

SEQ ID NO: 119765 - protein, 59 aa, Glycine max
  Coding DNA Sequence Number=SeqID_28080
MAGPGRDQNHDVLDCITTVLETLVQERDAEPTEYRALMAFRTNHPPKFSGDYDPEGAKL

SEQ ID NO: 119766 - protein, 201 aa, Glycine max
  Coding DNA Sequence Number=SeqID_28081
NALGNGSFEHTLDLFAKIPTGESLPAYSRYCRMPTDIREIEAALCIPGRGFILNAEGHPGKILRKDLTTLAQVWSVPSYSNLAPTSHASDLTVDRARLIFGLVTQLDINVGALISGKIISMAQSNSSRLEFPAHITTLCRSRGVVSDSLAFELLSLVINLAYIRKNYWNPDDPTVIIRGARRPRARPVELPSTSAALLQHI

SEQ ID NO: 119767 - protein, 181 aa, Glycine max
  Coding DNA Sequence Number=SeqID_28082
  Gene Ontology: Mol. function=RNA-directed DNA polymerase activity; Biological process=RNA-dependent DNA replication
  Homolog annotation: Hit_ID=A5BZH4; Match level="QueryCoverage=59%, HitCoverage=17%, E-value=1e-09, Identity=36%"; Hit description =Putative uncharacterized protein
  Pfam annotation: Domain name=zf-CCHC; Domain location=72-89; Score =21.5; E_value=0.00084; Accession=PF00098.14; Description=Zinc knuckle
DNVEANLDWEIRVEQQLKRKSTSKSYGSHSYPKKDQGQGILGVTPCKPKDDKGKTIEKQSLKASMQEKTSSMKCFKCLGRGHITSQCPTKKTMIMRGQDIYSSQDEATTLPSSSEECKETLVSIATPLGLEFIPQVKELLDAGVPMNLKRIKVIPEWPTPPTPLIELVRNHVPSWEDAQEM

SEQ ID NO: 119768 - protein, 144 aa, Glycine max
  Coding DNA Sequence Number=SeqID_28083
  Homolog annotation: Hit_ID=A5BSR3; Match level="QueryCoverage=71%, HitCoverage=33%, E-value=3e-11, Identity=38%"; Hit description =Putative uncharacterized protein
MGPVLSDPQRSLDVWKKAQAIQKQNTAPHVLSRGGYDYLEQKLMVEKTKKKLEETAQSGSTEGVINPPSPIRRHVKWKMARTKKTRLMSSEVAKEITEKIDSLEEQASQGSFVPHGRQDVLTAAIGRPEHPGRVRAAGAGVTIK

SEQ ID NO: 119769 - protein, 110 aa, Glycine max
  Coding DNA Sequence Number=SeqID_28084
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTTASAKLACLQVDSRGSH

SEQ ID NO: 119770 - protein, 56 aa, Glycine max
  Coding DNA Sequence Number=SeqID_28085
MESHTSLKRVLRCGKHHPPCGMIESTPLWVLGSPRTKSILMSTQGADGMGKGVYSP

SEQ ID NO: 119771 - protein, 84 aa, Glycine max
  Coding DNA Sequence Number=SeqID_28086
  Subcellular localization annotation: CTP_CleavageSite=56; ConfidenceScore=5.07e-01
MAVSWELLGAPSNIAGAPNNYVNGLNCPSIKIRKKHAHPTVPPFRLYSSFFILCVPSSSVPTRLLLPFPFILGDLLVPLLRFRR

SEQ ID NO: 119772 - protein, 166 aa, Glycine max
  Coding DNA Sequence Number=SeqID_28087
MVVIVRPERVLRQFGYIQSIPPPPVSALLSYDDIDDMWMHFSDHVSADYMEWFFQISHSFMIPTQAGDQPRHAPTPDHGDYMQPDIPQVPVAFDPPRHAVDDYEGYEVIAERLERVLNLRMIIVGTKLHDIMQDCLRIARGVPAQMEVLGLDKDGAQSIDGVFYVL

SEQ ID NO: 119773 - protein, 236 aa, Glycine max
  Coding DNA Sequence Number=SeqID_28088
  Pfam annotation: Domain name=zf-CCHC; Domain location=89-106; Score =8.1; E_value=0.092; Accession=PF00098.14; Description=Zinc knuckle
ERKPQEANINLPYFHGKDNVEANLDWEIRVEQQLKRKSTSKSYGSHSYPKKDQGQGILGVTTSKPKDDKGKTIEKQPLKASMQEKTSSMKGFKCLGRGHITSQCPTKKTMIMRGQDIYSSQDEATTSPSSSESEEAKGKESIEEIYPQEEGQPLMVKEECKETLVCIATPLRLEFIPQVNELLDEGLVRKSLNDVSSIGACRPRIFFINGFLYILEDEWQRNGEGRERGDATSRRR

SEQ ID NO: 119774 - protein, 125 aa, Glycine max
  Coding DNA Sequence Number=SeqID_28089
  Homolog annotation: Hit_ID=UPI0000ECC274; Match level="QueryCoverage =52%, HitCoverage=96%, E-value=5e-22, Identity=69%"; Hit description =UPI0000ECC274 related cluster
  Subcellular localization annotation: CTP_CleavageSite=34; ConfidenceScore=5.23e-01
GKPVVPAALMNRPTRGEKAVCVLGALPLPRSLTRCARSFGCGERYQLTQRRSFAPSWAVCTNPPFSPTAAPYPVTIVLSPTRISRARYVGGATEFLKWWPNYGYTRRTVFGICALLKPVTFGKRV

SEQ ID NO: 119775 - protein, 233 aa, Glycine max
  Coding DNA Sequence Number=SeqID_28090
MTQEMVARGDTLRLSAPRHSVTPSVIDEQRPVWSFAPFPEMSASSGGDFFKSHKLSRTTSKSLAFVGCPTISVILTLRSCDMRRQNLRQNLVILHPLPSRGGGPDDMRRQNLVIPHPFAIQTQSCPMARRDKIWSFCTLLSSKGGGPDDMRRQNLVIPHPFSIQTQACPMARRDKMGSFCTLCHPEAAGPMTCGDQMWSFRTSWPFRHSRVRWHAETKCGHAAPFVIQRRQAR

SEQ ID NO: 119776 - protein, 52 aa, Glycine max
  Coding DNA Sequence Number=SeqID_28091
MSRNFTDCLTMGVKFLKVVKRGSHPTYRWSPDEIRAQNDHNLSLRAIGHDRA

SEQ ID NO: 119777 - protein, 357 aa, Glycine max
  Coding DNA Sequence Number=SeqID_28092
  Homolog annotation: Hit_ID=A5ASR8; Match level="QueryCoverage=76%, HitCoverage=58%, E-value=8e-12, Identity=23%"; Hit description =Putative uncharacterized protein
  Subcellular localization annotation: CTP_CleavageSite=41; ConfidenceScore=5.49e-01
MAEPSKKRKGSSSTAAAAAHRRHGPSEAPTTPIHPSLSSPRSSTSFSSDDQRLRYLSQFSSRIILDLKYLDVEFFNDETFDCYQVFQNSGLVDFMSLKLPNYPELVKVFYFNLKIQDGIISSEVHGIPMIIDQSLFFSLTHLPSQCAPFEGTIVDDWKFDYSSHDTRRMVCNDQAEMTGRLLAGSFTFDNRIMHYIIVRILLPRSSNLAQASEDDLILMWAFLTGRQIDWAHLVRYHMHMALRANAPLPYPQLITLFLRHFQIPLDDEPFVQVKRSFAIGAGVVTSFGYRMDRNGQWLKKDALPPQDEHTPSPPPRREDSALLNEVLTELRGLRPYVGEHFDSLDTRFASMDIRLTQ

SEQ ID NO: 119778 - protein, 138 aa, Glycine max
  Coding DNA Sequence Number=SeqID_28093
  Homolog annotation: Hit_ID=A5AZ88; Match level="QueryCoverage=39%, HitCoverage=5%, E-value=8e-08, Identity=48%"; Hit description =Putative uncharacterized protein
MTRSKRFVEVEDEDNVVHEKKIADKKSTDGKKNEVRGESNQEKEEQIMVKNKELKDQEKEKEIEKEKVKKKKKIIRMQRRVGLKKLWMKENIIVEGNCSAVIQKILPPKHTDPGSVTIPCSIGEVNVRKALIDLVAKY

SEQ ID NO: 119779 - protein, 32 aa, Glycine max
  Coding DNA Sequence Number=SeqID_28094
MESEEKLEESQGTTRDAAIAVKRDVTPHKGKG

SEQ ID NO: 119780 - protein, 39 aa, Glycine max
  Coding DNA Sequence Number=SeqID_28095
MEALREFKWLKAQVEKDEGPSGERHRPRVEKDEGPSGEG

SEQ ID NO: 119781 - protein, 204 aa, Glycine max
  Coding DNA Sequence Number=SeqID_28096
GRRRGGSREKSRKRGRAQGGRGEKTRKRGKAWGTKKKKKGKERHRRGKEGRKGARGGKSKTKPGGERRGRAEQDNQVEEGGRGEKRKNQGENRQKRGEEGQRGRGGRNKHGGKGRGRGTGEGEGQRAKARGSEDQNRGSEDNGGKARGTGERQGKTGAKPGGEGEARTTSGEARTREENAGGNRGGEKARGDGRGEIPGLDGAG

SEQ ID NO: 119782 - protein, 85 aa, Glycine max
  Coding DNA Sequence Number=SeqID_28097
MVKESEDDVPSSGEQLRRSQRGRQVPQTLKEYELYPDTVITAEGDFVHFALLAESEPMSHDEASQSSHWRTAMEEELKSIKKNQT

SEQ ID NO: 119783 - protein, 172 aa, Glycine max
  Coding DNA Sequence Number=SeqID_28098
  Homolog annotation: Hit_ID=A5B6K1; Match level="QueryCoverage=51%, HitCoverage=11%, E-value=2e-11, Identity=37%"; Hit description =Putative uncharacterized protein
  Subcellular localization annotation: CTP_CleavageSite=23; ConfidenceScore=5.38e-01
MSTLSRATIPKYVLNFFFLWGPSAFPVTGSTCTTGLSTPGGLVDNDHRREALRVRFMADVEADASEVGGGGGGGVEAGINASTISQTQADLKKSLQEQLWSAALAYESMLRQKSRVKWLREGDRNSSYFHRIINHRRRVNALQGLCIDGGWIHDPNSVKIAVLQHFKERFSK

SEQ ID NO: 119784 - protein, 141 aa, Glycine max
  Coding DNA Sequence Number=SeqID_28099
  Homolog annotation: Hit_ID=Q6L477; Match level="QueryCoverage=37%, HitCoverage=8%, E-value=6e-07, Identity=39%"; Hit description =Putative uncharacterized protein OSJNBa0009L15.8
  Subcellular localization annotation: CTP_CleavageSite=24; ConfidenceScore=5.48e-01
MGSSPASTPPPPPPPTSDASASTSAMKRTRKASLVHVDPVTGKADGPHRKKKLRTYLGIVARDKVDITYENWKKVPTTQKDLIWEDIRAEFDIPEASDNLTRKWALAANQDGVEDTVCDKYGISKEKWVQFYQTRRDPSWE

SEQ ID NO: 119785 - protein, 116 aa, Glycine max
  Coding DNA Sequence Number=SeqID_28100
MLKNGRESSRNYSRKRYGSASAWIFFTEIIFLSNFERGRSAKKAEPFFFFTPPLIYSKIGEELATQLAQASSAHPGEQGCFLQKQQPSGGRIWKAKWARLLFVPPFLLYAPPFYFF

SEQ ID NO: 119786 - protein, 140 aa, Glycine max
  Coding DNA Sequence Number=SeqID_28101
MEEKEKKQLEEAVKSRSTDTVIDPPSPIRRHMKLKMACTKKTGKMTFEATKQIANKIDSLEEQASEGSFVAHERQDALTSSIGRLEHPSRVCAAGVGVTIKQYFGPAPRTSRMSSSMALEVLEYLTQYTGTSWRSQSQKK

SEQ ID NO: 119787 - protein, 133 aa, Glycine max
  Coding DNA Sequence Number=SeqID_28102
MVRTRGLGRALGHVTGRGDRDDSDDAPQRQRHTASARRQRVPVTTAHDEPVLPTPDVEADVVPDDPMAPADVEDTGTDIPADIGTQAAEDEHEGFSGGPSDPSVLTQYADHVACGVWTREERPELKLSSHGRK

SEQ ID NO: 119788 - protein, 98 aa, Glycine max
  Coding DNA Sequence Number=SeqID_28103
RLCETETNMLAIVSEYQEELNLATAHEHKVADEYARVYAEKEARGRVIDALHQEAKMWMNRFALTLNGSQELPRLLAKAKAMEDIYSAPEEIHGLLSY

SEQ ID NO: 119789 - protein, 181 aa, Glycine max
  Coding DNA Sequence Number=SeqID_28104
  Homolog annotation: Hit_ID=Q2HW90; Match level="QueryCoverage=38%, HitCoverage=13%, E-value=5e-07, Identity=44%"; Hit description =Putative uncharacterized protein
YLEGKARDMANQEEWVPFADILALLIFGVVLFPNVDGLVDLAAIDAFLAYHHSKESPVVAMLVDLFDTFDRRCEKNSARIVCCLPALSVWLGSTDVREPLAIPCERFRCAMSQDCTKSPQGVGKPDEVVQAQKSELGKARLAKEKFKSAATSIRKECAELRQENATTAKALEQETKRARKE

SEQ ID NO: 119790 - protein, 82 aa, Glycine max
  Coding DNA Sequence Number=SeqID_28105
  Homolog annotation: Hit_ID=A5BKB8; Match level="QueryCoverage=89%, HitCoverage=25%, E-value=6e-29, Identity=75%"; Hit description =Putative uncharacterized protein
MGGGAWPFLVGGAICLIIAIVGLQRGIPSKRESSARVDYVPALCTHRPSLLPIEWSGEVFGLRRRERFAARDVVRSPLNLII

SEQ ID NO: 119791 - protein, 72 aa, Glycine max
  Coding DNA Sequence Number=SeqID_28106
MAEIKEVQEQMKANTEALKDQMASMMEAMLRLKRMMESNSVVVAATSAAAKADPTHPFAINQVNQLIPYMMD

SEQ ID NO: 119792 - protein, 183 aa, Glycine max
  Coding DNA Sequence Number=SeqID_28107
MDARGALSGMSSCSACMYNSSFFHILPRAQSQECFGDPNSRMLQSVQKAWNAVQRKDKKLRGSSNGIIGGYHMWLKAQTQEITWFPKLGVSSEEETEVPEESEEVQALKVELERTQVVKEKFKTAAIRVRKECDELRDVNTTTATTLERETKRARKEEWGRNKFRGALWGSNSELKLQRAKRD

SEQ ID NO: 119793 - protein, 33 aa, Glycine max
  Coding DNA Sequence Number=SeqID_28108
MAYGRYLTARVAFGRGPSMSIPHMAKGQGDHKL

SEQ ID NO: 119794 - protein, 158 aa, Glycine max
  Coding DNA Sequence Number=SeqID_28109
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSDLAIRPGNWRKPRK

SEQ ID NO: 119795 - protein, 304 aa, Glycine max
  Coding DNA Sequence Number=SeqID_28110
  Gene Ontology: Mol. function=motor activity; Cellular component=cell projection
  Homolog annotation: Hit_ID=UPI00006A2D9E; Match level="QueryCoverage =57%, HitCoverage=85%, E-value=4e-16, Identity=16%"; Hit description =UPI00006A2D9E related cluster
LKAVAFRGLHALAIKGLHALAFRGLHVLAIRGLHVLIFRGLHVLTFRGLHVLAFRGLHALAFRGLHVLAIRGLHALTFRGLHILTFEGLHVLAFRGLHVLAFRGLHALTFRGLHILSFRGLHTLAFKGLHVLTFRGLHALAFRGLHALAFIGRHVLDFRGLHALTFRGLCVLTFIVSLYQFLGHPTDLGGGSTVQAQPEREAIVQLLCILGQDFVLTVGPGVSSSGYGPLSILQGIAPARYPVDPEKSNRVLGFPALITSLYQFYGVPVPPSKVIKPPTNRAFIKEYCTPRQAQGETLQQPGDG

SEQ ID NO: 119796 - protein, 121 aa, Glycine max
  Coding DNA Sequence Number=SeqID_28111
  Subcellular localization annotation: CTP_CleavageSite=41; ConfidenceScore=5.02e-01
MNCIFVHASSIFEFGAMRSDCLVQLSILNLFRSPMNCVFVQASSTHEFGAMRSDCLLQFSILNPFSEPMNCVFIHASSTHEFGTMLSDCLVQFSILNPFSNPHELRFRSCLLHPRVWSHAL

SEQ ID NO: 119797 - protein, 193 aa, Glycine max
  Coding DNA Sequence Number=SeqID_28112
MAPEELEQLTQQIRDQLEESITEKVTRQLMLSFSQMQSQLQSQIQSQGLALPLEPEVGPSAACVSTKGSCVDRSPTDLDMGDSDKFGLYIEENPSCLVALGRVYEGSTVVHNIPLLHGQVKVGAEEVKDAEALVPVPTDKVILVGQTINTFLAWPTHLVKRLSEQAAVSLAKPPDRPDHEVEDPLYLMTLTIP

SEQ ID NO: 119798 - protein, 106 aa, Glycine max
  Coding DNA Sequence Number=SeqID_28113
MTDLVSAEDDTAKKNVYTDNHSGISARQRDSNVSMTDLVSAEDDTSKKNVYTDNHSGISARQRDSNVSMTDLTSKKNVCTDNHSGISARQRDSNVSMTELVSADDD

SEQ ID NO: 119799 - protein, 191 aa, Glycine max
  Coding DNA Sequence Number=SeqID_28114
  Subcellular localization annotation: CTP_CleavageSite=25; ConfidenceScore=5.38e-01
MVMGDSSADSLSPVNALFFTPKSICCSKSVEYLSLAKACLRFSGENTETFSSLTSYPELRRSEFLIGGYVGARASLLSTTPPFVAMTQELVARGDTLWLFAPFCHPEAAGPVTSRDQVWSFCTHDTRRYLTVIRTPLPFRHSRVRWHAETKFGHSAPMIRGDTLRLSAPLCHSDTVVSDGMQRPSLVILHP

SEQ ID NO: 119800 - protein, 508 aa, Glycine max
  Coding DNA Sequence Number=SeqID_28115
VFAGFAHQQAVNQAADHRITGAHGADHLTGRRFGDPGTGGVNPQRAFRAEGDHHVGDALLAQRMRGLDHVRQRRQRAAGPDLQLAAVRLHQPRRGLQPSDQRFAAAVENDARTLGAQLGHPVGKGIGIDAGRQAAAHRHHVKLAQPAQRVADEAIPVLRRHFKTGEIEIGDFAVFFRQLDVDAGAARHYLEAVGDPQIAEQQLETVLIVFAQEAADGDVDAQILQHLGDVDALTGGVQAGGFYPVDFPAFDLRAKPHQIVMPFFHAQRHHLHQAAPVGRLAAAVQVGDGDVTVETFDHVDQRRARPCVQAVLVADHELGAQYAALLGHFAGQQRQHPGGIRLQQAFSFVGQQQVAERHRLAVFHESLRRAADGGRAGQVAFNAVAQPDALPQVQRLAGNGIADELRVDRAGLLQPAGVQRLQRHQAVGRDVERNQRNVELEFGALLLAHQQAAQLFRGGGFRQPLRHAVIAQHVSKLAQQRQMLVGTGGDADRHIGGLAFAPGDALRN

SEQ ID NO: 119801 - protein, 25 aa, Glycine max
  Coding DNA Sequence Number=SeqID_28116
MAPPKESAAIIYHNGHIVDDPVQGS

SEQ ID NO: 119802 - protein, 76 aa, Glycine max
  Coding DNA Sequence Number=SeqID_28117
MGKLEDASEDRGSSSGVVAGFKSCKNFLILYALRLLQVALISKLMGIKSHAVDLLCIQEKQNNNYPVQKNNKMCNN

SEQ ID NO: 119803 - protein, 103 aa, Glycine max
  Coding DNA Sequence Number=SeqID_28118
  Subcellular localization annotation: CTP_CleavageSite=43; ConfidenceScore=5.00e-01
MHIRQQTHRHHLGRPIQVGHWAWSVIYSIWLASKRPTTMGRCRYMSVSTGSASVSRGRVAWPGDWPDALAGEEPAGSPGEADESRMEEDMTNLLGFLGGSGAV

SEQ ID NO: 119804 - protein, 92 aa, Glycine max
  Coding DNA Sequence Number=SeqID_28119
MVASGGSNLARLGKLGGKLLPYFAINSGRSEEGKGSAFLTLHIHLKLLRKIVYVKKIQAEALPNVSVGDFAKIFSRSSSFIVCSSLFFDLQP

SEQ ID NO: 119805 - protein, 79 aa, Glycine max
  Coding DNA Sequence Number=SeqID_28120
MLQCEGFCSNLRYYFEIPKGENVRNWVENVVLKFHDDPTVNESKIFIFLRQVWWSMGKRKGFERRRGKTKMRPKKRHLT

SEQ ID NO: 119806 - protein, 166 aa, Glycine max
  Coding DNA Sequence Number=SeqID_28121
  Homolog annotation: Hit_ID=UPI0000ECBAF8; Match level="QueryCoverage =21%, HitCoverage=42%, E-value=2e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMHASLALAVVYNVVTGKTLALPNLIALQHIPLSPAGVIAKRPAPIALPNSCAA

SEQ ID NO: 119807 - protein, 182 aa, Glycine max
  Coding DNA Sequence Number=SeqID_28122
  Gene Ontology: Mol. function=structural constituent of ribosome; Cellular component=ribonucleoprotein complex; Biological process =translation
  Homolog annotation: Hit_ID=Q2PMT2; Match level="QueryCoverage=100%, HitCoverage=87%, E-value=6e-86, Identity=80%"; Hit description =Chloroplast 30S ribosomal protein S2
  Pfam annotation: Domain name=Ribosomal_S2; Domain location=1-175; Score=298.3; E_value=1.5e-86; Accession=PF00318.11; Description =Ribosomal protein S2
MSPYISAKRKASEGKQFLIVGTKKKAADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 119808 - protein, 250 aa, Glycine max
  Coding DNA Sequence Number=SeqID_28123
  Homolog annotation: Hit_ID=Q6WAY6; Match level="QueryCoverage=50%, HitCoverage=21%, E-value=6e-09, Identity=29%"; Hit description =Putative uncharacterized protein
MVPTIEEFEEILGCPLGGRKPYLFSDFLPSLSKIAVVIGDSAKELDRMKQTRNGIVGLARKYLESKARDMASQEKWGPFADILALLIFGVALFPNVDGLVDLAAIDAFLAYHHSKESPVVAILADLFDTFPPRGVKKIVHGLSVVYPLSVYGRFHTYSNKTRDTRVRFKVIAHAPKRKSRLGPTFGWDRGQRSIGFLVGRKARKEFFSRGSVNRRKSLAFPCEGSRRVSYPNFVRGPLLDDMRPFFGPCE

SEQ ID NO: 119809 - protein, 112 aa, Glycine max
  Coding DNA Sequence Number=SeqID_28124
MSLHSSSSVNGEGSTPKDPLYKILDELRSLKLWKVKQERKEKAKREKFHWLPLAFKGMPSIGGLPLLGNEGFMGILQQSIGMILRVPLGRGAFPPTMKGSLWTSSKGLDKGV

SEQ ID NO: 119810 - protein, 83 aa, Glycine max
  Coding DNA Sequence Number=SeqID_28125
MGKAEEVQEKVKADMEAMMSMKKIMEANAVTIAATSTVAKVNPMPPSGLNQMNHPTLDIVGKDLGSRDDPHNVQNQNKHAFPP

SEQ ID NO: 119811 - protein, 103 aa, Glycine max
  Coding DNA Sequence Number=SeqID_28126
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=87%, HitCoverage=8%, E-value=1e-41, Identity=96%"; Hit description=DNA -directed RNA polymerase subunit beta
MPYLQDPIPSILTIAWEQVHLRSIFPFQYFSIGASLIPFIEHNDANRALMSSNMQRQAVPLSQSEKCIVGTGLERQVALDSGVSAIATRGNIIYTNTDRIFFI

SEQ ID NO: 119812 - protein, 70 aa, Glycine max
  Coding DNA Sequence Number=SeqID_28127
MPHPIRALCLDILQHKGDQSGSQCFARMLQPYGINIGLKEHSNRVTPKAYTPKSMSGPLTPDSGPTQKTF

SEQ ID NO: 119813 - protein, 119 aa, Glycine max
  Coding DNA Sequence Number=SeqID_28128
  Homolog annotation: Hit_ID=UPI0000ECBAF8; Match level="QueryCoverage =34%, HitCoverage=48%, E-value=1e-16, Identity=100%"; Hit description= UPI0000ECBAF8 related cluster
  Subcellular localization annotation: CTP_CleavageSite=51; ConfidenceScore=5.16e-01
SLSGFATSDLSVDFCDARQGAGAYGKTPATRPFYADTARRSRTTERSESVSEEAEERPIRKPPLPARMQAWHWPSFYNVVTGKTLALPNLIALQHIPLSPAGVIAKRPAPIALPNSCAA

SEQ ID NO: 119814 - protein, 83 aa, Glycine max
  Coding DNA Sequence Number=SeqID_28129
MLRLNGPKWLCWKPDPIVSGDVMAHIQEKKLKLMRIKRGLSGMKETNLTNTTTLMQQPLAQVDGVQASVTLDNEDGREGIRWS

SEQ ID NO: 119815 - protein, 61 aa, Glycine max
  Coding DNA Sequence Number=SeqID_28130
MAHQRREGLWVRLPREEGTRSRHQRLFEENVGKTEMCGLRTLSVKGSGIVFTHGEGCFPRS

SEQ ID NO: 119816 - protein, 101 aa, Glycine max
  Coding DNA Sequence Number=SeqID_28131
MFSWFWIVHDVWMLWKLGGIDGDPVLRGTRIRATWEYVSSVEGGQLGMVDLCVICGCGESTCTIAQSLPSTTYDGVVPGDMSRGSGDLGDVRWGAFAQNQA

SEQ ID NO: 119817 - protein, 154 aa, Glycine max
  Coding DNA Sequence Number=SeqID_28132
MAEVSMEAIASLAQYYDQPLRCFTFGDFQLTPVVEEFEEILGCPMGGRKSKDAITKCAPRHPYCTRCKSRTMGDLEEVQEQMKADMSALKEQMGSMMDAMLGMKQQMESNAATAAAISSVAEAYPTLPTVAHHPIPNMVGRERSTPGHISNPRL

SEQ ID NO: 119818 - protein, 158 aa, Glycine max
  Coding DNA Sequence Number=SeqID_28133
  Homolog annotation: Hit_ID=Q2A9Z4; Match level="QueryCoverage=53%, HitCoverage=14%, E-value=8e-08, Identity=38%"; Hit description=Zinc knuckle family protein
MTIEESIHVSFDESNAILPRKDFLDDISDSLEDIHIHGNDSKEKDEGSNEDSQDNGVRANNELPREWKASRDHPLDNIIGDISKGKAVASGGSNPARLGELGGNHLPYFAINRGGRQEGRAEALPKRFRNVFREEFRKGFNRSSTFFIRSSSFFDLQR

SEQ ID NO: 119819 - protein, 185 aa, Glycine max
  Coding DNA Sequence Number=SeqID_28134
MRGAPTEESLSPFLVMDLGVQSLKVIQRVHKAWRSLLRKDKELRGIRNGVIGVIDEENFEAPEEDEEVQALKLELGKARLAKEKFKSAATHIRKECTELREENATTARALEQETKRARKEEHGREKFRGALWGSNNELKLRREERDRSQVHDMILKEELAACARSKRSLAQHLEATEQSMRAIIG

SEQ ID NO: 119820 - protein, 112 aa, Glycine max
  Coding DNA Sequence Number=SeqID_28135
  Homolog annotation: Hit_ID=A0ST23; Match level="QueryCoverage=28%, HitCoverage=65%, E-value=1e-11, Identity=100%"; Hit description =Putative reverse transcriptase
MTVKTSDTCSSRRRSQLVCKRMPGADKPVRARQRMRKEKIPHHAPFAIQAAQLLGRAIGAGLFAITPAGERGMCCKAIKLVGKPVVPAALMNRPTRGERRFAYWALFRFLAH

SEQ ID NO: 119821 - protein, 85 aa, Glycine max
  Coding DNA Sequence Number=SeqID_28136
MSPHGGDMDGGEKRKERDGVSLAFGIAGPGGRPARRAISSVVERAPDNCVVVPGLFRFGLNGKNGAPNNVSSQTKNYEIAPFILG

SEQ ID NO: 119822 - protein, 102 aa, Glycine max
  Coding DNA Sequence Number=SeqID_28137
  Subcellular localization annotation: CTP_CleavageSite=73; ConfidenceScore=5.40e-01
SSSLLPLHSRANLRLARGNLCTPPLPFGRPTPHRNCLPETVPRPVGPGTKLRPPFTGASVVGSPVISRPGLVTATPFVRRHPFSRSYGAILPSSLERVVSRL

SEQ ID NO: 119823 - protein, 142 aa, Glycine max
  Coding DNA Sequence Number=SeqID_28138
MTVTALGALCTSSASKPSRDGRFSGKRRVQLRDDEYTDFQEEIGRRRWAPLVTPMAKFDPEIVLEFYANAWPIEEGVRDMRSWVKGSVDPVRCRRYQPAPGISDGFCPDCCRKTGADHAHQHDHPDSDMDDSAAQQHPAHRS

SEQ ID NO: 119824 - protein, 143 aa, Glycine max
  Coding DNA Sequence Number=SeqID_28139
  Homolog annotation: Hit_ID=B0I112; Match level="QueryCoverage=38%, HitCoverage=100%, E-value=7e-11, Identity=63%"; Hit description =Putative uncharacterized protein
SEQESARGSFQGETPGIFIVLSGFATSDLSVDFCDARQGAGAYGKTPATRPFYGSWPFAGLLLTWFFPALSPDSVDNRITAFEKRKSAQYANRLSPRVGRFINAAGTTGFPTGKRAVSATQLIYDHDYEFELGTLWNRVEFFV

SEQ ID NO: 119825 - protein, 131 aa, Glycine max
  Coding DNA Sequence Number=SeqID_28140
MIMRGQDIYSSQDKATTSPSSSENEEAKGEESSEEIYPQEEGQSLVVKEKCKEVSVSSKRLAKMETHFTIKTNIKENFPLRQPPHLLLCKKTLVSTATPLRLEVIPQVKELLDEGLVHKSLNPCAFLVPKI

SEQ ID NO: 119826 - protein, 122 aa, Glycine max
  Coding DNA Sequence Number=SeqID_28141
MGNVEEAQEQMKADMEAVKERMATMMDALMSMKKIMEANAVTVAATSAVAKVNPMPPSGLNQMNHPTSAMVGKDLGSTGGPHYAQIQNMHAFSPYGSTPKEDVNNSDPILIESRQPHHAHVS

SEQ ID NO: 119827 - protein, 211 aa, Glycine max
  Coding DNA Sequence Number=SeqID_28142
ENAATARALEQETKRARKEEHGRDKFRGALWGSNNELKLRREERDQSRVHGMILKEELVACSRSKRSLAQHLEAMERSMLAIIGQYKEELNQSLTHEQKLVEDFAQAYAEKEARGRVIDALHQEATMWMDRYSPQAYPYGLTLDFTPHTAPDDLSQAPTFEGQIPPYADYRLQEDDEGDAHLGPLLPLKDPGPHELPQANIVHHVPSLPVT

SEQ ID NO: 119828 - protein, 274 aa, Glycine max
  Coding DNA Sequence Number=SeqID_28143
  Gene Ontology: Cellular component=integral to membrane
  Homolog annotation: Hit_ID=A8GGI8; Match level="QueryCoverage=100%, HitCoverage=89%, E-value=2e-93, Identity=61%"; Hit description =Putative uncharacterized protein
  Pfam annotation: Domain name=UPF0187; Domain location=1-274; Score =353.3; E_value=4e-103; Accession=PF05249.2; Description =Uncharacterised protein family (UPF0187)
MIVRPHQHWFLRLFDWHGSVLSRIAFRLSLNLLMSVIAILGYPWYSTLGIHLTTAPFSLIGVSIAIFLGFRNNASYARFIEARTLWGNMHITQRSLLRQVKTLRGLRAEQVQEFIGLQLAFSWSLKHRLRKTDAQPDLQRLLPPAWHAAVLGHPMPTSQIMLCMGEWLAQRRDEGLVTDIVWQSIDDNLNHLSAYLGGCDRLASTPIPFAYSLILHRTVYLFCTLLPFALVADLHLMTPLVSVFISYTFLSLESLAEELEDPFGTAPNHLPLDA

SEQ ID NO: 119829 - protein, 67 aa, Glycine max
  Coding DNA Sequence Number=SeqID_28144
MLVRMIHTRLFAAARVKSCPGMHSRCVIVSLSGCARIVWIWSTLKMRTRSPLKARACSPLMARTYSL

SEQ ID NO: 119830 - protein, 298 aa, Glycine max
  Coding DNA Sequence Number=SeqID_28145
  Subcellular localization annotation: CTP_CleavageSite=16; ConfidenceScore=5.36e-01
TATAARCRGLPGCPARANPPSPARWSRRCTGSASAPICWTAITSAREHSPSGGSGQTDGGCRAGGADRVHFAAPRRAADGARDARRRSLYRSVPPTRRWRSARRAIRRDCIKKRAPASCAISPASTRRVAWSGYYQTLNSKKACGVFRHALFTLSRRRASRITRDHYAKCHAYLDRLQAVKTGERGAFLFFPGRRQRLCFLLAGVRVAVPGLRFQHAVFPALYLAVLPGADAAVGADRHHPQHAVARSSDFDAAADRRHRAVPVLAGVQLPDRVVRERAPMAGARRIAKRCRRLQNFA

SEQ ID NO: 119831 - protein, 156 aa, Glycine max
  Coding DNA Sequence Number=SeqID_28146
MLCGTSRGYIYLGLTENKRGYISCGSVLVEGTSTRVSKRTREGHSIQQGGADDHDWSLRVNRLTCLWLTKARITMRCLHVPSDLPSLDDEGADNHEGGADDHDWSLRSNRLACLWLMKARITMRCLHVPSDLPSLDDEGADNHEVSPCVIGLAVSK

SEQ ID NO: 119832 - protein, 206 aa, Glycine max
  Coding DNA Sequence Number=SeqID_28147
MDMNLGYLISHQISIIAQHDSSRLVFPALITTLCKARGVSSDSRSLESLSPAINLAYIKKNCWNLDDPTVTFRGPRKARGKRSEAPPTSAAPNASALSSSTLPDPSVPSTSTPQLPQFPVQLLASSAPASYFLFTPEMLHSMMQSLHRGQVILMQRFQSLGMPSIMPMEDFHAQVPWPGVQPSPFRGGGACAAQEPDSAEPVEEHT

SEQ ID NO: 119833 - protein, 45 aa, Glycine max
  Coding DNA Sequence Number=SeqID_28148
MKVGVGQERRPSRSKKEASPDDADRTYPNRHHPTVIQGLNRINNG

SEQ ID NO: 119834 - protein, 86 aa, Glycine max
  Coding DNA Sequence Number=SeqID_28149
MAYSLVDDTSSHLFSFVFRCISMVESGGVKDLIEAQRSSLHRSPTSKLPSSGNQSTRASKFPPIKLAIEARFDFLWFKFLVLVLEP

SEQ ID NO: 119835 - protein, 143 aa, Glycine max
  Coding DNA Sequence Number=SeqID_28150
MPGADKPVRARQRVFGGYRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSHHCMPWILKPATQAIMQKWDYSGK

SEQ ID NO: 119836 - protein, 166 aa, Glycine max
  Coding DNA Sequence Number=SeqID_28151
MATSDIAILRDRAHIPTKKSLLELTSQDALLAHNKLQDVQSMGEHMTLDVVSLVKNQLFMKSTTWGISPEILDQGGPSNRPQQQVPSPYERTIKLEETLAQFMQVSMSNQKSMESSIKNLEVQVGQLAKQLADRSSGSFTRNIEKNSKEECKAVMARSRMEIQVDD

SEQ ID NO: 119837 - protein, 267 aa, Glycine max
  Coding DNA Sequence Number=SeqID_28152
  Gene Ontology: Mol. function=hydrolase activity, acting on carbon -nitrogen (but not peptide) bonds; Biological process=carbohydrate metabolic process
  Homolog annotation: Hit_ID=A8U6Z4; Match level="QueryCoverage=76%, HitCoverage=93%, E-value=3e-16, Identity=28%"; Hit description =Putative uncharacterized protein
  Pfam annotation: Domain name=Polysacc_deac_1; Domain location=112 -231; Score=27.8; E_value=5.4e-06; Accession=PF01522.12; Description =Polysaccharide deacetylase
GKVFAGWYPTAADADALRIEARVNGADAVVCTDQQLELFAAWKTAEQNAADAVRVPILMYHQFTSKPDGESGWLRGNYAYIGDFDAHMNHIATTGFYLPTWDELSAFIDGRLSLPARSVVITDDDADQTWFDLAVPVIAKHRLLATSFMVTAYRSDPPPSIYVLRRSHTHDMHQAGDNGKGRMVNWTAEQIASDLARSGDVLGVREVIAYPFGHVNDTAKQGVAQAGYEMARTIEPGYVQIGTDKLALPVVRIDYGMGLDALVSRIG

SEQ ID NO: 119838 - protein, 118 aa, Glycine max
  Coding DNA Sequence Number=SeqID_28153
  Gene Ontology: Mol. function=protein kinase C binding; Cellular component=cell projection
  Homolog annotation: Hit_ID=Q9JKS4-3; Match level="QueryCoverage=81%, HitCoverage=11%, E-value=1e-08, Identity=36%"; Hit description =Isoform 3 of Q9JKS4
VLVPSPSEGYTPSPSVDCTPSPSEDYTSSHSEDYTSSPLEDYTSSPSKCYMPSPLGGYRPSPSEYYTSSPSEGWTPSPSEDYTSLGAEGYAPSPSEDYMSSPSEDCMSSSSEDYMSSP

SEQ ID NO: 119839 - protein, 42 aa, Glycine max
  Coding DNA Sequence Number=SeqID_28154
VVGNATIEKPREEWNDDERRIEKSDKRNLKEKKEKKGYIKCE

SEQ ID NO: 119840 - protein, 122 aa, Glycine max
  Coding DNA Sequence Number=SeqID_28155
YCTQRQVQGDAPQAADVPPPHQAGRDGSFDTEQYLRHLVRQQAANHRAHVQTHDCLYQLSLSLQSQGFTSFPCPTPDQFRAVVAWPGDWPEAPAVAPDEADEAREDEEMTDLLDFLGGSGAT

SEQ ID NO: 119841 - protein, 160 aa, Glycine max
  Coding DNA Sequence Number=SeqID_28156
MATMMEAMMSMKKIMEANAVAIAATSIVAKVNPTPPSGINQMNHPTSDMHAFPPYGLPLNYTPPNVAYTPNKNVNNSTPILIKSQQPQSDHAHVSRPMEETHEIPHHDLADFEPWLGYATEGQAVGGIPFENTLEGPQFRPQPQPLHFAVGRAPPAMAEK

SEQ ID NO: 119842 - protein, 81 aa, Glycine max
  Coding DNA Sequence Number=SeqID_28157
MEDLIPEHNEELGECIQHLDSSKEVLENKIEDPGTLIKEKPILELKPLHPHLKYVFLKGEDEKLAIISSTLHKEEEKRLTK

SEQ ID NO: 119843 - protein, 124 aa, Glycine max
  Coding DNA Sequence Number=SeqID_28158
MVGYTPSSFTDLVFASEKIEVGLKRGKFNHLALMNEKTGANEEGENEGETHVATAIPTWPNFPPIPQCHYSANNNPSPYPPPSYPQRSSLNQQQNPPTTQPMLNTTFITSQNTNQEMNFAAKSL

SEQ ID NO: 119844 - protein, 92 aa, Glycine max
  Coding DNA Sequence Number=SeqID_28159
  Gene Ontology: Mol. function=hydrolase activity, hydrolyzing O -glycosyl compounds; Cellular component=cytoplasm; Biological process= carbohydrate metabolic process
  Homolog annotation: Hit_ID=A6TDI8; Match level="QueryCoverage=77%, HitCoverage=14%, E-value=3e-13, Identity=57%"; Hit description =Putative glycoside hydrolase, family 32
MGLRKQHCGTLRHSSWCRATRLCRCTDAAPGAGATLSEVWPVWHTSSVEVFVNEGEACLSSRIYPDEDCRDLALFAWTGGASLIHGGAWQLE

SEQ ID NO: 119845 - protein, 185 aa, Glycine max
  Coding DNA Sequence Number=SeqID_28160
MVKEECKEVSVSSKRLAKKESHFAIKTNVKETSPLRQPPHLLHCKKTLVSTSTPLGLKIIPQVKELLDDGLVHKSLNPCALVPKIGIMRHQIPMIGGLMNVLNGATLFCKITHASNIFMIHISRDSLGSDQWVPTDPKRIKVIPEWPTPPSVKGRSPEFQEPLDLRSNPFQGGGDDAILPLKGIG

SEQ ID NO: 119846 - protein, 258 aa, Glycine max
  Coding DNA Sequence Number=SeqID_28161
  Homolog annotation: Hit_ID=Q84VH5; Match level="QueryCoverage=87%, HitCoverage=39%, E-value=1e-102, Identity=75%"; Hit description =Envelope-like protein
MDLIKAAGLLKTVTKLGDCYESLVREFIVNIPSDITNRKGDDYQKVFVRGKPTEGVVDLAVSEHQIAKEITAKQVQHWPKKGKLSAGKLSVKYAILHRIGAANWVPTNHTSTVATESFAVKLPIAFPTVLCGIMLSQHPNILNYTDSVMKRESPLSLHYKLFEGTHVPDIVSTSGKAAASGAVSKDALIAELKDTCKVLEATIKATTEKKMELERLIERLTESGIDDGEAAEEEEEAAEEEEDAAEDTESDDDSDATP

SEQ ID NO: 119847 - protein, 76 aa, Glycine max
  Coding DNA Sequence Number=SeqID_28162
MAAEWRRKRERRCHFKEKMSLEEAHHHRRPWIRAWRKKEMNEERGREEHEILCSKRALKFEPTNPRSSPRFSTKCA

SEQ ID NO: 119848 - protein, 118 aa, Glycine max
  Coding DNA Sequence Number=SeqID_28163
MSEIRRFGGLGMEERRKRKGAAQGCLENVIFIEQDAWRRQPTGNRLHEYCNRLQAICSGVIDYSIHVYDQEGYHSQIIVASSIKSVHNNCRQKYIPLQQWTKQHFFVSYYAMRQERIQ

SEQ ID NO: 119849 - protein, 158 aa, Glycine max
  Coding DNA Sequence Number=SeqID_28164
MAASDHAILYDRTHTHQEKHVGTLFTRCIAVVFMEELMNPVVVYPKMMLLKSYRQGGSFNQNQGQGWRSHPRNQFNKDQGGPSNKPPNQGPNLYERTTKLEETLAQFMQVSMSNHKSTESAIKNLEIQVGQLAKQIAGNCSGGFGANTEKNPKEECKA

SEQ ID NO: 119850 - protein, 374 aa, Glycine max
  Coding DNA Sequence Number=SeqID_28165
  Gene Ontology: Mol. function=hydrolase activity, hydrolyzing O -glycosyl compounds; Biological process=carbohydrate metabolic process
  Homolog annotation: Hit_ID=Q2HTU0; Match level="QueryCoverage=94%, HitCoverage=71%, E-value=2e-98, Identity=45%"; Hit description =Glycoside hydrolase, family 5; Ricin B-related lectin
  Pfam annotation: Domain name=Cellulase; Domain location=51-346; Score= -46.3; E_value=0.00061; Accession=PF00150.9; Description=Cellulase (glycosyl hydrolase family 5)
MLLGKPSQLLFLLLLVFIFEIASHSNAYPLSTHKRWIIDEATGQRAKLVCGNWAGHLKPMIPEGLDRRPLKDIVSELVEHKFSCVRLTYAIYMWTRYGNGNVNATFDSLDAPEVVEGIAKNNPSVLSMTHVEVFDAVVHELGAQNVKVLLDNHVSYPKWHFNPQEWVHGLTLAAEHFSGNHAVVAMSLRNELHGPRQNLRDWYRYMNQGALAIHKANPNVLVVISGLNYDTELQFLKSKPLKIGLGKKMVFETHLYSWSGIGTLKLKQIWTKQPLNRICANSIKGIDHRAGFLTAGKNASPLIFTEFGFDETGSSVEDNRFLTCLQTYLVGRDLDWGLGAFQGSYYTWHHLSNPNFTDKFQLLQRKNQVIISSY

SEQ ID NO: 119851 - protein, 379 aa, Glycine max
  Coding DNA Sequence Number=SeqID_28166
  Gene Ontology: Mol. function=oxidoreductase activity; Cellular component=cytosol; Biological process=metabolic process
  Homolog annotation: Hit_ID=A7PZ77; Match level="QueryCoverage=73%, HitCoverage=92%, E-value=2e-96, Identity=64%"; Hit description =Chromosome chr15 scaffold_40, whole genome shotgun sequence
  Pfam annotation: Domain name=Epimerase; Domain location=9-304; Score=- 56.9; E_value=0.0063; Accession=PF01370.12; Description=NAD dependent epimerasedehydratase family
  Pfam annotation: Domain name=Myb_DNA-binding; Domain location=317 -362; Score=35.4; E_value=2.1e-07; Accession=PF00249.22; Description =Myb-like DNA-binding domain
  Pfam annotation: Domain name=adh_short; Domain location=7-184; Score =26.7; E_value=2.2e-07; Accession=PF00106.16; Description=short chain dehydrogenase
  Pfam module annotation: Pfam domain module=Epimerase::Myb_DNA -binding::adh_short; Domain location=9-304::317-362::7-184
MGEATERYAVVTGANKGIGLEIVRQLASAGIKVVLTARNEERGLKALETVKDSGLSHLVLFHQVDVADATSVASLADFIKSKFGKLDILINNAGISGVVIDDTDLITTVIKNRGAKPEYDGTKGVTHTYELAEECLQINYYGAKKTTESLMPLLQLSDSPRIVNVSSSLGQLESLPKGSWARGVFNDVDNLTAEIVDEILNKFLRDFKEGSLESKGWPKYLSAYIVSKAAMNAYTRILAKKYPSFCINSVCPGYVKTDITANTGILTVEEGAASPVRLLHSTANQVALMSPAEVELPGSQINHSLPQKGMSSKSNRCKRWSQEHRLFLLGLEKHGSGDWKNISRIIETRTPLQVASHAQKYFLRQALGDKAKRRSINDI

SEQ ID NO: 119852 - protein, 396 aa, Glycine max
  Coding DNA Sequence Number=SeqID_28167
  Gene Ontology: Mol. function=catalytic activity; Biological process =cellular metabolic process
  Homolog annotation: Hit_ID=A7PZ68; Match level="QueryCoverage=92%, HitCoverage=99%, E-value=1e-121, Identity=63%"; Hit description =Chromosome chr15 scaffold_40, whole genome shotgun sequence
  Pfam annotation: Domain name=Epimerase; Domain location=32-321; Score= -8.1; E_value=1.5e-06; Accession=PF01370.12; Description=NAD dependent epimerasedehydratase family
  Pfam annotation: Domain name=NAD_binding_4; Domain location=34-301; Score=-98.2; E_value=0.021; Accession=PF07993.3; Description=Male sterility protein
  Pfam annotation: Domain name=RmlD_sub_bind; Domain location=30-395; Score=26.0; E_value=6.1e-14; Accession=PF04321.8; Description=RmlD substrate binding domain
  Pfam module annotation: Pfam domain module=Epimerase::NAD_binding _4::RmlD_sub_bind; Domain location=32-321::34-301::30-395
MQYKLTRRDHNSTPSKERHQRQKQRRMSKVKILVVGGTGYLGQHLLQAYVHANANNGTPFAFDLAFTHHSSPPPQPLLDAIPFSLPFQVDLKTGFGFEAISNTFGQANVDNPVFFWVDTEWLTPLIFASLSSQLDSHSLIILLAMHKCEYDHPDVVVNCAAISVPRACEIDPATAHAINVPSSLVKWLQSFEKRSTLLIHLSTDQVYEGEKSFYKEEDIAVPVNVYGKTKVAAEQFISENYPNFAILRSSIIYGPQTVSPVPKSLPIQWIDGALAKGEKVEFFHDEFRCPIYVKDLVTIILTLTSQWISEGKQMQLLLNVGGADRVSRLQMAEAVAEFRGYDASLIKSVSASSVDRGVKSPADISMDITRLVQTLRIHPVSFKDGVRLTLTTEARQ

SEQ ID NO: 119853 - protein, 45 aa, Glycine max
  Coding DNA Sequence Number=SeqID_28168
MAGWEGIGEREVSRPWRWRDRREGVVPPLELAGQAFMAACVYTNT

SEQ ID NO: 119854 - protein, 669 aa, Glycine max
  Coding DNA Sequence Number=SeqID_28169
  Gene Ontology: Mol. function=structural constituent of ribosome; Cellular component=intracellular; Biological process=translation
  Homolog annotation: Hit_ID=A7QB23; Match level="QueryCoverage=91%, HitCoverage=97%, E-value=0.0, Identity=66%"; Hit description =Chromosome chr5 scaffold_72, whole genome shotgun sequence
  Pfam annotation: Domain name=RAP; Domain location=594-651; Score =75.5; E_value=1.7e-19; Accession=PF08373.1; Description=RAP domain
  Subcellular localization annotation: CTP_CleavageSite=65; ConfidenceScore=5.29e-01
MEGLLNSLHNQSCLKPFGFTPRLGYTFPVITRTGHLNRKPESCTLRSNCAQLGRDTSTSSRGAIVAALYSNDKGEGSNTDWESEFLGELDPFGYRAPKKREKEKRSMLLEATDGMDWCVRARKEALKSIEARGMAHLMENMVTVKKKKKKDKKKLESKKKIVKKIEKIEDLDFSLEEDLPQPMETEIDVGDLKRRVSIFNDGMFIEKKEKTKEEFVNRLSQFSGPSDHRKEINLNKAITEAQTADDVLEVTYETIVAVAKGLSPSPLSPLNIATALHRIAKNMEKVSMMRTRRLAFARQREMSMLVSIAMTALPECSAQGVSNISWALSKIGGELLYLSEMDRIAEVALTKVGEFNSQNIANIAGAFAAMQHSAPDLFSEFSKRASDIIHTFQEQELAQLLWAFASLYEPADPIFDSLDIVFKDHSQLRGCIGEKTSNNHEQISVDRSGASNGSLGSPVLTLTRDQLGTIAWSYAVFGQMARSFFSHVWKTLSHYEEQRISELYREDIMFASQVHLVNQCLKLEFPHLQLSLCGELEDKVALSGKTKRFNQKITSSFQKEVGHLLVSTGLEWVKEFVVDGYTLDAVIVDKKLALEIDGPTHFSRNTGVPLGHTMLKRRYITAAGWKVASISYQKWEELQGAFEQVEYLSNLLKNHLDEVYDETTSTEVK

SEQ ID NO: 119855 - protein, 199 aa, Glycine max
  Coding DNA Sequence Number=SeqID_28170
MAIQALQANAANTNGGTCANVDSPVIGSCDIPSMSPCRQYEWRDMPTRLGHVIALQETRALLLHWLGQSEACSRRKSTRKLKKKAKDSTAGGEKLSNFGEEELKNAQRSTTPNVQKATFKNAACKPRVETYPLQHCTLATLHASLGQNLSRQWDRRDLLTGCQVSRVLASSNGGSYVDYVSPVTMAASNQFPTWTVSRL

SEQ ID NO: 119856 - protein, 361 aa, Glycine max
  Coding DNA Sequence Number=SeqID_28171
  Gene Ontology: Mol. function=protein binding; Cellular component =postsynaptic membrane; Biological process=red or far red light signaling pathway
  Homolog annotation: Hit_ID=A7PZF0; Match level="QueryCoverage=96%, HitCoverage=96%, E-value=1e-129, Identity=62%"; Hit description =Chromosome chr15 scaffold_40, whole genome shotgun sequence
  Pfam annotation: Domain name=F-box; Domain location=23-70; Score =36.1; E_value=1.3e-07; Accession=PF00646.24; Description=F-box domain
  Pfam annotation: Domain name=Kelch_1; Domain location=115-161; Score =33.1; E_value=9.9e-07; Accession=PF01344.16; Description=Kelch motif
  Pfam annotation: Domain name=Kelch_1; Domain location=163-208; Score =38.6; E_value=2.3e-08; Accession=PF01344.16; Description=Kelch motif
  Pfam annotation: Domain name=Kelch_2; Domain location=115-161; Score =14.1; E_value=0.53; Accession=PF07646.6; Description=Kelch motif
  Pfam annotation: Domain name=Kelch_2; Domain location=163-208; Score =13.8; E_value=0.67; Accession=PF07646.6; Description=Kelch motif
  Pfam module annotation: Pfam domain module=F-box::Kelch_1::Kelch _1::Kelch_2::Kelch_2; Domain location=23-70::115-161::163-208::115 -161::163-208
MEHADKGKESSNSINEVEVTNSPIICGLPDDISLMCLARIPRKYHSVMKCVSKRWRNLICSEEWFCYRRKHKLDETWIYALCRDKSNEIFCYVLDPTLSRRYWKLIDNLPPQISKRKGIGFEALGNKLFLLGGCSEFLDSTDEVYSYDASSNCWAQATSLSTARYNFGCEVLDKKLYAIGGGGSKSSYHSWETFDPLTNCWTSQTDPKIVNEIKDSVVLDGKIYVRCSRYPVTPHVFAVVYEPSSGTWEYADDDMVSGWTGPAVAVDGTLYVLDQSAGTKLMMWHKERREWILVGKLSPLPIRQPCQLVAVGKSIFVVGRVLSTVVVDVDNLGNEDQVIVGSAIPGLLFDVNVTSVKCLSN

SEQ ID NO: 119857 - protein, 265 aa, Glycine max
  Coding DNA Sequence Number=SeqID_28172
  Gene Ontology: Mol. function=structural constituent of ribosome; Cellular component=ribonucleoprotein complex; Biological process =translation
  Homolog annotation: Hit_ID=Q2PMT2; Match level="QueryCoverage=44%, HitCoverage=49%, E-value=1e-45, Identity=81%"; Hit description =Chloroplast 30S ribosomal protein S2
  Pfam annotation: Domain name=Ribosomal_S2; Domain location=101-258; Score=80.2; E_value=6.7e-21; Accession=PF00318.11; Description =Ribosomal protein S2
MAPPKEIATVIYHNGHITDDSVQRSVYTCANPIFIYPSSPQSSCPQLQLPPPQQLPYNNLDLNDPVSSYNNLEIKDALDIYTSYTQLLSKNDFFYAQQTSFDQQNHPSSQFMSPSQQPQTQTSNRNEHLIANEDPIILFHEENNDFNEDQQCNKRRGDSIVFPNRDVAILKRHLAQLETYLGSIKYMTRLPDIVIIVDQQEEYKALRECITFEIPTIFLIDTNCDPDLADISIPTNDDAIASIRLILNKLVFAICESHSSYIRNS

SEQ ID NO: 119858 - protein, 453 aa, Glycine max
  Coding DNA Sequence Number=SeqID_28173
  Gene Ontology: Mol. function=protein binding; Cellular component =signalosome; Biological process=red or far red light signaling pathway
  Homolog annotation: Hit_ID=A7PXZ3; Match level="QueryCoverage=94%, HitCoverage=87%, E-value=1e-164, Identity=70%"; Hit description =Chromosome chr15 scaffold_37, whole genome shotgun sequence
  Pfam annotation: Domain name=PCI; Domain location=338-437; Score =52.8; E_value=1.2e-12; Accession=PF01399.18; Description=PCI domain
MDGDDETSGPMIDEIYANGGGVGDDGDKRSRRAIMSGDQLDIEAYAALYSGRTKIMRLLFFADKMNNAATQLEALRMAYDEIKKGENTQLFREVVQKIDGRLGPNYDMDAAWCDTVDRRAEQKKEKLENELNAYRTNLIKESIRMGFNDFGDFYYAHGQLGDAFKSYVRTRDYCTTSKHIIHMCMSAILVSIEMGQFSHVTSYVSKAEQAPDAPEAVTVAKLRCAAGLANLEAKKYKLAARKVSGSNFVFRCNLPVIVCGAAISPQGIRISGDKLGHFLETGPELGSHYNDVIASQDVATYGGLCALATFDRAELKASTPLYCYDDNSNFRNFLELVPEVRELINDFYSSHYASCLEYLGNLKANLLLDIHLHDHVETLYDQIRHKALIQYTHPFVSVDLNMMANAFKTTVAGLEKELEALITDNQIQIKGMPPFKGFWKLEGNLIVMFVPCY

SEQ ID NO: 119859 - protein, 74 aa, Glycine max
  Coding DNA Sequence Number=SeqID_28174
MHITNCKSIKTIVVKDREGGNDDEDNDENGGNGEGDTDEDGNEDGNFCKRDINSVIMQHRHPELVNMMTDSLDL

SEQ ID NO: 119860 - protein, 863 aa, Glycine max
  Coding DNA Sequence Number=SeqID_28175
  Gene Ontology: Mol. function=nucleotide binding; Biological process =defense response
  Homolog annotation: Hit_ID=A5AWL3; Match level="QueryCoverage=79%, HitCoverage=42%, E-value=1e-39, Identity=27%"; Hit description =Putative uncharacterized protein
  Pfam annotation: Domain name=LRR_1; Domain location=21-42; Score=2.0; E_value=1.3e+02; Accession=PF00560.24; Description=Leucine Rich Repeat
  Pfam annotation: Domain name=LRR_1; Domain location=254-279; Score =1.7; E_value=1.5e+02; Accession=PF00560.24; Description=Leucine Rich Repeat
  Pfam annotation: Domain name=LRR_1; Domain location=310-333; Score =5.8; E_value=26; Accession=PF00560.24; Description=Leucine Rich Repeat
  Pfam annotation: Domain name=LRR_1; Domain location=336-360; Score =3.2; E_value=78; Accession=PF00560.24; Description=Leucine Rich Repeat
  Pfam annotation: Domain name=LRR_1; Domain location=468-504; Score =2.3; E_value=1.2e+02; Accession=PF00560.24; Description=Leucine Rich Repeat
  Pfam annotation: Domain name=LRR_1; Domain location=520-543; Score =0.3; E_value=2.7e+02; Accession=PF00560.24; Description=Leucine Rich Repeat
  Pfam annotation: Domain name=LRR_1; Domain location=555-577; Score =5.5; E_value=29; Accession=PF00560.24; Description=Leucine Rich Repeat
  Pfam annotation: Domain name=LRR_1; Domain location=581-603; Score =4.9; E_value=38; Accession=PF00560.24; Description=Leucine Rich Repeat
  Pfam annotation: Domain name=LRR_1; Domain location=78-102; Score =1.2; E_value=1.8e+02; Accession=PF00560.24; Description=Leucine Rich Repeat
  Pfam annotation: Domain name=LRR_1; Domain location=786-808; Score =2.2; E_value=1.2e+02; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=21 -42::254-279::310-333::336-360::468-504::520-543::555-577::581 -603::78-102::786-808
MDNMSFSEHPELQQAWQDGQSLKELEVGDCKNVEVIFEMDVTEDAGTTFQLQNLSLERLPKLMQAWKGNGRGTHSFQNLQEVFVIGCQRLQNVFPAAVAKNLKKLHSLFIISCQRLEEIVKKEEDAEAEAAAEFVFPCLTTLHLSNLPELICFYPEPFTLGCPVLDKLHVLDCPKLELFESANRQPVFSDLKVISNLEGLALEWKHSSVLNSKLESGDYPNLLEYLIWIRLYFDVDDDGNPIFPIQTLQKASPNLKAMIISSCRSLEVFRTQIPEINKNLMLTQLCLIDVWKLKSIGSGEAQWLDEICKKLNELDVRGCPHFTALLHSPSSVTFSNLKELFIFNCQRLKYLFTSSAAKKLSQLEEIIVYYCKSIKEIVAKEEDETALGDVILPQLHRISLADLSSLECFYSGNQTLQLPSLIKVHIDKCPKMEIFSQGSIGPNSCREIVTRVDPNNRSVVFDDELNSSVKKVFLHQNHIVFGDSHMLQEMWNSETLPDWYFRNLTSMVVEGMGPQGSLSHLEQLQLENCDELAAIVANDEADNEEATKEIVIFSSITSLRLSDLPKLSCIYPGMQSLEWRMLKELHVKHCQKLKFFASEFQNSPDLNPDGEDRFSTDQQAIVSLEKVTPCLEVMSLGKEEAMMIEQGKLDIELPKLNSLKLQCFQDEQGDIFPFVFGLKDCDGLKYLFTFSTAKTLVVLKEIYITKCKSLKTIVAKDGEEGGDDEDNDVEEEDQGEGNEDEDEDEDEEEDEDEEEANAKGDGDEDENEGNNDENGNQGEDDITFKKLESLTLSSLPKLRSFYTGSSSLNFPCLKVMSFSKPCSTKLFRLFDNVPEQLRVKIDGIYSKRDIDSVIMQQDEAEAP

SEQ ID NO: 119861 - protein, 263 aa, Glycine max
  Coding DNA Sequence Number=SeqID_28176
  Gene Ontology: Mol. function=binding
  Homolog annotation: Hit_ID=A7PY00; Match level="QueryCoverage=45%, HitCoverage=21%, E-value=8e-28, Identity=58%"; Hit description =Chromosome chr15 scaffold_37, whole genome shotgun sequence
MALGSDIANTVDSGTEEGVVVGMNEGGPRCKLAIVSHPLEPCQGTAIHVEGNNGAGENCGGFVCGEEDDGDEGRRSKRSGMVRRTNESTNVRGWNTLVSRTRPSYEEEGEDRDNYPADGPIGPHGVLTHNHAVCLLNSSCIPCCTPVSLSTSETRLKQILLEVAAQAISSLIVLSQNQIEVKMDDTSVPNLVQLLDSSTQNTAKKYAVSCLGSHSPSKKCKKLMISYGAIRYLKKLTEMDIPGAKKLLERLERGKLRSLFSRK

SEQ ID NO: 119862 - protein, 1014 aa, Glycine max
  Coding DNA Sequence Number=SeqID_28177
  Gene Ontology: Mol. function=nucleotide binding; Cellular component =cytoplasm; Biological process=defense response
  Homolog annotation: Hit_ID=A5BH36; Match level="QueryCoverage=93%, HitCoverage=82%, E-value=1e-127, Identity=32%"; Hit description =Putative uncharacterized protein
  Pfam annotation: Domain name=AAA; Domain location=176-395; Score= -31.1; E_value=0.011; Accession=PF00004.20; Description=ATPase family associated with various cellular activities (AAA)
  Pfam annotation: Domain name=LRR_1; Domain location=600-623; Score =0.8; E_value=2.1e+02; Accession=PF00560.24; Description=Leucine Rich Repeat
  Pfam annotation: Domain name=LRR_1; Domain location=625-646; Score =1.9; E_value=1.4e+02; Accession=PF00560.24; Description=Leucine Rich Repeat
  Pfam annotation: Domain name=LRR_1; Domain location=671-692; Score =12.4; E_value=1.5; Accession=PF00560.24; Description=Leucine Rich Repeat
  Pfam annotation: Domain name=LRR_1; Domain location=694-717; Score =10.6; E_value=3.3; Accession=PF00560.24; Description=Leucine Rich Repeat
  Pfam annotation: Domain name=LRR_1; Domain location=913-937; Score =0.2; E_value=2.8e+02; Accession=PF00560.24; Description=Leucine Rich Repeat
  Pfam annotation: Domain name=LRR_1; Domain location=939-960; Score =4.1; E_value=54; Accession=PF00560.24; Description=Leucine Rich Repeat
  Pfam annotation: Domain name=NB-ARC; Domain location=140-507; Score= -1.7; E_value=3.7e-10; Accession=PF00931.13; Description=NB-ARC domain
  Pfam module annotation: Pfam domain module=AAA::LRR_1::LRR_1::LRR _1::LRR_1::LRR_1::LRR_1::NB-ARC; Domain location=176-395::600 -623::625-646::671-692::694-717::913-937::939-960::140-507
MQFVGIFVQVLPHLKSVCLHLKSGLGYLKLLPYELWRYESIVKELDRGFNNLQRERKRIGHKVKEEENRYGRAIDDDVIKWLQEADKIISEYDDFRLDEDSPYAVFCDGYLPKPSIRFRLSRIAVDLARRGNVLLQSANPDWLGRSSTDADFQSFASRNQTKKRIVDALADSNVGVIGVYGWSGVGKTSLIKEVAKEVKGKMFDVVIMVNVSFPEIRNIQGQIADRLGMILEEESESGRAARIRERLKNPKEKTLIILDDMEVKLDFGMLGIPFDDTVGSQMNNKKKNPLAHHKYAMKTEEFEASSLMKIEEPIARYTGCKILMISDSEQLLISQMGGKGIQTFSVEALTDKEAKKMFMTMAEIIPLMEKKAETMFKTMAEIIALREMEAETMSKIMTEMIGDENSKFEKLAAQIAKRCKGLPMTIVTTAKALKNKSLVVWEKAYLDLGKQNLTAMPEFSTKLSYDLLENEELKHTFLICARMGRDALITDLVRYCIGLGFLQGIYTVREARDRVYALVGKLKELSLLSDSFSIDHFTMHDIIRDVALSIASQEMHAFALTKGRLDEWPKKRERYTAISLQHCDVTDIMKKFPESIDCCRLRIFHLDNMNPRLEIPDNFFNGMKELRVLILIGIHLLSLPSSIKCLKELRMFCLERCKLAENLSIIGELEELRVLSLSGSDIECLPIELRKLAKLQIFDISNCFELKKIPADVLSSLTSLEELYVGKSPIQWKDEEGQGNQNGDVSLSELRQLNQLTALDIQIPKMTHFHKNLFFDQLNSYKIIIRDFNAYPAWDFKMLEMCEASRYLALQLENGFDIRNRMEIKLLFKRVESLLLGQLNDVKDIFNELNYEGFPYLKYLSILSNSKVKSIINSENPTYPEKAFPKLESLFLYDVSNMEHICHGQLTNDSFRKLKIIRLKICGQLKNVFFSSMLKHLSALETIEVSECNSLKDIVTLESNKDHIKFPELRSLTLQSLSEFVGFYTLDASMQQQVPNWKPGDQLFDEEVCSKLSR

SEQ ID NO: 119863 - protein, 349 aa, Glycine max
  Coding DNA Sequence Number=SeqID_28178
  Gene Ontology: Mol. function=nucleic acid binding; Cellular component= nucleus
  Homolog annotation: Hit_ID=A7PY01; Match level="QueryCoverage=95%, HitCoverage=93%, E-value=1e-58, Identity=61%"; Hit description =Chromosome chr15 scaffold_37, whole genome shotgun sequence
  Pfam annotation: Domain name=RRM_1; Domain location=194-258; Score =59.5; E_value=1.1e-14; Accession=PF00076.13; Description=RNA recognition motif. (a.k.a. RRM, RB
  Pfam annotation: Domain name=RRM_1; Domain location=4-65; Score=1.1; E_value=0.12; Accession=PF00076.13; Description=RNA recognition motif. (a.k.a. RRM, RB
  Pfam module annotation: Pfam domain module=RRM_1::RRM_1; Domain location=194-258::4-65
MKPVFCGNLDFDARQSDVERLFRRYGKVDRVDMKSAGQLLFLLGILALWILVLNGAFVGSIVWRRKIGCFKDVFCCHEDVEVETEASYWVESQIFEKGKSFIAFSFLMTFAQCSISNMFQHRNHDDFATVAGFAFVYMEDERDAEYAIRRLDRTEFGRKGRRIRVEWTKQERDSRRSGGDSRKSSSNSRPSKTLFVINFDPVHARTRDLERHFDSYGKILNIRIRRNFAFIQFESQEDATRALEATNLSKFMDRVITVEYAIRDDDDRDRRNGYSPDRRGHDSPDGRYGRGRSPSPYRRGRGSPDYGHGSNPSSRPDPRGSPKYERAESPINNGRYDSRSPPPRERSRS

SEQ ID NO: 119864 - protein, 48 aa, Glycine max
  Coding DNA Sequence Number=SeqID_28179
  Subcellular localization annotation: CTP_CleavageSite=45; ConfidenceScore=5.37e-01
MDINVIGIPPPTKKNSASNSMKQKKASSSSYVVVTCILWSSRLPVCML

SEQ ID NO: 119865 - protein, 413 aa, Glycine max
  Coding DNA Sequence Number=SeqID_28180
  Homolog annotation: Hit_ID=A5AMK8; Match level="QueryCoverage=48%, HitCoverage=40%, E-value=7e-18, Identity=30%"; Hit description =Putative uncharacterized protein
  Subcellular localization annotation: CTP_CleavageSite=30; ConfidenceScore=5.09e-01
MSTQLKRFNSMERRPRMLKDFLSENLNSCSSSGFKSLPRKPTNNNSMHSLIEMELKSSSPFQTLMNTIRSISLFTSKSPSVLSLPRSLSRKLSSSRRKTRTRRRRSHVCSSDVNITTVVKIKDIIRWKSFRDIVVEPSLPPPPLDFMVGSTNTTCSSCSSGSSWTESDFFLTSSWEEPQNDNVEAGKRFSFFSPLVVGKDSGATDTSTCQEEQHSPVSVLHVGEDDFSPFDQSLANILRRKQKFIQTVQKLESHAKFDLANLDQCLSLDDNSGYDEEYEEEEDDDNDDIEEQDWIEEKAKQLLHCVKARVSAHGCIDYLDTLLLDFFREELSGSRNQYKNEEEFELETLRITEDWINGSFAFDAGHADKHAYIKDMERRDQWSRLEEDQEELAFEIETAILHSLIADLLDLDA

SEQ ID NO: 119866 - protein, 190 aa, Glycine max
  Coding DNA Sequence Number=SeqID_28181
  Homolog annotation: Hit_ID=A5AMK8; Match level="QueryCoverage=58%, HitCoverage=21%, E-value=4e-12, Identity=35%"; Hit description =Putative uncharacterized protein
MVVSIVRFTISIARFDRIPAATDANRSIKDHDDIVTVTNDQCLSLDDNSGYDEEYEEEDDDNNNDIEEQDWIEEKAKQLLHCVKVRGSAHGCIDYLDTLLLDFFREELSGSRNQYKNEEGFELETLRITEDWINGSFAFDAGHAHKHAYIKDMERRDQWSRFEEDQEELAFEIETAILHSLIADLQDLDA

SEQ ID NO: 119867 - protein, 27 aa, Glycine max
  Coding DNA Sequence Number=SeqID_28182
GVPKVVSKFHNNLTVDESEIIVLLGHV

SEQ ID NO: 119868 - protein, 147 aa, Glycine max
  Coding DNA Sequence Number=SeqID_28183
  Gene Ontology: Cellular component=integral to membrane; Biological process=transport
  Homolog annotation: Hit_ID=A7PYR9; Match level="QueryCoverage=38%, HitCoverage=29%, E-value=7e-19, Identity=83%"; Hit description =Chromosome chr12 scaffold_38, whole genome shotgun sequence
MDTYGVELELRKLEGEVKAIHENLLYLKGREAEMRTVSEKTNGRVAWFSIISLAMCIAVSEEDEKLLRHITKYGHGHGHGAEFPKQEDRVRQTMTMANDDGACGTIRTSRRSEGGDDEACGSVRRFPENAFTMSRELGRTYVHEQSA

SEQ ID NO: 119869 - protein, 309 aa, Glycine max
  Coding DNA Sequence Number=SeqID_28184
  Homolog annotation: Hit_ID=Q45TX7; Match level="QueryCoverage=68%, HitCoverage=58%, E-value=5e-57, Identity=52%"; Hit description =Putative shrunken seed protein
  Pfam annotation: Domain name=Pex16; Domain location=97-305; Score= -2.0; E_value=2.1e-09; Accession=PF08610.1; Description=Peroxisomal membrane protein (Pex16)
MDSTMSTRTFHTLTNPPCPGMIHLGDGVDEVFYSVPKGKGEGHCGRGNNGGHNKCLHSSFIEGVSCKCLEFIDEGGMNEDFFYKPLASEVVAFSEAIEAYKRWVRQNKEFVHSMESLANGLTWLLPERFSESEIGPEAVTTILGIITALNEHIIDTAPKQNITGSVEPYSFPYPLCLSALKDLETLVEVVAQQYYGDDKKWNFLAITEATKVLVRLSLFRKSGYKMLLQGGETPNDEEYSDSFTSQHHMGLKPDVHHRPGYMKNNLGAKPMNQEGRALSALVRFGEKAKGSDPVWLRRVEHQQATMEPT

SEQ ID NO: 119870 - protein, 132 aa, Glycine max
  Coding DNA Sequence Number=SeqID_28185
  Gene Ontology: Mol. function=serine-type endopeptidase activity; Cellular component=extracellular region; Biological process=negative regulation of catalytic activity
  Homolog annotation: Hit_ID=A7PY65; Match level="QueryCoverage=99%, HitCoverage=17%, E-value=2e-46, Identity=68%"; Hit description =Chromosome chr15 scaffold_37, whole genome shotgun sequence
MAPAIIVNSRIGQIITNYTQSTRSPSAVMHKSHEVKIQAPFAASFSSRGPNPGSQHILKPDVAAPGINILASYTPKKSITGQKGDTRFLEFALMSGTTMSCPHVAGVAAYVKSFHPKFPAAIRSAIITTGEI

SEQ ID NO: 119871 - protein, 150 aa, Glycine max
  Coding DNA Sequence Number=SeqID_28186
  Gene Ontology: Mol. function=sequence-specific DNA binding; Cellular component=nucleus; Biological process=regulation of transcription, DNA-dependent
  Homolog annotation: Hit_ID=A1XG54; Match level="QueryCoverage=92%, HitCoverage=56%, E-value=1e-26, Identity=53%"; Hit description=SOC1
  Pfam annotation: Domain name=K-box; Domain location=1-82; Score=51.2; E_value=3.6e-12; Accession=PF01486.8; Description=K-box region
HLKQEAENMMKKIDLLEAAKRKFLGEGLGACSIEELQRIEQQLERSLSNVRARKVQVFKEQIEQLKEKTLIYTVVTNCQYEEKALLDENAKLTENARLSEKHDIHLQPATKNQNVNQPQCNAESSSSSDVETELFIGLPDTRARHISHHV

SEQ ID NO: 119872 - protein, 227 aa, Glycine max
  Coding DNA Sequence Number=SeqID_28187
  Gene Ontology: Mol. function=phosphoprotein phosphatase activity; Biological process=intracellular signaling cascade
  Homolog annotation: Hit_ID=A7PHV0; Match level="QueryCoverage=61%, HitCoverage=46%, E-value=7e-26, Identity=42%"; Hit description =Chromosome chr13 scaffold_17, whole genome shotgun sequence
MVMFYGCKLSMFQNIFGIGKKTENYTSDELFPRLRMDGAPLIGPPNLDLADFCEELLGVRPQEGELQGSVCSTYAWGPAVLAYLYREMCSAADYILIQMWAWERCTTLSPKRTPSVIENKPLGHRWLRRGNQHIGNDDLIVFCRKLDIMKRHEFLCEPCTTNVMSALPPICLVGSVAWCAVMPLICFHVVEWHQPDRILRQFGMQQPILGSFVTPEYSWHNTKRQTR

SEQ ID NO: 119873 - protein, 31 aa, Glycine max
  Coding DNA Sequence Number=SeqID_28188
MEGVGKTLSYGNGRLDDGKALAELGFEIGDR

SEQ ID NO: 119874 - protein, 233 aa, Glycine max
  Coding DNA Sequence Number=SeqID_28189
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A5BY55; Match level="QueryCoverage=70%, HitCoverage=38%, E-value=5e-56, Identity=64%"; Hit description =Putative uncharacterized protein
  Pfam annotation: Domain name=2-Hacid_dh_C; Domain location=2-146; Score=159.1; E_value=1.2e-44; Accession=PF02826.10; Description=D -isomer specific 2-hydroxyacid dehydr
ISFVFQLKGKRVGIVGLGKIGKEVAKRLEPFGCRIMYHSRNQKPFISYPFYSKVVELAGNSDVLVLCCPLNEQSRHLINREVMLALGKDGAIVNVGRGALIDEKELVRCLMEDEIRGAGLDVFENEPNVPNELFPLDNVVLSPHAASLTSDGFTEVCELAAEALELFFSTLSGTRCLVSQDHLILRLMTLQDNPFQDGAFALLPKFVRASVQLFMLVLYRGCKYTSCPPHESK

SEQ ID NO: 119875 - protein, 82 aa, Glycine max
  Coding DNA Sequence Number=SeqID_28190
  Gene Ontology: Mol. function=nucleotidyltransferase activity
  Homolog annotation: Hit_ID=O64642; Match level="QueryCoverage=70%, HitCoverage=7%, E-value=8e-24, Identity=87%"; Hit description =Expressed protein
KREKDWTRRIGNDRHLICIEDPFEISHDLGRVVDKHSIKVLREEFERAAEIMQNDPNPYFIGEVMDTQLARIFCYVERAPRY

SEQ ID NO: 119876 - protein, 171 aa, Glycine max
  Coding DNA Sequence Number=SeqID_28191
MNNCLLAKSMNTLEVSSLLKSLQVWAHIRDLAPFRRRFTSLQRITDSLIRDRSTSVVQGKLRCLAIAITVYCIWMSRNKLIFEDYQFSVIELAREGERRWKRWEKEGLDMRKAWSHRESETELKWRNQELQCGGERGGNGEWEMMDDIRDSRQKDSEGRIVLHRNKVVFTN

SEQ ID NO: 119877 - protein, 91 aa, Glycine max
  Coding DNA Sequence Number=SeqID_28192
  Homolog annotation: Hit_ID=A5B7R0; Match level="QueryCoverage=53%, HitCoverage=3%, E-value=3e-08, Identity=55%"; Hit description =Putative uncharacterized protein
MEYAMHFLMGLNEAYSSIKGQILSMDSFTSITKVFPLIAQEEKQREIGASANAESSHAFAVKNDAGSYESSMLQTDWIPTKLQEEQAFFSL

SEQ ID NO: 119878 - protein, 524 aa, Glycine max
  Coding DNA Sequence Number=SeqID_28193
  Gene Ontology: Mol. function=ATP-dependent helicase activity; Cellular component=cytoplasm; Biological process=regulation of translation
  Homolog annotation: Hit_ID=A7QIS9; Match level="QueryCoverage=98%, HitCoverage=99%, E-value=0.0, Identity=78%"; Hit description =Chromosome chr2 scaffold_105, whole genome shotgun sequence
  Pfam annotation: Domain name=DEAD; Domain location=177-343; Score =226.9; E_value=4.6e-65; Accession=PF00270.20; Description=DEADDEAH box helicase
  Pfam annotation: Domain name=Helicase_C; Domain location=409-485; Score=117.9; E_value=3e-32; Accession=PF00271.22; Description =Helicase conserved C-terminal domain
  Pfam annotation: Domain name=ResIII; Domain location=173-338; Score= -37.6; E_value=0.069; Accession=PF04851.6; Description=Type III restriction enzyme, res subunit
  Pfam module annotation: Pfam domain module=DEAD::Helicase_C::ResIII; Domain location=177-343::409-485::173-338
MNHNNSNNRARYPPGMGLVRGGFNPNLSQNPNQNQNPSLNQNHHAFQARPPYHQQQQAQYVQRHLLQQQQQQQQWLRRDANAVDEVEKTVQSEAVDSRARVSVEVLLLVCLVYVVWLSVMCLLGCSQDWKARLKIPPADTRYKTEDVTATKGNEFEDYFLKRELLMGIYEKGFERPSPIQEESIPIALTGSDILARAKNGTGKTAAFCIPALEKIDQDNNVIQVVILVPTRELALQTSQVCKELGKHLKIQVMVTTGGTSLKDDIMRLYQPVHLLVGTPGRILDLAKKGVCILKDCAMLVMDEADKLLSPEFQPSIEQLIHFLPTTRQILMFSATFPVTVKDFKDRYLQKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLIEQELGTEIKQIPPQIDQAIYC

SEQ ID NO: 119879 - protein, 460 aa, Glycine max
  Coding DNA Sequence Number=SeqID_28194
  Gene Ontology: Mol. function=guanyl-nucleotide exchange factor activity; Cellular component=plasma membrane; Biological process =embryonic development ending in seed dormancy
  Homolog annotation: Hit_ID=Q2HTJ1; Match level="QueryCoverage=97%, HitCoverage=97%, E-value=1e-151, Identity=61%"; Hit description =Putative uncharacterized protein
  Pfam annotation: Domain name=PRONE; Domain location=12-459; Score =679.1; E_value=3.5e-201; Accession=PF03759.4; Description=PRONE (Plant-specific Rop nucleotide exchang
MDNSSNFDDNSDVGYQPSPSSVDQNDHSITENVGYSPLFSGESFAYCRSNSEVSNFSEPIDDNSFASEPSPSLWTPMKHGASQAALSRLGVKQHRHSVDEKSDDLDLLETELDMMRERFSKLLLGEDMSGGGKGVCTAVTISNSITNLYATAFGQNLKLEPLKPEKKAMWRREMNCLLSVCDYIVEFSPTAQYLEDGTIVEMMTSKPRSDIYINLPALQKLDTMLIEILDSFQDTEFWYAEQGSISGNSTRSRGGSFRRIVQRKDEKWWLPVPCVHTGGLSDKSRKHLNEKRDCANQIHKAAMAINSSALAEMDIPETYMSNLPKNALSSMFSCFHLFFSSLTLEWKNKSGGHNLPLRKACLSHSKTSWNKVKDLMADTDRSDKNYILAERAETLLFCLKQRYPELSQTSLDTCKIQYNQDVGKAILESYSRVLEGLAFNIVAWIEDVLLADKSMRNQNV

SEQ ID NO: 119880 - protein, 510 aa, Glycine max
  Coding DNA Sequence Number=SeqID_28195
  Gene Ontology: Cellular component=endoplasmic reticulum lumen
  Homolog annotation: Hit_ID=A7PZA5; Match level="QueryCoverage=74%, HitCoverage=100%, E-value=1e-171, Identity=69%"; Hit description =Chromosome chr15 scaffold_40, whole genome shotgun sequence
  Pfam annotation: Domain name=DUF821; Domain location=102-504; Score =988.5; E_value=2.6e-294; Accession=PF05686.3; Description =Arabidopsis thaliana protein of unknown function (DUF821)
MEKDNETYLKLFWGRSNHEKPCLLSKKGKSTALSTTVILLVCFVATFLVLTIWNTSTFAALSIPISIIPTTKPQEQEFPLSCTQNVTQTCSRDYPTIHTPTNPTRTCPSYFRWIHEDLWPWRERDRGITREMLEGARRTAHFRLVIVDGKLYVEKYKKAIQTRDVFTLWGILQLLRMYPGKVPDLELLFDCDDRPVVSKERFKGPNAPTPPLFRYCSDQWSLDIVFPDWSFWGWAEINIKPWKHVLKEIKEGNEKTKWKDRVPYAYWKGNPLVSPTRKDLMKCNVTEKDDWNTHLYIQDWDQESSKGYKKSNLGDQCTHRYKIYVEGWAWSVSEKYILACDSTTLYVRSRFHDFFVRGMVPLEHYWPIRDNSKCKSLKFAVEWGNNNTDKAQAIGEAGSKFIHEDMDMDYVYDYMFHLLNEYAKLQRFKPTIPQNAVEYCPETMACGVDGIQRRFMEDSMVKSPSDSNPCTLPPPYEPINLQDFLEKKASSIRQVETWEDQYWEKEKGGQ

SEQ ID NO: 119881 - protein, 168 aa, Glycine max
  Coding DNA Sequence Number=SeqID_28196
MGFSGNMIATSLFCGVHNKIKAIMAVLWALQVWALRGAALKIYTGFLKTHMQMVKLCHWRDRLAEALKEMQSEGKADRVFHLISASNGTIEREKDDQPVIKLNEILAVCLSMLSMANAGMWWKAKIPPYRHAIAAYGAAMVGLPSQIAYGGWQKSAMPFRYSSHGATI

SEQ ID NO: 119882 - protein, 136 aa, Glycine max
  Coding DNA Sequence Number=SeqID_28197
MKEGKFVDDMFGRLQVLLNGLEALGQSFSKSQINMKIIDNFPKMAESDGSNNSFGGSTNDEVTLMSRKFKQMLKKKEKFQCSSRRKNTIFKKKCKEENNEIIYFECRKLGLMKAKCPQLKKNRYFGDKKKKSLMVT

SEQ ID NO: 119883 - protein, 92 aa, Glycine max
  Coding DNA Sequence Number=SeqID_28198
  Homolog annotation: Hit_ID=Q5CDC4; Match level="QueryCoverage=30%, HitCoverage=21%, E-value=1e-07, Identity=100%"; Hit description =LacOPZ-alpha peptide from pUC9
  Subcellular localization annotation: CTP_CleavageSite=21; ConfidenceScore=5.03e-01
MRNASQSNFPSSSTDLQEQMRNQMKDPAMRKMSLPLSKIDFSYSHCIFFWQVVQMFSSGTELEFVIMVIAVSCVKLLSAHNSTQHTSRKHKV

SEQ ID NO: 119884 - protein, 126 aa, Glycine max
  Coding DNA Sequence Number=SeqID_28199
FDLEICDRSGAQNLVADHLSRIERVFEDSPIQDDFPDDHLYILDRLLGDAFQTMRLTQSCNSVILPHQVAILAYRGQLARCLTVVSIGPPFSRMSGEFVALVSLVREQATHLHGNNKCLNNPCYSV

SEQ ID NO: 119885 - protein, 114 aa, Glycine max
  Coding DNA Sequence Number=SeqID_28200
MTIEESIHVSFDESNAISPRKDILDDVAESLEKMHIHGQDSKGKGKGSNEDPPEEAKSTDELPKELKASKDHPLDNIIGDISKGCFSKWLNQEEVYVEQPPGFEISQISRGIFL

SEQ ID NO: 119886 - protein, 98 aa, Glycine max
  Coding DNA Sequence Number=SeqID_28201
MVMDMADTFGEDFGIHFNQWSCINAEISTESSVSRLQFFSTLKKDSQSRILADQPWKGSSSLPLIKGRRKALLIDSLSWKSSLQFGLAGEIKVLAWMV

SEQ ID NO: 119887 - protein, 67 aa, Glycine max
  Coding DNA Sequence Number=SeqID_28202
MTKLKVRHFIYKMMIRSRMSQMNQTSGQRKLIQESVQDQSKNQIKIKIRSRSERSIKIVLKSFVKTE

SEQ ID NO: 119888 - protein, 58 aa, Glycine max
  Coding DNA Sequence Number=SeqID_28203
MKLMSSSRHVMRESIASKRSPVKARRYLSSVRMSFSKEDEESYCGGGEGGHSLGIGGG

SEQ ID NO: 119889 - protein, 73 aa, Glycine max
  Coding DNA Sequence Number=SeqID_28204
MGADGRVGGGDAMNVGIDGGVVEEANGMATGCNRDGYCISHPAPNFVIDPRPRPRSPSGLKIRTHPRTGIVTY

SEQ ID NO: 119890 - protein, 312 aa, Glycine max
  Coding DNA Sequence Number=SeqID_28205
  Gene Ontology: Mol. function=transferase activity, transferring phosphorus-containing groups; Cellular component=membrane; Biological process=two-component signal transduction system (phosphorelay)
  Homolog annotation: Hit_ID=A1FR21; Match level="QueryCoverage=70%, HitCoverage=53%, E-value=9e-85, Identity=75%"; Hit description =Sensor protein
  Pfam annotation: Domain name=HisKA; Domain location=158-226; Score =5.1; E_value=0.092; Accession=PF00512.16; Description=His Kinase A (phosphoacceptor) domain
  Pfam annotation: Domain name=PAS_4; Domain location=27-134; Score =3.3; E_value=0.1; Accession=PF08448.1; Description=PAS fold
  Pfam module annotation: Pfam domain module=HisKA::PAS_4; Domain location=158-226::27-134
MPRVAVSAANALVTAPLPPQPVLQALLERLREGLLLFTDDGQVALANPAAQNLLASGEGGGLPPPQRLRELLPPDALEQARQHGHWNGSLPLGEGVVIAHLYHHGPVGQGHFLALFRHIEGQEDYERELQQRHAELRQAYLRLNGTQEKLLQSEKMASIGQLAAGVAHEINNPIGYVHSNLGSLQEYLRSLFTVIEAYERALRAPDPKALIPEIDDIRDRLDIDFISRDLPQLMAESREGIERVTRIVRDLKDFSPGIDHQHHLERAEVQGHPGAGVRPATAGGMPAVGVEPGLHEPAAQRQPCHRRARHDH

SEQ ID NO: 119891 - protein, 149 aa, Glycine max
  Coding DNA Sequence Number=SeqID_28206
  Homolog annotation: Hit_ID=Q6WAY6; Match level="QueryCoverage=65%, HitCoverage=19%, E-value=1e-07, Identity=33%"; Hit description =Putative uncharacterized protein
MTRASISWFLRWKEGREVVLCSCEGFPNVPLIGMRGCIKYNPMRGAPSEETITPFIAQGFNDANTKILQRIRNAWNKVGRKDKELSRRSNGVIGGYHKWLKSRMPGITWLPKLKGLDGEAAKVLEESEEVQAELEKTRVAKEKLKVVVT

SEQ ID NO: 119892 - protein, 172 aa, Glycine max
  Coding DNA Sequence Number=SeqID_28207
MIRGDTLRLFAPLCHPEAAGPMTSRDQVWSFCTLVSSRGGGPDDTRRYLTVIRTLLSSRGGGPDDKQRPKAAGPMIRGDTLRLFAPFCHPEAAGPMTSRDQVWSFCTLVSSRGGGPNDTRRYLTAAGPMTSRDQIWSFCTLVSSRGGGPDDTRKYPSGYPYNILLLSVRQNA

SEQ ID NO: 119893 - protein, 137 aa, Glycine max
  Coding DNA Sequence Number=SeqID_28208
MRTCFSKETKLPTDQSNICFLDEKQCVYRGRRHFISKRPFRGNTGSNKDRKKSLKVYQSNTMRGEKVTSAQDFVGNQRERTTLGKGLTFSPWVKVYDKLGFWLKACRTAGHDICQGLASGSGIKGMSYIIFMIHMQQ

SEQ ID NO: 119894 - protein, 72 aa, Glycine max
  Coding DNA Sequence Number=SeqID_28209
MPIGWTSQKSGADADKEEPTDLRSNPLQGGGDDAILPRKGPVTYAMSRRLQEDWARVAEEGPRVLMNTRVDF

SEQ ID NO: 119895 - protein, 140 aa, Glycine max
  Coding DNA Sequence Number=SeqID_28210
MAEPSKKCKGSSSRIQWHSEAQDTPIPSFISSSSLFSLEEQRIWYANLFSSHFIIYPKFIDMDFFSDESFECIQAFQNSNLIPFMSLKLHVYSELVKAFYSNLETQESTLISEVYGIKMVIDQSLFYDLTQLSTEGVPFE

SEQ ID NO: 119896 - protein, 115 aa, Glycine max
  Coding DNA Sequence Number=SeqID_28211
MVLLVNVMIQQAISSNSASPYQLDFTLYASGSYNAQWNAPGRLRDKHTLRSSRILRKMEVEEPWLGLFAAKFLFVGVFLVCAKGMAFVDNWAVGQEEFCYWLSNDIVGLVGNLAV

SEQ ID NO: 119897 - protein, 130 aa, Glycine max
  Coding DNA Sequence Number=SeqID_28212
MARRDKLWSFCTLLSSRGVGPDDMRRQNLVIPHPFAIQTQLCPMARRDKLWSFCTLLSSRGGEPNDMRRQNLVIPHPFAIQTQSCPMARRDKLWSFCTLLLSRGGGPDDTRRFTSSSALTRSVILTFESR

SEQ ID NO: 119898 - protein, 240 aa, Glycine max
  Coding DNA Sequence Number=SeqID_28213
  Gene Ontology: Mol. function=nucleotide binding; Cellular component =intracellular; Biological process=response to DNA damage stimulus
  Homolog annotation: Hit_ID=A6TCH9; Match level="QueryCoverage=63%, HitCoverage=62%, E-value=3e-79, Identity=96%"; Hit description=DNA repair protein recO
  Pfam annotation: Domain name=KH_2; Domain location=41-105; Score =47.1; E_value=6.1e-11; Accession=PF07650.8; Description=KH domain
  Pfam annotation: Domain name=RecO; Domain location=83-240; Score =131.0; E_value=3.5e-36; Accession=PF02565.6; Description =Recombination protein O
  Pfam module annotation: Pfam domain module=KH_2::RecO; Domain location=41-105::83-240
MASEIIREKLMRFLGAELPYSVTVEIERFVSNERGGYDINGLILVEREGQKKMVIGNKGAKIKTIGIEARKDMQEMFEAPVHLELWVKRAFVLHSRPWSETSLMLDVFTEESGRVRLVAKGARSKRSNLKGALQPFTPLLVRFGGRGEVKTLRSAETVSLALPLSGITLYSGLYVNELISRVLEHETRFSELFFDYLHCIQALAGAIGSPEPALRRFELALLGHMGYGVDFLHCAGSGDP

SEQ ID NO: 119899 - protein, 143 aa, Glycine max
  Coding DNA Sequence Number=SeqID_28214
  Gene Ontology: Biological process=transposition, DNA-mediated
  Homolog annotation: Hit_ID=Q1J7G7; Match level="QueryCoverage=28%, HitCoverage=71%, E-value=2e-12, Identity=74%"; Hit description =Transposase
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPPRLVPKQGLATLNASNVLAE

SEQ ID NO: 119900 - protein, 73 aa, Glycine max
  Coding DNA Sequence Number=SeqID_28215
IIVPRKLLPERNVVVYYTKFDEFKEELERHHWDEELTDFGDGNIDVAIVKELYANLYDPKDKSPKQVRVRSSD

SEQ ID NO: 119901 - protein, 354 aa, Glycine max
  Coding DNA Sequence Number=SeqID_28216
EMAPRKLASKRSRKDKAAEGTSSAPEYDSHRFRSAVHQQRFEAIKGWSFLRERRVQLRDDEYTDFQEEIGRRRWTSLVTPMVKFDPEIVLEFYANAWPTEEGVRDMRSWVRGQWIPFDADAIGQLLGYPLVLEEGQECRVWPEEEPDFARTAAGRRVRIMRTNMTTLTQIWMTLLLSNILPTDHNSDLPMPKCQLVYAILTRMSIHVAQLITDAIYIFAGMAPTRHPLDPDKSNRALGFPALITGLCQSFGVPVAPAKVIRPPITRAFIEKYCTQRQAQGDAPQAAGAPPPPHQAGQAGAFDMEQYLRHLVRQQAANHQAHVRTHDCLYQMSLSMQSQGFASFSCPTPDQFRAE

SEQ ID NO: 119902 - protein, 48 aa, Glycine max
  Coding DNA Sequence Number=SeqID_28217
MIDTLEPYNGAMRGTMHEPQVNLGADQNSSPGFVPKSKLQKGSSQDLK

SEQ ID NO: 119903 - protein, 80 aa, Glycine max
  Coding DNA Sequence Number=SeqID_28218
RGEKVASAQDFVGNQRERTTLGRGRGLTFSPWVKVYDKLGFWLKACRTAGHDTCQDLASDSGIKGMYPHYSHDTHATNDE

SEQ ID NO: 119904 - protein, 233 aa, Glycine max
  Coding DNA Sequence Number=SeqID_28219
  Gene Ontology: Mol. function=hydrolase activity, hydrolyzing O -glycosyl compounds; Cellular component=integral to membrane; Biological process=carbohydrate metabolic process
  Homolog annotation: Hit_ID=A6KWP7; Match level="QueryCoverage=88%, HitCoverage=25%, E-value=5e-70, Identity=59%"; Hit description =Glycoside hydrolase family 3, candidate beta-glycosidase
  Pfam annotation: Domain name=Glyco_hydro_3; Domain location=138-233; Score=-75.9; E_value=0.00016; Accession=PF00933.12; Description =Glycosyl hydrolase family 3 N terminal domain
MPNQLKSYLIIAALSALYLNSSAQHINIYHKDWIDFNKNGKKDIYEDPKQDIASRVEDLLRQMTVQEKANQTVTLYGYGRVLKDEQPTAAWDQEIWKYGLANIDEMLNSLAYNKSAKSSFSYPFSRHAQALNNVQKWFVENTRLGIPVDFTNEGIHGLNHDRATSLPAPINIGSTWNTSLVRKAGDVIGKEAKYLGYTNVYTPILDVSRDPRWGRVVETYGEDPFHIAEMGKQ

SEQ ID NO: 119905 - protein, 136 aa, Glycine max
  Coding DNA Sequence Number=SeqID_28220
MQSQGLALPSELEVGPSVDRVSTKKSCVDPSGNNPDTGYSGKCGLYIKENPPRLVALGRVYEGSTIVYNIPLLHDQVKVGVEEVRDADTPIPVPTEEGAVGLVKPVDRSDHEVDDPLCLMTLIIPQLFLKPLQVYD

SEQ ID NO: 119906 - protein, 241 aa, Glycine max
  Coding DNA Sequence Number=SeqID_28221
  Gene Ontology: Mol. function=guanyl-nucleotide exchange factor activity; Cellular component=basal part of cell; Biological process =positive regulation of peptidyl-serine phosphorylation
  Homolog annotation: Hit_ID=A7PDN1; Match level="QueryCoverage=59%, HitCoverage=7%, E-value=2e-69, Identity=90%"; Hit description =Chromosome chr11 scaffold_13, whole genome shotgun sequence
KRKSAQYANRLSPRVGRFINAAGTTGFPTGKRAVSATQLIYDHDYEFELGTHSAVKYLQLANKLFSQAELFHFCASILELVIPVYKSRRAYGQLAKCHTLLTNIYESILEQESSPIPFTNATYYRVGFYGVRFGKLDKKEYVYREPRDVRLGDIMEKLSHTYESRMDGNHTLHIIPDSRQVKAEELQPGMQAWHWPSFYNVVTGKTLALPNLIALQHIPLSPAGVIAKRPAPIALPNSCAA

SEQ ID NO: 119907 - protein, 261 aa, Glycine max
  Coding DNA Sequence Number=SeqID_28222
  Gene Ontology: Mol. function=[acyl-carrier-protein] S-malonyltransfera se activity; Cellular component=fatty acid synthase complex; Biological process=fatty acid biosynthetic process
  Homolog annotation: Hit_ID=A3XKS2; Match level="QueryCoverage=99%, HitCoverage=88%, E-value=4e-99, Identity=69%"; Hit description =Malonyl CoA-acyl carrier protein transacylase
  Pfam annotation: Domain name=Acyl_transf_1; Domain location=1-261; Score=-13.6; E_value=2.5e-09; Accession=PF00698.12; Description=Acyl transferase domain
MESANEILGFDMLSLMFNGTEEDLKKTEVTQPSIFIHSVAALKAVNGLGAEMVAGHSLGEFSALVANGVLSFDDGLKLVSERAKAMQEACDINPSSMAAILGLEDAKVEEICAQINGIVVPANYNCPGQLVISGETAAVEEACIKLKEAGAKRALLLPVNGAFHSPLMQPAQERLAAAIEQTKFRKATIPVYQNITTTAVTNPDEIKKNLIAQLTGPVKWTQSVQNMIKDGASNFVEVGPGKTLQGLIKKIDSSVDVASAI

SEQ ID NO: 119908 - protein, 53 aa, Glycine max
  Coding DNA Sequence Number=SeqID_28223
SMYHHEVTVILLIKGFKHTVANFCMVFLGLSFTTANWHCCGSALIISLKPQSQ

SEQ ID NO: 119909 - protein, 78 aa, Glycine max
  Coding DNA Sequence Number=SeqID_28224
MAGARLAGGNHPQRTFHRRCAAERPADAGKNARWPAAAGGGPDWRRQRRRLHSGDARPVSRQPPARAAHHLCPDLHVA

SEQ ID NO: 119910 - protein, 98 aa, Glycine max
  Coding DNA Sequence Number=SeqID_28225
MSLEVHARCPSLPQCKDLRYQSLLFVMTLVAGTYWVRTSNLPLGSFEGSKVSIVVLFSQPCSKGERKKQLILAKRIFQGREMVEGFFSVDGLSQMTPM

SEQ ID NO: 119911 - protein, 16 aa, Glycine max
  Coding DNA Sequence Number=SeqID_28226
MENCTKQSVRMAPNSK

SEQ ID NO: 119912 - protein, 36 aa, Glycine max
  Coding DNA Sequence Number=SeqID_28227
SPISILVVPELDASLPEKRPSLDGFEALLVYNAPKA

SEQ ID NO: 119913 - protein, 58 aa, Glycine max
  Coding DNA Sequence Number=SeqID_28228
MRISRKLIKFTRLILSWKPLPLVVYKMPLFVRKSRHYWMKRTQISGWNVSMTKRWLLI

SEQ ID NO: 119914 - protein, 125 aa, Glycine max
  Coding DNA Sequence Number=SeqID_28229
MGALITNDGSRDSKPAKQIRSNKIYNNLSIVSFGGFLSNPTLQGYWIEDSKRLGPELLMKALGSFFHGLFPSGWRLLSPLLLCLPLHLHGGKSPLKDLIDAQRSNIHRSPTSKLPSGLASTHFET

SEQ ID NO: 119915 - protein, 112 aa, Glycine max
  Coding DNA Sequence Number=SeqID_28230
  Homolog annotation: Hit_ID=A7NT00; Match level="QueryCoverage=55%, HitCoverage=11%, E-value=3e-14, Identity=65%"; Hit description =Chromosome chr18 scaffold_1, whole genome shotgun sequence
MRKEKIPHQAPFAIQAAQLLGRAIGAGLFAITPAGERGMCCKAIKLGNARVFPVTTLYKIVKAGSGRSHTVVVTEDGNSLAFGWNKHGQLGSGSVRNGMLVFSVSVKIGNFC

SEQ ID NO: 119916 - protein, 47 aa, Glycine max
  Coding DNA Sequence Number=SeqID_28231
MASSGATDAPPSPLEFTSAHPQKGLSIAYTTWPTNRRPSPKPKVGRT

SEQ ID NO: 119917 - protein, 16 aa, Glycine max
  Coding DNA Sequence Number=SeqID_28232
SRVRPIPGKCYEVLGN

SEQ ID NO: 119918 - protein, 317 aa, Glycine max
  Coding DNA Sequence Number=SeqID_28233
  Gene Ontology: Mol. function=catalytic activity; Biological process =proteolysis
  Homolog annotation: Hit_ID=A1G019; Match level="QueryCoverage=100%, HitCoverage=73%, E-value=1e-93, Identity=86%"; Hit description =Putative uncharacterized protein precursor
MEIKDVRLVYAPPGSVGKFGGDVDNWMWPRHTGDFSFYRAYVGKDGKPAAFAADNVPYQPKHFLKFADQPLGADDFVMVAGYPGRTNRYALAGEFNETASFTYPTIAKHYNAVLKMIADAGKADADVKVKYAATAASMNNVAKNYLGQLEGFKRIDAAGQKQAEEAAVLAWLKKQGAAGKPALAAHAQLLKHLDTSKSTRERDLFVGQFNNTSAVALLDAVKAKRYGGLEDKRIGSVPVNFLSNLDITGGNSGSPVLDANGKLVGLAFDGNWESVSSNWVFDPVMTRMIAVDSRYMQWIMQEVAPAPQLLKELNLAK

SEQ ID NO: 119919 - protein, 159 aa, Glycine max
  Coding DNA Sequence Number=SeqID_28234
VARFTLRGLHILAIRGLYTLTFRGLHVLTTARPLEPSFRGLHALAFRGLDLSQRTRILAIRGLEVLAIRGLHALTFERTTRPRYLEDCTGLHVLAFRELHVLEGCTLFRGLHVLVIEGCTPSPSEDYTSSPLENCTPSSSEDYTFSPSEGCTPSPSEDY

SEQ ID NO: 119920 - protein, 208 aa, Glycine max
  Coding DNA Sequence Number=SeqID_28235
  Gene Ontology: Cellular component=mitochondrion
  Homolog annotation: Hit_ID=Q6R9L5; Match level="QueryCoverage=37%, HitCoverage=64%, E-value=9e-28, Identity=76%"; Hit description =Putative uncharacterized protein orf121-a-ct
MVESVGALRGGGLPCGGCQRFESAYLQLVNLVDTKLYDSTSIFPIRQFDLCYDLSFMDVDKILPSSSTLGWHSLKVNGDVQTKKGLWWIPRHPETRKGVVSDEMLRGVENKRRSGDSRYRSTFRTAAESTGTRGKESKSDSRSSGERNGSSLNRENGVVGELYKCRAARRSSRECCTLDGESPVAESITSLRSDPSSMGHVESRVNQQ

SEQ ID NO: 119921 - protein, 65 aa, Glycine max
  Coding DNA Sequence Number=SeqID_28236
MRSGKYAPSSSGSGHLSFKEAAGIRLPLGVGCYERSSIGQARPVKAEAAGSSPESVPMDPKEMKF

SEQ ID NO: 119922 - protein, 305 aa, Glycine max
  Coding DNA Sequence Number=SeqID_28237
  Homolog annotation: Hit_ID=Q6Z8F0; Match level="QueryCoverage=22%, HitCoverage=61%, E-value=3e-17, Identity=68%"; Hit description =Putative uncharacterized protein P0459B01.18
PTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRACTQRVVDGSRTDRLARDWSRAWLIHHFITAKSAMNPDSTNHEAGARGRRALGLMASGATCVQRLDGSRDSAIHTKYRISLRSSSMQEPRYPLPRVIDEEAGRTGRRGHPLPPDGR

SEQ ID NO: 119923 - protein, 142 aa, Glycine max
  Coding DNA Sequence Number=SeqID_28238
TLVSTATPLGLEVIPQVKELLDEGVPTDPERIKVTPDWPTPPTPLIELVRNHVPSWEDVHERGVEGKSPEYKEPRDLRSNPFQGGGDDAILPPKALASQLKEVSLAIRELLKEVFSKKLLKEVFSKKLVKEVFSRKLLKEAT

SEQ ID NO: 119924 - protein, 150 aa, Glycine max
  Coding DNA Sequence Number=SeqID_28239
MSSYVIGSGVNSGNGLGGKFLVVLELPAGRVVFGVGTWGASLWVSALGCTGVELEAFPSVYYHGDHLSLNHGRSYLCRQIPPPLRIFFKGFTLFLEHILQLSAVGSHIRIVLILPLEGSNQILPSTDTGSFQISVPHYRGFGQAILKEVY

SEQ ID NO: 119925 - protein, 222 aa, Glycine max
  Coding DNA Sequence Number=SeqID_28240
  Homolog annotation: Hit_ID=A5BSR3; Match level="QueryCoverage=52%, HitCoverage=37%, E-value=6e-12, Identity=38%"; Hit description =Putative uncharacterized protein
MDEKTKKKLEEADQSGSTEAVIDPPSPIRRHVKWKMARTKKTGQMTSEATKEIAKKIDSLEEQVSQGSFVPYGRQDLLTVAIGQPEHPDRVRTAGIGVTIKQYFGSAPQTSRTSSSMAPEELEQLTQQIRGQLEELITEKVTRQLICNHRDLHYLRSLRLVPQLLVSAQMGVVLIPQRSIQTRVTQTNTGCTSKKILPAWLPYEEFMRDPQPFTTSLCCMAK

SEQ ID NO: 119926 - protein, 240 aa, Glycine max
  Coding DNA Sequence Number=SeqID_28241
  Gene Ontology: Mol. function=oxidoreductase activity; Cellular component=microsome; Biological process=electron transport
  Homolog annotation: Hit_ID=A1CPD7; Match level="QueryCoverage=100%, HitCoverage=53%, E-value=7e-76, Identity=55%"; Hit description =Cytochrome P450 pisatin demethylase, putative
  Subcellular localization annotation: CTP_CleavageSite=59; ConfidenceScore=5.13e-01
MNSRLISGVLRTLTTSKQGGPTGMMALMTSSHTMIFRRPEQDEVFSEAVNLVFAGPGSVAAALTAMVYQLGTQEGQLWQEKLRKEADVEALPFSLELQAVVKETLRHCASFPTAFPRVIRRGAETIVSTLPAPLPIGTTVSANSYVLGRSRKIWGHDADQWLPQRWLGDESQRREIEAKLVAFSKGSRGCVGKELAWLVLAKAVMAIIRRWKFVSVGELRGKSYLEMQYDDCWIEYEELA

SEQ ID NO: 119927 - protein, 73 aa, Glycine max
  Coding DNA Sequence Number=SeqID_28242
MEIKEQVSIGHQNWGEFYRLFAAKFLPWLVFWFVLKVVFSIGCVEWQPQHGFLPHSHPLHLPQFSHSSKQQAG

SEQ ID NO: 119928 - protein, 177 aa, Glycine max
  Coding DNA Sequence Number=SeqID_28243
  Homolog annotation: Hit_ID=Q6WAY4; Match level="QueryCoverage=68%, HitCoverage=22%, E-value=5e-10, Identity=33%"; Hit description =Putative uncharacterized protein
MGTNQNGKRFYQVKIKGLDVTNLNELGRLMGPLQRQAFHKVYGKILDLTTMEVFTEAIVSLAQYYDQPLRCFTFGDFQIVPTVEEFEEILGCPLGGRKPYLFSGFLPSLSKIAAVVGDLARELDRMMQTRNGVVSLPHKYLEGKVMQSYPARALDRRLQVDWARDPREGLRVLMSLR

SEQ ID NO: 119929 - protein, 155 aa, Glycine max
  Coding DNA Sequence Number=SeqID_28244
MERKTREKRVEEISQDERDKIREEERRKILKELRKEKHASYGSHNSCKSLSEELRDYYEGRHRSHLRPHSHRREKERKPQEANTNLPYFHGKYNVEANLDWEIRIEQQLKRKSTSKSYGSHSYPKKDQGQGILGVTPSKPKDDKGKIIEKQPLKA

SEQ ID NO: 119930 - protein, 86 aa, Glycine max
  Coding DNA Sequence Number=SeqID_28245
MKWNFNVSTQNEETDKRKRSIAFKASCSMQEEEESDDEEDFSLFVKKFHKFVKNRRIERRHNFNNGKRSQEGSPTLKFYKCNRPVT

SEQ ID NO: 119931 - protein, 161 aa, Glycine max
  Coding DNA Sequence Number=SeqID_28246
  Homolog annotation: Hit_ID=O52175; Match level="QueryCoverage=50%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLSHAPVKAKLKGQFCDCAPPASTSSRV

SEQ ID NO: 119932 - protein, 22 aa, Glycine max
  Coding DNA Sequence Number=SeqID_28247
VEERLQSVGKASGGTIGILEDI

SEQ ID NO: 119933 - protein, 50 aa, Glycine max
  Coding DNA Sequence Number=SeqID_28248
MSEEVDMNEQNEDKASVNEEHVDCSDVFNTSQEWLVYGQKERFGKNSYWQ

SEQ ID NO: 119934 - protein, 158 aa, Glycine max
  Coding DNA Sequence Number=SeqID_28249
  Homolog annotation: Hit_ID=A4W8L8; Match level="QueryCoverage=100%, HitCoverage=100%, E-value=5e-63, Identity=76%"; Hit description =Putative sensory transduction regulator
MDLQVVPTLDTLRQWLDDAGITFFECDSCQALHLPHMQNFDGIFDAKIDLINDVILFSALAEVKPSALLALASDLSAINASSLTVKAFLDIQDDNLPKLVVCQSLFSGAGLSFKQFAWFMRLSEEQISMVMMEASAHHLLYSAEDDAENNDASPNFLH

SEQ ID NO: 119935 - protein, 179 aa, Glycine max
  Coding DNA Sequence Number=SeqID_28250
  Homolog annotation: Hit_ID=A1IW39; Match level="QueryCoverage=38%, HitCoverage=98%, E-value=2e-17, Identity=69%"; Hit description =Putative uncharacterized protein ophh-69
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRGYSAEVIHAILQEKLERPSTNGYLYPKPTQCRKVKEVGDLMTGEPTTEAPVNGGRNYNGPKVAKFLV

SEQ ID NO: 119936 - protein, 39 aa, Glycine max
  Coding DNA Sequence Number=SeqID_28251
EKEGGACHPARLDELGCFLQKAILEGPSGPGCYLHPPIY

SEQ ID NO: 119937 - protein, 69 aa, Glycine max
  Coding DNA Sequence Number=SeqID_28252
MGTKMKRCPFEALGSMVLITSMPDMENGQGAAETFNDTGLPRHLNSMYDKSSCMLSWNMDARLASASTI

SEQ ID NO: 119938 - protein, 115 aa, Glycine max
  Coding DNA Sequence Number=SeqID_28253
  Homolog annotation: Hit_ID=A6FJQ2; Match level="QueryCoverage=33%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLVTPGFSQSRRCKRRPVPSLHACRSTLEDPPLFGKI

SEQ ID NO: 119939 - protein, 92 aa, Glycine max
  Coding DNA Sequence Number=SeqID_28254
MVIGESFSFVVVSSLVVGQQVVIVAVAGLVDGGKVFATRDDVLEWARSVAYEIGFVAIIMRLDTNNGIRGRTLFVLIGCERSGQYRAKKKDL

SEQ ID NO: 119940 - protein, 134 aa, Glycine max
  Coding DNA Sequence Number=SeqID_28255
  Homolog annotation: Hit_ID=A5BEV8; Match level="QueryCoverage=74%, HitCoverage=15%, E-value=2e-14, Identity=36%"; Hit description =Putative uncharacterized protein
MTKQQRSTKCDPSYWEYVDALHFMHNIAALLGMGEDSWSLVHNHLHKELTKWSDDYINLVTMDKWMNITDMGYVIVSRYNVILVSLSLQQSMIFFPLRSQPPTDSFEHHVICIGHVYDNHFVQVFLRDCCRYCQ

SEQ ID NO: 119941 - protein, 366 aa, Glycine max
  Coding DNA Sequence Number=SeqID_28256
  Homolog annotation: Hit_ID=Q2HTA0; Match level="QueryCoverage=32%, HitCoverage=18%, E-value=3e-11, Identity=37%"; Hit description=IMP dehydrogenase/GMP reductase, related
  Pfam annotation: Domain name=DUF1723; Domain location=95-144; Score =11.0; E_value=0.026; Accession=PF08330.1; Description=Protein of unknown function (DUF1723)
MDHAYDEVHEQPEEAAADDVLTNAEDFPGEPHNTSVLQDYVYHVVTKVWNGEERLELKLFSQGRKVEKFGRPAPEIEDLVAATGLSPLITCSLNTSDQGLMSAFMERWHKETSSFHLPSLHVDDTVLLLVELLEVSVEEAQVEIVQCHGAYSHTCPCGILGCIARPVHINDNLNDASKSMARQLARCITLLQCWIYEHFPSVGCVVAADDYDERKPRAYRWKSRKALLVSMYHKRLARLTSDVVCWIPYDHSSAPAAPSLSIEDIDDRWIQFSEYIAPHHDTFVEPDVTQHPVVTMAMNEASEDAHVDEACQAIAERLERLLNLRIVTEGTKTYNVMEDCLRIARGVTADRNVYVRLQRRWHIEVT

SEQ ID NO: 119942 - protein, 77 aa, Glycine max
  Coding DNA Sequence Number=SeqID_28257
MRKRHASRREKGGQVSGGRSLWKNASNAAFLRFLAFCWPFAHMFFPALSPDSVDNRIPPLSELIPLAAAERPSAASQ

SEQ ID NO: 119943 - protein, 111 aa, Glycine max
  Coding DNA Sequence Number=SeqID_28258
  Subcellular localization annotation: CTP_CleavageSite=66; ConfidenceScore=5.50e-01
MAIYTSVLKTQDVKKAKDLTMVMQNPVSSSLMLKLNPALKENSVTVTVFNMTGQSVITTQYRREINVTTLSSGSYIAVVSDGVLSEKKPAEISVKGYSKPDVLQLRLNGKP

SEQ ID NO: 119944 - protein, 56 aa, Glycine max
  Coding DNA Sequence Number=SeqID_28259
MGWFYNVPIYGPSERGVRQASSISPSPAWEKQRTLEARALFTFGHEHYSVLSVNPP

SEQ ID NO: 119945 - protein, 124 aa, Glycine max
  Coding DNA Sequence Number=SeqID_28260
MGDSDKCELYVDDNPPQLVALERVYDGSTTIQNVPLGNDQVKDKQVAEGPVKPVDMSDPDIDPLYLMTLTIPQLFLKPLQVLWDASMFGVYSDIFPLYIKHENLFEIAHGCQCLSISVIQLWIL

SEQ ID NO: 119946 - protein, 39 aa, Glycine max
  Coding DNA Sequence Number=SeqID_28261
MKKQQWKRRGRQRRRGERRRHPQGISHGRRSFTTKMRLG

SEQ ID NO: 119947 - protein, 48 aa, Glycine max
  Coding DNA Sequence Number=SeqID_28262
MEELVTKHNSPKITPTSSRWLGGSSPESYSLHPATVILLPRTRFVIIT

SEQ ID NO: 119948 - protein, 72 aa, Glycine max
  Coding DNA Sequence Number=SeqID_28263
MTPYEAWFNRKPTVDHFKIQSSSSFLEMSSLTKEQAGNGVLKSMRRKKQPIQARAHYHHHQHNMTNITSKKK

SEQ ID NO: 119949 - protein, 345 aa, Glycine max
  Coding DNA Sequence Number=SeqID_28264
  Homolog annotation: Hit_ID=Q652R5; Match level="QueryCoverage=26%, HitCoverage=36%, E-value=2e-16, Identity=53%"; Hit description =Putative uncharacterized protein P0603C10.50
VGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGLVGSVRARKGSSMGPELTGSHVIGLERGSIHHFITAKSCHATQISTNHEAGARGRRALGLMASGATCVQRLDGSRDSAIHTKYRISLRSSSMQEPRYPLPRVIDEEAGRTGRRGHPLPPDGR

SEQ ID NO: 119950 - protein, 109 aa, Glycine max
  Coding DNA Sequence Number=SeqID_28265
MDDNTEMEVNEPETNTTTQNMSSTKENGQRKRSREGDKRIGVAAKLSSQLDRIIQTFESSVSAQDPTSITACVVKLKDLPRLECGRCLHHYHQMTLHLAMTITLRRTKC

SEQ ID NO: 119951 - protein, 278 aa, Glycine max
  Coding DNA Sequence Number=SeqID_28266
MWMDRFALTLNGSQELPRLLAKAKAMADTYSAPEEIHGLLGYWKNTITKRATRHPYCTRSKSRTMGDQEETQEQMKADMSALKEQMASMMEAMLSMKQLIEKNAATAAAVSSAAEADPTLLATAHHPPSNIVGRGRDTLGHDGSPHLGYNRAAYPYGLSPNYSPPVLQEDAGHIASPVLEREPPQQPDEVHKDSQDYARRDVEFYPPIPEGPAPGTLLQPNIAASPIVLSTEGPPSATEERRKLNLLEERLRVVEGFGDYAFADMTDLCLVPDVVIPP

SEQ ID NO: 119952 - protein, 38 aa, Glycine max
  Coding DNA Sequence Number=SeqID_28267
GCPIANVWRAIEIIGNLNVMLSVESERENGNLVTHERH

SEQ ID NO: 119953 - protein, 115 aa, Glycine max
  Coding DNA Sequence Number=SeqID_28268
DRDCKTPSGPEEGQQCLGVASSKYGSLSVQGSACCPQQGHQAPYQSSFHLEVLRPQAGAGRDTTAALGWTVAGNRHTAITTKVHLSSSIKRMHLVAHDPGDLNKTSASSEGREIP

SEQ ID NO: 119954 - protein, 83 aa, Glycine max
  Coding DNA Sequence Number=SeqID_28269
MTPIAQSNTSRLGARGVVSDSLTFECLSPIINLAYIKKNCWNPKDLTVSIRGIWRARARPAELPSTSAAPTLASTSAAPSVPA

SEQ ID NO: 119955 - protein, 52 aa, Glycine max
  Coding DNA Sequence Number=SeqID_28270
MTSQAAKEIVKKIDSLEEQVSQGSFVPHGRQDLLTAAIGRLEHIGRVRVAGA

SEQ ID NO: 119956 - protein, 51 aa, Glycine max
  Coding DNA Sequence Number=SeqID_28271
MDPKRIKVIPEWPTPPCVEERIPEFQEHMDLMSNPFQGRGNDAILPHKGIG

SEQ ID NO: 119957 - protein, 98 aa, Glycine max
  Coding DNA Sequence Number=SeqID_28272
  Subcellular localization annotation: CTP_CleavageSite=66; ConfidenceScore=5.10e-01
MFFLLITIARKVRSLLFWPMLMTPSTGDARRAVRGLFVAHLLFMYGWSLTFFVMKVNSSIPYKVTACVPRKGKQIGSSSWQVCTLELTPPSRWTLQIH

SEQ ID NO: 119958 - protein, 177 aa, Glycine max
  Coding DNA Sequence Number=SeqID_28273
MESLIPATKLAYVKKNYCNLDDLTVTFRGPHKAKGKRSETLPFSEIPLSAAPSITTSSSSALSPSAPASSLPAPASAPTPLLVAWPGVQPSPSREGEASTAQEPVPAEEPVQDAEDELEKAVAQEPTSPVQISPAPIPKDSQPSAPASEPAQPIVQDPPAAPVLDLNEHAEDHPQED

SEQ ID NO: 119959 - protein, 137 aa, Glycine max
  Coding DNA Sequence Number=SeqID_28274
  Gene Ontology: Mol. function=beta-lactamase activity; Cellular component=nucleus; Biological process=beta-lactam antibiotic catabolic process
  Homolog annotation: Hit_ID=P62593; Match level="QueryCoverage=85%, HitCoverage=44%, E-value=8e-39, Identity=69%"; Hit description=Beta -lactamase TEM precursor
  Subcellular localization annotation: CTP_CleavageSite=51; ConfidenceScore=5.20e-01
MDKAHAVGQLTGVRAHSSFGGPKELTVFAQHGGSCNSPTVNRRRSGHHDPVARVGTTMRKLLTGELLTLASRQQLIDWMEADKVAGPLLRSALPAGWFIADKSGAGERGSRGIIAALGPDGKPSRIVVIYTNGESGN

SEQ ID NO: 119960 - protein, 100 aa, Glycine max
  Coding DNA Sequence Number=SeqID_28275
MQEKNEDEESEDEEDFSLFVKKFKNLSRRKESRGVKTSTMEKDLKKILKFLDATNATNLVTSKQIVPQMRNGLKRVIRKEKEINLLTKDYESDVNISQED

SEQ ID NO: 119961 - protein, 78 aa, Glycine max
  Coding DNA Sequence Number=SeqID_28276
MRFRNIPKAIKGDDYVICKKKNQQKKAGGVFSKQRMQIATKPTWAFHDVPPEAGAFWRKQPSLPGRARWQVPPSFSYK

SEQ ID NO: 119962 - protein, 210 aa, Glycine max
  Coding DNA Sequence Number=SeqID_28277
  Gene Ontology: Mol. function=unspecific monooxygenase activity
  Homolog annotation: Hit_ID=O04892; Match level="QueryCoverage=21%, HitCoverage=8%, E-value=9e-20, Identity=97%"; Hit description =Cytochrome P450 like_TBP
  Subcellular localization annotation: CTP_CleavageSite=76; ConfidenceScore=5.70e-01
GPFPIRPPTGTRRPRSRRGSSSSSPPTADGFGTGTPVPSPQSQSFSRGYGSILPTSLAYIVPSTRGCSPWRPDAVMSTTGRGRHSVLRIFKGRRGRTGHHATCEKITLSGAPADVSGLPNVAVSRHVPICTDDRSARARALGFAATAAPSYSSGLGPCPDARVSAQLGTVTQLPVHPASPVLLTKNGPLGALDSMARLNRAAAPSYLFKV

SEQ ID NO: 119963 - protein, 78 aa, Glycine max
  Coding DNA Sequence Number=SeqID_28278
MVQFRNQCHKGSITSSRKAAMGIELIYKPSKLWSHDIPKFFDKVEVKAIWPRAFVTSTIPHNFFELKNCSPPPSAKIS

SEQ ID NO: 119964 - protein, 386 aa, Glycine max
  Coding DNA Sequence Number=SeqID_28279
  Homolog annotation: Hit_ID=Q6WAY6; Match level="QueryCoverage=90%, HitCoverage=59%, E-value=8e-29, Identity=27%"; Hit description =Putative uncharacterized protein
MQVVVRDPARGLDRVKQTRNGIVGLPQKYLEGKAMDMVNQEEWVPFMDVLALLIFGVVLFPNVDGLVDLAAIDAFLAYHNHKESPIVAMLADLYDTFDRRCEKSNTRIVCCTLALYVRLVSHLFRQEVRHACPLEGHRSCTEKGGANWDQLLANKEGASINWFPRWKEGRTGVLVSCGGFLNVPLIGTRGCIDYNPILAIRQLGYLMRGAPLEEELALVISRGFNETNVETLRKVRKAWEVVQKKDKELRGSNNGPIGGYCEWLKAHVQGLDWLPSLRTAKREEVEAPEEDEDVQALRTELKQAQVVKERFKSAALKIRKENAELRDINIATTKALEQETKRARREEHGRNKFRGALWGSNSELKLRREERDQSRVDSLILKDELK

SEQ ID NO: 119965 - protein, 68 aa, Glycine max
  Coding DNA Sequence Number=SeqID_28280
  Homolog annotation: Hit_ID=A6FJQ2; Match level="QueryCoverage=55%, HitCoverage=84%, E-value=3e-11, Identity=92%"; Hit description=50S ribosomal protein L5
MQLPETVTACLMRKEKIPHQAPFAIQAAQLLGRAIGAGLFAITPAGERGMCCKAIKLGNARVFPVTTL

SEQ ID NO: 119966 - protein, 54 aa, Glycine max
  Coding DNA Sequence Number=SeqID_28281
MKPFLKTKCFQDIQGSDVCNRLPATELLKFKFKSHDPSKYNYVVDYQKPVIDYQ

SEQ ID NO: 119967 - protein, 149 aa, Glycine max
  Coding DNA Sequence Number=SeqID_28282
  Homolog annotation: Hit_ID=Q84VH5; Match level="QueryCoverage=68%, HitCoverage=14%, E-value=9e-38, Identity=79%"; Hit description =Envelope-like protein
MAFRTVLCGIMLSQHPNMVNYTDSVMKRESPLSLHYKLFEGTHVPDIVSTSGKAAASGAVSKDALIAELKDTCKVLEATIKATTEKKMELERLITRLSESGIDDEEAAEEEEEAAEEDKEAAEEEEEAAEEEEDTAEETESDDDSEATP

SEQ ID NO: 119968 - protein, 112 aa, Glycine max
  Coding DNA Sequence Number=SeqID_28283
  Pfam annotation: Domain name=G-patch; Domain location=26-70; Score =7.7; E_value=0.022; Accession=PF01585.14; Description=G-patch domain
MNFQALEVVSNAYVKLPPVQPRSSSVALMVAGVMLGHGYEPKMGLGQNGDGVASLVEFKENRGRFRLGYKPTRADVRRSALERKGRSMGSLRGPQEKGTPLSHINKSFVSSG

SEQ ID NO: 119969 - protein, 50 aa, Glycine max
  Coding DNA Sequence Number=SeqID_28284
MKILSSGVVFTLKEGRGKQLKRSVKARQKRKEKKPKLTEIKMKAKNQEMN

SEQ ID NO: 119970 - protein, 449 aa, Glycine max
  Coding DNA Sequence Number=SeqID_28285
  Homolog annotation: Hit_ID=Q6WAY6; Match level="QueryCoverage=36%, HitCoverage=27%, E-value=4e-15, Identity=33%"; Hit description =Putative uncharacterized protein
MEVPRRQGEGYGQSRRLGPVYGCVSFANFWGRPLSKRGWCKKSSARIICCLPTLCVWLVSHLFQQDTRHPCPLLSHRSCTEKRRIDWDQLLAGIGGRTISWFPRWKEGKEGVLFSCGGYPNIPLVGTRGCINYNPTLAIRQLGYPMRGAPTEESMSPFLVRDFCAQNSKTIQRIHKAWETPLRKDQELRGIHNGIIGGYHEWLKVHIRGLDWLAKLKVVSEESFEAPEEDEEVQALKSELGKAKLAKEKFKLAATHIRKEYAGLREENAITTRALEQETKRARKEEYGRNKFRGALWGSNSELKLRREERDQSRAHSMVLKEELVACSRSKRSLSQRLCETETNMLAIIAKYQEELGLATAYEHRIADEYAQVYAEKEARGRVIDSLHQEATMWMDRFALTLNGSQELPRLLAKAKAMADTYSAPEEIHGPLGYCQHMIDLMAHIIRNR

SEQ ID NO: 119971 - protein, 77 aa, Glycine max
  Coding DNA Sequence Number=SeqID_28286
MTPSQQHDAPMATPNAPLGLQWDVLICVTSFLQRLSNKGRDSAQEEIRIVKLKGGIDHVAHPRTITDTIMTDIYVSI

SEQ ID NO: 119972 - protein, 68 aa, Glycine max
  Coding DNA Sequence Number=SeqID_28287
MSAEIYQSGLFHDRCRLLSINSIRERSGARCRLGNVRSASSDDASFLDPDLSSFVANVACHFFINIGE

SEQ ID NO: 119973 - protein, 174 aa, Glycine max
  Coding DNA Sequence Number=SeqID_28288
  Pfam annotation: Domain name=Transposase_23; Domain location=38-108; Score=-16.4; E_value=0.074; Accession=PF03017.5; Description =TNP1ENSPM transposase
MMQSQGLALPLEPLVGPSGPRVSTKGSYVDPSGNDPETGDSDRCGLYIEANPDLLVALGRVYEGSTVVHNTLLLPGQVKVGVEEVKDADVLVPIPINEVSLVGQAIDTFLAWLIHLIKSLSQQVDDPLYLMTLTIPELFLRPYQVTWDATMFGVFNLDFPLYIKHEDLSEIAHG

SEQ ID NO: 119974 - protein, 28 aa, Glycine max
  Coding DNA Sequence Number=SeqID_28289
EWRRRRVERRCHFKEKMSQEEAHHPRKP

SEQ ID NO: 119975 - protein, 95 aa, Glycine max
  Coding DNA Sequence Number=SeqID_28290
  Subcellular localization annotation: CTP_CleavageSite=34; ConfidenceScore=5.17e-01
VDSRGSHPVTSSKGIRPPTNRAFIKKYCVSRRVQGETPQQPGDGRQRATDALPSPLEFTSAHPQKGLSIAYTTWPTNRRPSPKPKVERYLGYACI

SEQ ID NO: 119976 - protein, 55 aa, Glycine max
  Coding DNA Sequence Number=SeqID_28291
MAPEDMEKTTFVTPVGTFCYKLFERLRKYELREVARFHRKPERDRGGPRKGEGHP

SEQ ID NO: 119977 - protein, 145 aa, Glycine max
  Coding DNA Sequence Number=SeqID_28292
MIRGDTLRLFAPFCHPEASGPMTSRDQVWSFCTLVSSRGGGPDDTRRYLTVIRTLLSSRGGGPDDKQRPKAAGPMIRGDTLWLFAPFCHPEAAGPMTSRDQIWSFCTLVSSRGGGPDDTRKYPSGYPYKHSFAICKTERLIACRD

SEQ ID NO: 119978 - protein, 77 aa, Glycine max
  Coding DNA Sequence Number=SeqID_28293
MVSVKFRGMPEVEREHCRTICKVLQHSREKESAKEAIRVVFSKKGCANSNQSHLGLPGCSNRRRCLLVEATQLALAS

SEQ ID NO: 119979 - protein, 69 aa, Glycine max
  Coding DNA Sequence Number=SeqID_28294
MNEERGKEGGGCRPARLSELAGRPKWACLLTMGVKYFERSSKGCRPSNNGPWMKLGFDSCPSLLIFYWR

SEQ ID NO: 119980 - protein, 83 aa, Glycine max
  Coding DNA Sequence Number=SeqID_28295
MSGFTRDSPQISASLHQLYLAPYASGSYNVQWNALGLLHNKHTLRSSRILRKMEVEEPWQGLWLPLHYQVDMGASQHRTPELG

SEQ ID NO: 119981 - protein, 218 aa, Glycine max
  Coding DNA Sequence Number=SeqID_28296
  Gene Ontology: Mol. function=nucleotide binding; Cellular component =intrinsic to membrane; Biological process=defense response
  Homolog annotation: Hit_ID=Q6R271; Match level="QueryCoverage=100%, HitCoverage=21%, E-value=2e-83, Identity=67%"; Hit description =Disease resistance protein
DILDEIQHEISKCQVEVEAEAESQTCTCNVPNFFKSSPASSFNREIKSRIEQVLENLENLARQSGYLGLKNASGVGSGFGGAVSQQSQSTSLLVESVIYGRDDDKEMIVNWLTSDIDNCSELSILSIVGMGGLDEFDVFNVTRTILVEVTKSTDDSRNREMVQERLRLKLTGKRFFLVLDDVWNRNQEKWKDLLTPLNDGAPGSKIVVTTRDKKVASI

SEQ ID NO: 119982 - protein, 247 aa, Glycine max
  Coding DNA Sequence Number=SeqID_28297
  Homolog annotation: Hit_ID=Q84VI1; Match level="QueryCoverage=91%, HitCoverage=29%, E-value=8e-43, Identity=83%"; Hit description =Envelope-like protein
PRLQGKRCLEMSLMHHWTNISFHSIGNVEKWKYVYQRRLAVERELGRDALDCKEIMDLIKAAGLLKTVSKLGDCYEGLVREFMVNIPSDISNRKSDEYQKVFVRGKENSTSSHTILKPSLHPAKRNQREELNATEETPAPRAPEPAPGDLIDLEEVESDEEPIANKLAPGIAERLQSRKGKTPIKRSGRIKTMAQKKSTPITPTSSRRSKVAIPLKKRKEISSSDSDDDVELDVSTSKRTKTSGRVP

SEQ ID NO: 119983 - protein, 177 aa, Glycine max
  Coding DNA Sequence Number=SeqID_28298
MQGITWLPKLKCPCREETEVPNESEEVQALKVELERTRVVKEKLKMAVTRVRKECDELRDVNMTTAEALERETKRARKEEWGQNKFRRALWGNNNKLKLQRAKKDESRVESMILEDKLRACQRSKRSLTEQLSSTEENMLTIIDQYKEKLNLAASHRQRLKDEHAKVSTLQVEREAR

SEQ ID NO: 119984 - protein, 104 aa, Glycine max
  Coding DNA Sequence Number=SeqID_28299
  Homolog annotation: Hit_ID=P63419; Match level="QueryCoverage=38%, HitCoverage=33%, E-value=8e-13, Identity=69%"; Hit description =Uncharacterized acetyltransferase yhbS
GLARQLVYEGLDSLNEFGYAAVAAHYDLRCRWPGTESAFQRLKGAVSGNEALFLALRQLFNPAFQPERQRPVADGGVKSQLNGSDEIEKPAHGKQIQYVKVNAP

SEQ ID NO: 119985 - protein, 102 aa, Glycine max
  Coding DNA Sequence Number=SeqID_28300
MARRDKIWSFCTLLSSRGGGPDDMRRQNLVIPHPFAIQTQSCPMARRDKIWSFYTLLSSRGGGPDDKQRPMWSFCTLRQSRPTSPLTRGDLHHLPHLQDLSY

SEQ ID NO: 119986 - protein, 146 aa, Glycine max
  Coding DNA Sequence Number=SeqID_28301
MSGFTRNSPQISASPHQLDLAPYASEPYHAQWNAPGLLHDKHTLRLSRILGEMEVDEPWLGLWLPLNHQVDMGSSLAYDNGIWGEPYRLFAAKFLFVVVFRHWKCGRQTLWFDLGMAFVDNWVVGKEKEWQSQHGLLPHSHPLHLP

SEQ ID NO: 119987 - protein, 53 aa, Glycine max
  Coding DNA Sequence Number=SeqID_28302
MRLRATWEYVSSVEEWYLEICRGGQETLGMSGGVLLPKTKLDQSRPNPGIVSQ

SEQ ID NO: 119988 - protein, 120 aa, Glycine max
  Coding DNA Sequence Number=SeqID_28303
MSYHIEGTSNGYRTMEDEEALKLGALLGRRETVRGSFSISRLPSGKSAPELENDGQKRAMNKKLKGASEEYGRRRFRGALWGATRAQAGERDPFAAYKRRVSCVRKIFGVPLSEEFGYLD

SEQ ID NO: 119989 - protein, 320 aa, Glycine max
  Coding DNA Sequence Number=SeqID_28304
MEAEIQPGGECHVLGFQEVRAERLRVVGECAHIGVQVERTLRLDFDAEAQFAQCRQQEIAALAERLAALLEDRHRFLAETGEGGMLSDARRADVQVLCQLLQIGHGRRRCHQPAQPPAGHAEVLGKTVQHERAVIHLQHAGRIQAVGQAVIDLVHHQMAAPRVQGDQRADAVGVPVLFHQRWSQLVGGFRPDRHQLRTAFHQAQEVAVARITWVGQQPVATRIDQQAAGQQQRTGAAGGDQDAFGIDVQPVVAAIETTDGLAQGRQATCGGVAGMAGGQCGLAGTHDRFGRGAVWFADFQVDHIVAGLFQRLCAGQQGHH

SEQ ID NO: 119990 - protein, 157 aa, Glycine max
  Coding DNA Sequence Number=SeqID_28305
  Gene Ontology: Mol. function=pyruvate dehydrogenase (cytochrome) activity; Cellular component=plasma membrane; Biological process =branched chain family amino acid biosynthetic process
  Homolog annotation: Hit_ID=A4TN52; Match level="QueryCoverage=100%, HitCoverage=27%, E-value=8e-61, Identity=74%"; Hit description =Pyruvate dehydrogenase
  Pfam annotation: Domain name=TPP_enzyme_M; Domain location=47-157; Score=103.4; E_value=6.8e-28; Accession=PF00205.13; Description =Thiamine pyrophosphate enzyme, centra
MRKAILNRGVSVIVLPGDVALQAAPENARSEWYPPQLPQVVPSVSELTRLAETLNEAKNITLMCGSGCAGAHAEVVKLAETLKAPVVHAMRGKEHLEYDNPYDVGMTGLIGFSSGYHAMMNADTLVLLGTQFPYRPFYPADARIIQIGVNPASLGAH

SEQ ID NO: 119991 - protein, 118 aa, Glycine max
  Coding DNA Sequence Number=SeqID_28306
  Gene Ontology: Biological process=transposition, DNA-mediated
  Homolog annotation: Hit_ID=Q1J7G7; Match level="QueryCoverage=25%, HitCoverage=42%, E-value=2e-10, Identity=100%"; Hit description =Transposase
  Subcellular localization annotation: CTP_CleavageSite=59; ConfidenceScore=5.04e-01
MVKVGTSYVPINVSFFAKKLAPGLSRDLPSQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 119992 - protein, 116 aa, Glycine max
  Coding DNA Sequence Number=SeqID_28307
MNRPTRGERRFAYWALAECILAYYVGTDEGEKKGCTGASAEYVIQDIFRFPRSLTRYARSFDCGERKWLTNGAEISWKMPGRYLTGKTIKIPGVSPWRLPRALFCSCLSVTGVIPL

SEQ ID NO: 119993 - protein, 100 aa, Glycine max
  Coding DNA Sequence Number=SeqID_28308
MDRLFTMILGFTSKLRLRCPFEYQTAVIFYPRNNFWMKFTTGSHSPIQLLCTVGRTTDGIINLLQRTMPYTHDAILYYNGEMEHATTEQICWMRVHMKKS

SEQ ID NO: 119994 - protein, 118 aa, Glycine max
  Coding DNA Sequence Number=SeqID_28309
  Gene Ontology: Cellular component=chloroplast
  Homolog annotation: Hit_ID=Q49KT9; Match level="QueryCoverage=68%, HitCoverage=88%, E-value=3e-23, Identity=62%"; Hit description =Putative uncharacterized protein ORF113
MDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 119995 - protein, 176 aa, Glycine max
  Coding DNA Sequence Number=SeqID_28310
  Homolog annotation: Hit_ID=A5AYL8; Match level="QueryCoverage=64%, HitCoverage=21%, E-value=6e-12, Identity=35%"; Hit description =Putative uncharacterized protein
MAGNPSDLQTFDPEIDRTFHRLVRHHFIPFDHPEHSITGESVHSVIGDFEHPDLEHYNFEDSDSEHSDFAHSENMAQLPPCERTLREMAAPDFTYESLCIQYPDEDVPYVLKTGLIHLLPKFHGLAGEDPHKHLKEFHIVCSTMKPPDVQEDHIFLKAFPHSLEGVAKDWLYYLAP

SEQ ID NO: 119996 - protein, 34 aa, Glycine max
  Coding DNA Sequence Number=SeqID_28311
MYDKCNFEIDMRHLENPHFLVNNALEENARIMNE

SEQ ID NO: 119997 - protein, 232 aa, Glycine max
  Coding DNA Sequence Number=SeqID_28312
  Gene Ontology: Mol. function=chloramphenicol O-acetyltransferase activity; Biological process=response to antibiotic
  Homolog annotation: Hit_ID=P62577; Match level="QueryCoverage=93%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFLRQLWCLEYFI

SEQ ID NO: 119998 - protein, 105 aa, Glycine max
  Coding DNA Sequence Number=SeqID_28313
MVLEVQTQEHRSLEQMDQWLALNSGFTCDSPQILASPHQLDLAPYASGPYNAQWNAPGLLHDKHTLRSSRILGEIEVDEPWLGLWLPLNYLVDMGASQHRTLELG

SEQ ID NO: 119999 - protein, 110 aa, Glycine max
  Coding DNA Sequence Number=SeqID_28314
  Pfam annotation: Domain name=zf-CCHC; Domain location=62-79; Score =18.9; E_value=0.0021; Accession=PF00098.14; Description=Zinc knuckle
DALKASSSIQEESDMEDSIDLDEDEELSLFVKRFNKFLRMRETQRRQNFKPKRRIEESSQTPRCYECNQLRHLRVDCPIFKKRMEKFKNKNIGENKAKKAYITWDDNDLE

SEQ ID NO: 120000 - protein, 223 aa, Glycine max
  Coding DNA Sequence Number=SeqID_28315
MNSEINNRNKMLLVNEEGKQSKKSWKLGKNCGVSFEGKDKVVEEKIEEMERKDNLEVTKAKEKFMKLIKVVNEDSHTQYKGHNEGGLGRRWMWEDIRSRKANSNIATWCVIGDFNCVRRSCERVGVGGEDINVGEKEEFNNYLVEMSLEDMPFMGKKIHMVKNSVVDWGPKSFKESDWAPQCTRQDKMSNEELKLQDPRCRIQCPGHPARKYWTHKSVISLTD

SEQ ID NO: 120001 - protein, 351 aa, Glycine max
  Coding DNA Sequence Number=SeqID_28316
EFYANLYSPKGPSPKQVRIRGHLIRIDADSLNAFLETPVVLAEGESLPAYSRYCRIPTDIREIEASLCILGRGFILNAEGHPGKILRKDLTTLAQVWSVLSYSNLAPTSHTLDLIVDRARLIFGLVTQLDMNVGALISGQIISMDQSNSSRLRGTRRPRARPAKVPATSAAPPPSRMTAAPSTLPPTDFQRFEAMLRSIHQGHIILLQRLQLVAPLDSIPTVEQFNEWVAWLGTQPPFHREDEDPATQVPHQSEDESSESSTPEPLIRKMRVVVTQKAAATSEKSLEATPELPAPVANTTSPQQAVDPSTPEDQTTPVLSLNTSPVATPVLHLSKEEEGQTQDTQDQSQDI

SEQ ID NO: 120002 - protein, 208 aa, Glycine max
  Coding DNA Sequence Number=SeqID_28317
MDNVEGVQEQMKADLSALKDQMASISEVMLKLQKTIEDKATATASSTVREAKPVLQPALNPGLDRNTVVFGRRYSPQAYPYGLPPDFTPRATPKDLSQAPTFEGQLPPYEDYPGQDDGEGDTHLGPLLHLKDPSSHEPPQPNIVRHIPASPTPVKQFVPFAEDKGKIEALEERLRAVEGLGNYPFSDLADLCLVPKHRYPSQVQSTRL

SEQ ID NO: 120003 - protein, 123 aa, Glycine max
  Coding DNA Sequence Number=SeqID_28318
EGANCKEEQANKKRKEVVLEPDDDPGHLRANVFQEGGNDENPKTGQIQAKGPSGEGRRPKWRRIKPPSNHCGVYPDLSSFTGSGVYPDLSSFIGSGVNQISVACIKRSAPCGAGIEEEEPTDL

SEQ ID NO: 120004 - protein, 138 aa, Glycine max
  Coding DNA Sequence Number=SeqID_28319
MSSAKIQASWWPWEKHMTEARPYTMWLMQTMFMRAPIQLKTLKLLDRYMDELSQRDGLGSVYEFLEPQAILNTNDRRGQCQEYIEKWLKESNRHVYLGAYLNKAHWQLIVLCPTKNIVVWFCSLRRRPNVHIKATINK

SEQ ID NO: 120005 - protein, 294 aa, Glycine max
  Coding DNA Sequence Number=SeqID_28320
  Gene Ontology: Mol. function=transporter activity; Cellular component= integral to membrane; Biological process=transport
  Homolog annotation: Hit_ID=Q5PCZ3; Match level="QueryCoverage=100%, HitCoverage=91%, E-value=1e-140, Identity=84%"; Hit description =Peptide transport system permease protein SapB
  Pfam annotation: Domain name=BPD_transp_1; Domain location=47-288; Score=176.0; E_value=9.8e-50; Accession=PF00528.13; Description =Binding-protein-dependent transport s
YFTPHAPLQGASLWNAWLFWFKGVLHWDFGVSSINGQLISEQLKVVFPATMELCILAFGFALLVGIPVGMIAGIMRNKWPDTLISALALVGFSIPVFWLALLFTLFFSLTLGWLPVSGRFDLLYEVKTVTGFALIDAWLSDSPWRHEMIVSAARHMVLPVLTLAVAPTTEVIRLMRISTSEVYDTNYVKAAATRGVTRRTILHRHVLHNALPPVIPRLGLQFSTMLTLAMITEMVFSWPGLGRWLINAIRQQDYAAISAGVMVIGALVIIVNVISDILGAMANPLKHKEWYALR

SEQ ID NO: 120006 - protein, 59 aa, Glycine max
  Coding DNA Sequence Number=SeqID_28321
MGKRKLELGFEDQKIDFDLFVEDKPAPEHNFCLQELAIPFAKPKPCAKRIFVHALSHES

SEQ ID NO: 120007 - protein, 28 aa, Glycine max
  Coding DNA Sequence Number=SeqID_28322
MKAQMQSALPRLLIVAEGPNKLEGPNTL

SEQ ID NO: 120008 - protein, 161 aa, Glycine max
  Coding DNA Sequence Number=SeqID_28323
  Homolog annotation: Hit_ID=A5BSR3; Match level="QueryCoverage=80%, HitCoverage=41%, E-value=3e-10, Identity=28%"; Hit description =Putative uncharacterized protein
MGSPPASTPPPPPPPPLYFGRIGFDVCRKADGPHKKKLRTYLGIVARDKVDITYENWKEVPTAQKDLIWEDIQDMRMKAQAIQKQNTAPHILSRGGYDYLEQKLQAEKTKKKMQEATQSGSVDGVINPPSPVRRHVKWKMARTKKTGEMTTEAAKEIAEKI

SEQ ID NO: 120009 - protein, 52 aa, Glycine max
  Coding DNA Sequence Number=SeqID_28324
MDDEERLKIFTESPTEIKIGEELATLLTQASQVASSRSNRLLEEESGRPKWV

SEQ ID NO: 120010 - protein, 98 aa, Glycine max
  Coding DNA Sequence Number=SeqID_28325
MVINLQVGIRSVCLWATHMTRKRWKLYDLETKEIVVSRDVEFVETKYPFTMDVTTKEDVLPKNGSCEEIVSDVTDGVEETDHTGGTEESGDITTNDRW

SEQ ID NO: 120011 - protein, 93 aa, Glycine max
  Coding DNA Sequence Number=SeqID_28326
MGDPLVLEEGQECEFSQRRNRADGFDEEAIAQLLCIPGQDFARTATGRRVQIMRTSMPPTRHPLDPDKSNRALGFPALITGLCSCLQSGSAHD

SEQ ID NO: 120012 - protein, 145 aa, Glycine max
  Coding DNA Sequence Number=SeqID_28327
  Homolog annotation: Hit_ID=Q2HST2; Match level="QueryCoverage=93%, HitCoverage=24%, E-value=6e-08, Identity=33%"; Hit description =Peptidase aspartic, active site
  Subcellular localization annotation: CTP_CleavageSite=32; ConfidenceScore=5.24e-01
MYPPTAPKPTPFSYQSNKAVPWKYTPPAFGERAATEVDSLSAKVTNITGLSGVTHSGRVFAPPHSAELPSKGKATMIQEPADAATPSKEVDPLVVKGAEKKECLQGKAVTLEEAHEFLRLIQQCEFKVVEQLNKTPAMISLLNCS

SEQ ID NO: 120013 - protein, 192 aa, Glycine max
  Coding DNA Sequence Number=SeqID_28328
  Gene Ontology: Mol. function=protein serine/threonine kinase activity; Biological process=protein amino acid phosphorylation
  Homolog annotation: Hit_ID=A2YNT8; Match level="QueryCoverage=23%, HitCoverage=13%, E-value=7e-12, Identity=71%"; Hit description =Serine/threonine-protein kinase SAPK2
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLSRIFVANPEKRITIPEIKMHPWFLKNLPLEFMDESEGVLQNDDVNDDSSETQSIEEILSIIQEARVPSSNS

SEQ ID NO: 120014 - protein, 100 aa, Glycine max
  Coding DNA Sequence Number=SeqID_28329
  Gene Ontology: Mol. function=transcription factor activity; Biological process=regulation of transcription, DNA-dependent
  Homolog annotation: Hit_ID=A8GGF1; Match level="QueryCoverage=100%, HitCoverage=33%, E-value=3e-43, Identity=88%"; Hit description =Transcriptional regulator, LysR family
MAFLDDYPQMQIEMVLNDRNLDLIDEGLDIAVRIGHLQDSSRVARRLGQVSRVTVASPAYLARCGEPRSPAQLAEHATIAGTQRPSLREWRFGPQENGER

SEQ ID NO: 120015 - protein, 120 aa, Glycine max
  Coding DNA Sequence Number=SeqID_28330
MVDTAFLLTGRGQHTLAVNERNPAMWKLIISFFGRVYGSIRRVGHIRGGGAAGQPGGGRAQTAALGAGDHPGDRRAGTAVRHPTGGTHHPAAGAYRSGRAPAGARATAAAGLSGGGAGYR

SEQ ID NO: 120016 - protein, 68 aa, Glycine max
  Coding DNA Sequence Number=SeqID_28331
MKNMVEFAPSSFADLVFASKRIEVGLKRGKFDHPALMNEKTGANEEDKNEEGTHVEAAIPTWSNFPSA

SEQ ID NO: 120017 - protein, 77 aa, Glycine max
  Coding DNA Sequence Number=SeqID_28332
MVIEESIHVAFDETNPIRPRKETLDDVTDSLEDMHINEKGYKGKGNGNEEDLQIDETKTSKDTDLPKEWTTSRYQSS

SEQ ID NO: 120018 - protein, 126 aa, Glycine max
  Coding DNA Sequence Number=SeqID_28333
  Gene Ontology: Mol. function=hydrolase activity; Cellular component =membrane; Biological process=metabolic process
  Homolog annotation: Hit_ID=P0A8Y6; Match level="QueryCoverage=100%, HitCoverage=46%, E-value=1e-53, Identity=82%"; Hit description =Phosphatase yidA
  Pfam annotation: Domain name=Hydrolase_3; Domain location=6-126; Score=-76.1; E_value=0.04; Accession=PF08282.3; Description=haloacid dehalogenase-like hydrolase
MAIKLIAIDMDGTLLLPDHTISPAVKTAIAAARARGVNVVLTTGRPYAGVHSYLKELHMEQPGDYCITYNGALVQKASDGSTVAQTALSYDDYRFLEQLSRDVGSHFHALDRNTLYTANRDISYYT

SEQ ID NO: 120019 - protein, 116 aa, Glycine max
  Coding DNA Sequence Number=SeqID_28334
MIMRGQDIYSSQDEATMSPSSSESEEAKGEESSEEIYPHEEEQPLMVKEECKEVSVSSKSDQGVPTGPKRIKVIPDWPTPPSVEGRSTEYEEPQDLRSNPFQHGGDDAILPPKGIG

SEQ ID NO: 120020 - protein, 33 aa, Glycine max
  Coding DNA Sequence Number=SeqID_28335
TSLSNALSKECGSDFVKDFTKIVEISSGLLEYW

SEQ ID NO: 120021 - protein, 120 aa, Glycine max
  Coding DNA Sequence Number=SeqID_28336
  Gene Ontology: Mol. function=nucleoside-triphosphatase activity; Cellular component=integral to membrane; Biological process=transport
  Homolog annotation: Hit_ID=A7P7L7; Match level="QueryCoverage=63%, HitCoverage=5%, E-value=7e-27, Identity=77%"; Hit description =Chromosome chr9 scaffold_7, whole genome shotgun sequence
MEKSLLIVEEANLSSRSFSRRVSDDKANRSGRKGMVLPFQPLSLTFDEIKYSLDMPQEMKKQGVFEEHRELLKGVSGVFRPRVLTALMGVSGAGKTTLMDVTFEVGKGANICWSIRPPLF

SEQ ID NO: 120022 - protein, 51 aa, Glycine max
  Coding DNA Sequence Number=SeqID_28337
ACSELQNKERETMLKRAIKGINSRYACELGSINKNQAKAIVQAINGAKHTK

SEQ ID NO: 120023 - protein, 297 aa, Glycine max
  Coding DNA Sequence Number=SeqID_28338
  Gene Ontology: Mol. function=phosphoprotein phosphatase activity
  Homolog annotation: Hit_ID=A5APQ3; Match level="QueryCoverage=29%, HitCoverage=5%, E-value=3e-15, Identity=41%"; Hit description =Putative uncharacterized protein
WHQPDRVLRQFGMQQPVPESPSQPLNIHGITLKGKHDENWGQLFAPMIQQWNNRHAFRVDAYPRQEGLLSFNSDYMVWYRRKTKMFVDPENAKTATLAEVAETLQYMVSPQGRNTWTIDDLVPYVEKITILSEEQERVTEPVSHGPASERQFPAQQFHMLQSSIETQGIDRRRDTVEAEEYSQQMAERGHGMYYTPQTFAEYPTQMYQYPFQDHHTDTSASQQSFGGFAETQAHFSWPTMTPSQQYHGPIPTPNAPLTKKKRGGIGAEEILIAKLEDRIDHVAHPHGITDTKMNDLH

SEQ ID NO: 120024 - protein, 51 aa, Glycine max
  Coding DNA Sequence Number=SeqID_28339
MFWDLRLVVSFKTRKGKQGSKGLSKELIQGSINKNQAKAIVQAGNEAKHTK

SEQ ID NO: 120025 - protein, 90 aa, Glycine max
  Coding DNA Sequence Number=SeqID_28340
MLGNWLSATPFKKFLFVEETNKILVLLLPINNSQQQVLMHGTSVERTVAFGKPCPMSEVPRMDIRLTQLEEDVGYIRQSFDLPPPPPPPS

SEQ ID NO: 120026 - protein, 92 aa, Glycine max
  Coding DNA Sequence Number=SeqID_28341
  Subcellular localization annotation: CTP_CleavageSite=48; ConfidenceScore=5.64e-01
MSFPTPSFFQNHFQRPKILLHHPQPPVATTNSHSSPLKPHTERNPSIRVESSKLALLFRLRTNPILTFTVFFKLVFASFLILEPPLYVLRFL

SEQ ID NO: 120027 - protein, 71 aa, Glycine max
  Coding DNA Sequence Number=SeqID_28342
MGVQIAPRPTWALRNIPPEGGCFWRKQPCSPGRAELAWASWGGRQEGRGSAPLALLSLSNLLGKIVSVKPI

SEQ ID NO: 120028 - protein, 108 aa, Glycine max
  Coding DNA Sequence Number=SeqID_28343
QLEVGNRGWWVYARIVDEESLLCTIARPPPSTTCDGVKLPALIVDHRVVPGDMSRGSGDLGDVRRAPGSQQIKGKQDHKARRLVVAGQLLENEVRKLGKPLVIDYQGV

SEQ ID NO: 120029 - protein, 130 aa, Glycine max
  Coding DNA Sequence Number=SeqID_28344
QLGYPMRGVPSDESITPFIARGFGDHNARVLQGVRKAWDAANGIIGGYHKWLRVRTQGLDWLPNLKTVRDDEVKTSEESDEVQALKAELERARVVEEKFKAAIVSSSSEEVKGIITGQRQDLEGRAKGLP

SEQ ID NO: 120030 - protein, 88 aa, Glycine max
  Coding DNA Sequence Number=SeqID_28345
MFVFNNDLKGLDDTQQSKSKPPARWITVKCNRQKGNTECGYYVMHWMSTIILGNFQNNWEMYFTDPRPLEPERLKAFRIQWAKYLFES

SEQ ID NO: 120031 - protein, 84 aa, Glycine max
  Coding DNA Sequence Number=SeqID_28346
MHTQSFTIPQFFKIDLTHKNSPVESPTVATCPFAGERGEAHGCAFQRRKDARSRHQRLFVENVGKTEGNRSKMKNSKFGSYIYV

SEQ ID NO: 120032 - protein, 20 aa, Glycine max
  Coding DNA Sequence Number=SeqID_28347
FYPMPFGGRIASVASESNSA

SEQ ID NO: 120033 - protein, 349 aa, Glycine max
  Coding DNA Sequence Number=SeqID_28348
  Homolog annotation: Hit_ID=Q2HW90; Match level="QueryCoverage=57%, HitCoverage=38%, E-value=8e-22, Identity=34%"; Hit description =Putative uncharacterized protein
MGTNQTGKRFYQVKVKGLDVTSLKELGRLMGPLQRQAFRKVYGKILDLTAAEVFIEAVVSLTQYYDQPLRMPSWGEKTVSFLRVSSLLEQDCSCGWRFGKRVGSHEANSQRCSRPATEILGRQGKRYGEPREVGPICGYISFVDFLGVVLFPNVDGLVDLAAIDAFLAYHHSKESPVVAILADLFDTFDRRCEKNSAWIVCCLPALCVWLVSHLFQQDTRHPCPLQSYRSCAKKGRVDWDQHLAGIGGSAINWFPRWKEGKEGVLFSCGDYPNVPLIGTRGCINYNPALAIRQLGYPMRGAPTEGSLSPFLVKDLGAQGLKVIQRVHKAWRSPLRKYKELRGIRNGVIG

SEQ ID NO: 120034 - protein, 127 aa, Glycine max
  Coding DNA Sequence Number=SeqID_28349
MHALLGSFNSGNWSDSKVLGSTGLSCCAITRDQGTLVPLDLELKATLRRNRAKRRRKLLQDRTIASILEEETHFSDSLSPDSPSSRESANQYSEAITMADEHDQRTTLEDYSSGSVPQFFTSIARPE

SEQ ID NO: 120035 - protein, 65 aa, Glycine max
  Coding DNA Sequence Number=SeqID_28350
MHEVATNVYSRKNVGKTKTCGLRTLIVKGLGVVFTHGEGCFPRSYVSSIAMGNLTYVVLLELNVG

SEQ ID NO: 120036 - protein, 214 aa, Glycine max
  Coding DNA Sequence Number=SeqID_28351
  Homolog annotation: Hit_ID=Q6WAY4; Match level="QueryCoverage=57%, HitCoverage=22%, E-value=1e-12, Identity=33%"; Hit description =Putative uncharacterized protein
MGSSQKPSLEKRFYQVKIKSLEVTSLRKLGQLMGQLQRQAFRKAYGKIWDLARVEVSMEPIASLSQYYDQPLRCFTFEDFQLVPTVKEFEEILGCPLGGRKPYLFSGFYPSTTRVAKVVKILAQELDRQRQVENGVVGIPRKYLEPTYMTPSTKDVKKAMQGLFAVLQLSMWGWFHTFFSKKVGPSIRYKVTARASKKERRIGTNSWLAWGGVC

SEQ ID NO: 120037 - protein, 126 aa, Glycine max
  Coding DNA Sequence Number=SeqID_28352
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQ

SEQ ID NO: 120038 - protein, 190 aa, Glycine max
  Coding DNA Sequence Number=SeqID_28353
MNSNVGRNPPMKELLEFALIPMTYGDLLPSLIANQLAVSADKESPKKPKPLVIHFTRDAAPQNRRGPSTLSGSKPVPFPYKNSKAVPWRYTPQKPSERKEKATGNDSLSAKVANIIGLSGVTHSGRIFAAPDLSVQPANAKGKAKMIVEEANEADPTLDEDVIMGRFAEKGEGLDKKEVSLEKGQRVPPV

SEQ ID NO: 120039 - protein, 144 aa, Glycine max
  Coding DNA Sequence Number=SeqID_28354
CETRGLARRRETVDAATYSLPPMPERQHGMYYTPPAFTQEPSQMPPMYSYPHDFQPGYSFAGIFGSSPPSTGTPSFTQSGQVSTPNAPLASPWNVPGDIPDMDDLLGVDLRHDFSNKWMKGQIVEEEILIGQLEIGTGHVGLRR

SEQ ID NO: 120040 - protein, 353 aa, Glycine max
  Coding DNA Sequence Number=SeqID_28355
  Homolog annotation: Hit_ID=Q3JX16; Match level="QueryCoverage=51%, HitCoverage=14%, E-value=7e-07, Identity=32%"; Hit description =Planctomycete extracellular domain protein
AEHLGDAHGAVAQHLVVLQLGKQQRVLAIRIATVGVGRGHPFRVGDQYIDVTGGVARGRQRPLVAGLRRRIDGQRHAHLGGQVQRSGGRRARGRTVVHLSAFRQARHAVIGAVETDFVVLGVDVVHVRERAGKLRAALVVGIRHALGVPDAEEIGAGIAGRIQALAMLRVERHGQAHRHLAQLGLHEVQRAGAELQQATQLAAGDFGVIQLDRHGLATGTGRQGVGDDGAADILGRRHGLQRIDGFARQQRLAARGQRDVELVALLVGGDADQLVQFGDGLVALVQQVVGRVARALAARDGDLAVQVVDAGPGAGSASPGRPSGSGWSGCWPCPAGPGARRDPPACWPRCSCW

SEQ ID NO: 120041 - protein, 59 aa, Glycine max
  Coding DNA Sequence Number=SeqID_28356
MHLCDQEESRRKRQRRCQFKEKMSLEDAQHHKRPWIRASRKKEMNEGMGREEHEILCSK

SEQ ID NO: 120042 - protein, 119 aa, Glycine max
  Coding DNA Sequence Number=SeqID_28357
  Subcellular localization annotation: CTP_CleavageSite=58; ConfidenceScore=5.03e-01
MAKKPTSNCFFTSSLILKDISSFILLSFCFTGEHPGFKGSLCCTILMQSYPARALGSRLQVDWARDPREGPRVLMSLREVSLAIRELLKEVFSKKLLKEVFSRKLLKEVFSRKLLKEAT

SEQ ID NO: 120043 - protein, 88 aa, Glycine max
  Coding DNA Sequence Number=SeqID_28358
  Gene Ontology: Cellular component=chloroplast
  Homolog annotation: Hit_ID=A8SIB0; Match level="QueryCoverage=65%, HitCoverage=47%, E-value=3e-13, Identity=63%"; Hit description =Putative uncharacterized protein
MKPESLVIAGQPYGGDSFPGIVHTARHTMGAGHARSRYLNRKEGDAEGRASDWSEVVTSHMDSLMCSSAPDPEMWIIQGTLAWRTSPV

SEQ ID NO: 120044 - protein, 225 aa, Glycine max
  Coding DNA Sequence Number=SeqID_28359
MAVLGETSSQTIVNSRLGFIFPNGSIIHNDTGVYFQTSTLVPIRVPNSCDFASLKIRIHNTLQLSDKQFLDETHFQCMKLINDDDVNTMLMCNDQFSCVGPIELLCTIGRTPDGVINLLQRTMPRTHDAILYYNRKWNMAPQNKLVGCAFTGKNPKKFQIPSTCTIDELKDLIKQVTPKGIPPLGIHESQTVRRLFFCQPGRFEYSDKLIKYEINELKTNKELLK

SEQ ID NO: 120045 - protein, 112 aa, Glycine max
  Coding DNA Sequence Number=SeqID_28360
NGTHKDTQWTRRSPTGPWGFQLWLRASVVLQGARSSRQGHVIIGIAPARHPVDPKKSNRVLELSSSNYGSLSTASPGRHRAKLPQQPGDGQQRAVDAPPSPLEFTSAHPQKG

SEQ ID NO: 120046 - protein, 47 aa, Glycine max
  Coding DNA Sequence Number=SeqID_28361
MTFAALGNDIHGAPKKVEYGELANSARQRHSRGSRLEGGGHMNSARQ

SEQ ID NO: 120047 - protein, 92 aa, Glycine max
  Coding DNA Sequence Number=SeqID_28362
MASSTCFQQISSQITIMKQKPSKTTHHISQNPIPTKIKDALHDSENAFLSRFGAEMGTKGWSFNGVSMEDEEEDNGNVREREKSFLKFSLAE

SEQ ID NO: 120048 - protein, 60 aa, Glycine max
  Coding DNA Sequence Number=SeqID_28363
MSNEEVKLQDPRCRIQCPDILPENTGVAAQCISQDKLSNFFRRDRSLQHQEVAAQNRTRL

SEQ ID NO: 120049 - protein, 44 aa, Glycine max; identical to SEQ ID NO: 109380
  Coding DNA Sequence Number=SeqID_28364

SEQ ID NO: 120050 - protein, 24 aa, Glycine max
  Coding DNA Sequence Number=SeqID_28365
LIHHLESGRERAWKNQNKKLAMTG

SEQ ID NO: 120051 - protein, 45 aa, Glycine max
  Coding DNA Sequence Number=SeqID_28366
MKKAYITWDDNDMESSEDSENEEINLCLMAKSYESDEENQLNLQC

SEQ ID NO: 120052 - protein, 87 aa, Glycine max
  Coding DNA Sequence Number=SeqID_28367
MSPVESPTVATCPFAGERRRGSRVRFPKEERCAESPPTFICGKHRKIEGNGRNENLSSGVVFTFEEGRQKRGFCSYVPSIEEEIRPT

SEQ ID NO: 120053 - protein, 87 aa, Glycine max
  Coding DNA Sequence Number=SeqID_28368
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=78%, HitCoverage=33%, E-value=4e-25, Identity=74%"; Hit description=MADS -box protein GmNMH7
  Pfam annotation: Domain name=SRF-TF; Domain location=9-45; Score =33.0; E_value=1.1e-06; Accession=PF00319.9; Description=SRF-type transcription factor (DNA-binding and dimerisation domain)
MARGKIQIKRIENTTKKANELTVLCDAKVSIIMFSSTGKLHKIEQSTKQFFDQYQMTLGVDIWNSHYEVLSFLFFRFTSACCFGSCN

SEQ ID NO: 120054 - protein, 29 aa, Glycine max
  Coding DNA Sequence Number=SeqID_28369
MGAKYLKVVKRGSHPNNGWSPDEIRIGHA

SEQ ID NO: 120055 - protein, 126 aa, Glycine max
  Coding DNA Sequence Number=SeqID_28370
MPISPCRSISWSVPSRHRGHAHKTPSGLGEIQQGPGVSSSGYGPLSVLQGARTPRQGIAPAGHPVDPKKSNRVLGLPALITGLCQFYEVPITPSKVIRPPTNRAFINKYCAPRQAEGKTPQQPGDG

SEQ ID NO: 120056 - protein, 40 aa, Glycine max
  Coding DNA Sequence Number=SeqID_28371
MKKILGLQAPMELASQTWNWKEDWCHPLKNLSQEERGQPP

SEQ ID NO: 120057 - protein, 128 aa, Glycine max
  Coding DNA Sequence Number=SeqID_28372
  Gene Ontology: Mol. function=metal ion binding; Cellular component =nucleus; Biological process=chromatin modification
  Homolog annotation: Hit_ID=A7PXJ3; Match level="QueryCoverage=30%, HitCoverage=8%, E-value=3e-10, Identity=74%"; Hit description =Chromosome chr12 scaffold_36, whole genome shotgun sequence
MKTITSSFQGMSNQAAPRWVEPKSHVQTGAYECGYYVMHWMWCIVTGGLKDDWNKNCRFICRHGLQRGGTGSEGPHVVGAQHPLKKIDCLVCSFCFRFVGSIELEIGRRLYMQQLRANESHGCDVGSS

SEQ ID NO: 120058 - protein, 62 aa, Glycine max
  Coding DNA Sequence Number=SeqID_28373
MGLLLKQRNQDHTKKIIEHGDVKIEKVDGKENAADPFTKALGKKEFDKHKWELGMKFMNDWL

SEQ ID NO: 120059 - protein, 97 aa, Glycine max
  Coding DNA Sequence Number=SeqID_28374
  Subcellular localization annotation: CTP_CleavageSite=67; ConfidenceScore=5.04e-01
MGALITNDGSRDSKPAKKIRSNKIHNNLGIVSSGGLTSATDSPRILEDSGCRNLPFGERAMRDSRVCAPRKEYARSRHQRLFEENVGKTGKDVIYEF

SEQ ID NO: 120060 - protein, 258 aa, Glycine max
  Coding DNA Sequence Number=SeqID_28375
MRGAGTEERHEWLRVHTRGLDWLSKLKIINEEKFEALEEDEEVQALKSELGKARLTKEKFKLVAIDIRKECARLREENAATARALERETKRARKEEHGQDKFRGALWGSNNELKLWREERDQSRVHDMVLKEELAACSRSKRSLAQHLEATEQSMLAIIGELTITKKAQWNPYNTRSRSKMENEEGVQEQMKADLSALKDQMASITEAMLRLQKTIEDNATKAASNTAREAEPVLQLAINLGRDRGKRDGSYEIRKIL

SEQ ID NO: 120061 - protein, 73 aa, Glycine max
  Coding DNA Sequence Number=SeqID_28376
MVADISRVHLWSPVEDPSAYAWPTPEQFEAAVGMRGPVEMEGKINEFQEPLDLRSNPFQGGGNDAILPPKGIG

SEQ ID NO: 120062 - protein, 282 aa, Glycine max
  Coding DNA Sequence Number=SeqID_28377
  Gene Ontology: Mol. function=L-rhamnose isomerase activity; Cellular component=cytoplasm; Biological process=rhamnose metabolic process
  Homolog annotation: Hit_ID=A1AI80; Match level="QueryCoverage=100%, HitCoverage=67%, E-value=1e-138, Identity=84%"; Hit description=L -rhamnose isomerase
  Pfam annotation: Domain name=RhaA; Domain location=1-281; Score =538.7; E_value=6.5e-159; Accession=PF06134.2; Description=L-rhamnose isomerase (RhaA)
MSLIPGAKRLNLHAIYLESDRPVERDAIEPQHFSNWLEWAKSRQLGLDFNPTCFSHALSADGFTLSHADPGIRQFWIDHCTASRRISAWFGEQLGTPSVMNIWVPDGMKDLTVDRLAPRQRLASALDEIIREPLNPQHHIDAVESKLFGIGAESYTVGSSEFCLGYATSRQTALTLDAGHFHPTEVISDKISSAMLFAPRLLLHVSRPVRWDSDHVVLLDDETQAIASEIARQKLFDRVHIGLDFFDASINRIAAWVIGTRNTQKALLRALLEPGEQLRQRE

SEQ ID NO: 120063 - protein, 104 aa, Glycine max
  Coding DNA Sequence Number=SeqID_28378
MNGSGMEKEEREEMPLQGEDESRRSSLDDLLHQWIPLLLGRGMAAKRRRKRERKHHFKEKMSLEEAHHHRRPWIRAWRKKEMNEGRGREEHEILCSKRALKSEV

SEQ ID NO: 120064 - protein, 97 aa, Glycine max
  Coding DNA Sequence Number=SeqID_28379
MVAITPTKVHQPPFFREYDSNATCACHGEAPGRSIEHCRALKRKVQGLIDMGWLKFEENRVIFNFHRKWVQAIGQFARATYAPEFGTSKTVGGPAVK

SEQ ID NO: 120065 - protein, 122 aa, Glycine max
  Coding DNA Sequence Number=SeqID_28380
MIMRSQDIYCSQDESTMSPSSSESEEAKGEESSEEIYPQEEGQPLMVKEECKEVSVSSKSDQGVPTDLKRIKVIPDWPTPPSIREIWGCHDLTNFYTRCRGKEPRVCRTSGFEVKSFPRWRG

SEQ ID NO: 120066 - protein, 66 aa, Glycine max
  Coding DNA Sequence Number=SeqID_28381
RGLSQRALHGRAKARLTGALSKGGKMRGVATNEGISTSHVDKSGALSPTYPPSKRKSDLRSSSFLS

SEQ ID NO: 120067 - protein, 81 aa, Glycine max
  Coding DNA Sequence Number=SeqID_28382
MAAEWRRKRERRRHFKEKMSLEEAHHHRRPWIRAWRKKEMNEGRGREEHKILCSKRALKSEPTNPRSIPRFSTKCLRCHEA

SEQ ID NO: 120068 - protein, 100 aa, Glycine max
  Coding DNA Sequence Number=SeqID_28383
  Homolog annotation: Hit_ID=Q5XM22; Match level="QueryCoverage=83%, HitCoverage=46%, E-value=3e-26, Identity=72%"; Hit description =Resistance-like protein HAAS-2
MKCQAQLWIAAARAYLLHLVGCTLFANKSATYVHVVHLDAFRDLGQSGGYAWGVVALVHMYDQLDEASRTTTRQIAGYLTLFQMCPGCRTLSIGGLGALS

SEQ ID NO: 120069 - protein, 210 aa, Glycine max
  Coding DNA Sequence Number=SeqID_28384
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
LSGFATSDLSVDFCDARQGGGAYGKTPATRPFYGSWPFAGLLLTCSFLRYPLILWITVLPPLSELIPLAAAERPSAARAYRWKGNTSSSSNPFSTKFIALQSILAQKDALKAMVTSKDWTSSAYAKEAKAKRFMEQVLDSRFWKACAEIVKLTKPLMRMQAWHWPSFYNVVTGKTLALPNLIALQHIPLSPAGVIAKRPAPIALPNSCAA

SEQ ID NO: 120070 - protein, 120 aa, Glycine max
  Coding DNA Sequence Number=SeqID_28385
VGGQLIIVSGEEDILVSWLSATPDVEEAEESLEIAFQALEVMDNAYVEIALGRNGDGMVTLLEIAKNRGRFGLGYKPTNTDKRRTTLERKEKCLACLQGHEPRIERSLSAALAKASGVRD

SEQ ID NO: 120071 - protein, 168 aa, Glycine max
  Coding DNA Sequence Number=SeqID_28386
MVSPQGRNTWTVDDLMPYVEKLAIISEEQERIIEPVSHGPTSEREFSAQEFHILQSSVETRGIGRRRELVEAEQYSQQMMERGHGMYYTPATFSQYPSQMYQYSFEGHHTDTSASEHSFGGVAETQSHFSWPTMTPSQQHDAPMATPNAPFALQWHVPEAIPHMGDLL

SEQ ID NO: 120072 - protein, 107 aa, Glycine max
  Coding DNA Sequence Number=SeqID_28387
VDPWVLVPIAFRGLHILAFRGLHVLTLRGLHVLALRGLHVLTIRGLHALTSRGLHVLALRGLPALALGTSYPHLQRTTCPHLRRGLHALTFRGLHILALTEGCTSSP

SEQ ID NO: 120073 - protein, 227 aa, Glycine max
  Coding DNA Sequence Number=SeqID_28388
MKREKHVSYSSHNSCKSLSEELRDYYEGRHRSHLRPHSHRRENERKPQEVNIKLPYFHGKDNVEANLDWEIRVEQQLKRKSTSKSYGSHSYPKKDQGQGILGVRHSKPKDDKGKTIEKKPLKASMQEKTSSMNKSEEAKGEESSEEIYPQEEGQPLMVKEECKEVSVSSKRLAKKERHFEIKTNIKEISLLRQPPHFLLCKETLVSLATSLRLEFIPQVKELLDEGL

SEQ ID NO: 120074 - protein, 183 aa, Glycine max
  Coding DNA Sequence Number=SeqID_28389
MASITEAMLKIQKSIEDNATVTASNTAREAEPVLQPAMNLGRDRSATGFNQSYSPQAYPYGFPPDFTPRTAPDDLSQAPTFEGQLPPHVDYPLQEDDEGDSHLDLLLPQRESAPHELPQPNIIRHAPSQFTLVKELVPISKDKGKIDLLEERLRAVEGLGNYPFSDLADLCLVPDIIIPPKFK

SEQ ID NO: 120075 - protein, 140 aa, Glycine max
  Coding DNA Sequence Number=SeqID_28390
MGSKIYPKVHENPKAFFISFSPILVQPLGKIASPFASSLSFEEGEVVASSWLLYISWLLIIMVFLVHLRLTHPWAKRASTAKRNFSVLSTTEEFGRASSSRLRAKHEISAPSATIVFSQAQRTTGAKLKSTYSHLARGWR

SEQ ID NO: 120076 - protein, 175 aa, Glycine max
  Coding DNA Sequence Number=SeqID_28391
  Gene Ontology: Mol. function=hydrolase activity; Cellular component =membrane fraction; Biological process=metabolic process
  Homolog annotation: Hit_ID=A6X634; Match level="QueryCoverage=99%, HitCoverage=76%, E-value=2e-84, Identity=88%"; Hit description =Isochorismatase hydrolase
  Pfam annotation: Domain name=Isochorismatase; Domain location=1-126; Score=-18.5; E_value=7.1e-05; Accession=PF00857.11; Description =Isochorismatase family
MATLTKMPVITTASVPQGPNGPLIPEIHQNAPHAKYVARRGEINAWDNPDFVAAVKATGRKQLIIAGTITSVCMAFPSIAAVADGYQVFAVIDASGTYSKMAQEITLARVVQAGVVPMDTAAVASELQRTWHRDDAAQWAEIYGGIFPSYQLLAESYAKAQDVERNQEALDSQRA

SEQ ID NO: 120077 - protein, 151 aa, Glycine max
  Coding DNA Sequence Number=SeqID_28392
MGDQEEVQEQMKADMSALKEQMASMMDAMLGMRQLMENNAATAAAVSSAAEADPTLPATAHHPILNVVGRERNTLGHVSNPHSGYNRVAYPYGLPPNYTPPGSLLDSRTRSTRIVESMPKETSIPTPRSPPRGQHPTHYLSPTSRENLETT

SEQ ID NO: 120078 - protein, 88 aa, Glycine max
  Coding DNA Sequence Number=SeqID_28393
  Homolog annotation: Hit_ID=B0HC01; Match level="QueryCoverage=39%, HitCoverage=74%, E-value=3e-12, Identity=100%"; Hit description =Putative uncharacterized protein
MAISRVLPGWTQDDSYRIRRSGRAERGGGGAYGKTPATRPFYGSWPFAGLLLTCSFLRYPLILWITVLPPLSELIPLAAAERPSAASQ

SEQ ID NO: 120079 - protein, 81 aa, Glycine max
  Coding DNA Sequence Number=SeqID_28394
  Homolog annotation: Hit_ID=UPI0000ECBAF8; Match level="QueryCoverage =50%, HitCoverage=48%, E-value=1e-16, Identity=100%"; Hit description= UPI0000ECBAF8 related cluster
MKSEMLMFAIFPGLCYFERSYFASIMGSGMQAWHWPSFYNVVTGKTLALPNLIALQHIPLSPAGVIAKRPAPIALPNSCAA

SEQ ID NO: 120080 - protein, 238 aa, Glycine max
  Coding DNA Sequence Number=SeqID_28395
  Homolog annotation: Hit_ID=Q6WAY4; Match level="QueryCoverage=90%, HitCoverage=38%, E-value=2e-23, Identity=33%"; Hit description =Putative uncharacterized protein
MGTNQTGKRFYQVKIKGLDITSIKKLGRLMGPLQMQAFRKAYGKILDWTIAEISTEAIVSLTQYYDQPLRCFTFGDFQLVPTVEEFEEILGCPLGGRKPYLFSECLPSLSKIAVVVKDSARELDRVKQTRNGVVRLPRKYLEGKARDMANQEKWVPFMDVLALLIFGVVLFPNMDGLVDLAAIDAFLAYHQSKESPILAILTNLFDTFDRRCEKSSARIICFLPALYVWLVSHLSSKT

SEQ ID NO: 120081 - protein, 43 aa, Glycine max
  Coding DNA Sequence Number=SeqID_28396
MGRADPYRNSKFILRPETNSKLFRIHFRIFPVSSPYAMATFTI

SEQ ID NO: 120082 - protein, 80 aa, Glycine max
  Coding DNA Sequence Number=SeqID_28397
MTIKGGDEGTASSSREECGFTTGDCGLCLIINYLRNKLCSIGTKVSELWTFCPTVTDEGAGVDDKGMSSVLVIFLDAICN

SEQ ID NO: 120083 - protein, 415 aa, Glycine max
  Coding DNA Sequence Number=SeqID_28398
  Gene Ontology: Mol. function=drug transporter activity; Cellular component=membrane; Biological process=multidrug transport
  Homolog annotation: Hit_ID=A7QZN3; Match level="QueryCoverage=93%, HitCoverage=77%, E-value=1e-137, Identity=65%"; Hit description =Chromosome chr10 scaffold_282, whole genome shotgun sequence
  Pfam annotation: Domain name=MatE; Domain location=282-415; Score =32.2; E_value=1.8e-06; Accession=PF01554.9; Description=MatE
  Pfam annotation: Domain name=MatE; Domain location=61-221; Score =157.0; E_value=5e-44; Accession=PF01554.9; Description=MatE
  Pfam module annotation: Pfam domain module=MatE::MatE; Domain location=282-415::61-221
MMESQNQNLLRQPLINSTHHHHHSADSRLEEVLSDPTLPWSKRILSATWIELNLLFPLAAPAILVYVFNNLMSNVTRAFAGHLGNLELAAANLGNSGIQLFAYGLMLGMGSAVETLCGQAYGANKYEMLGIYMQRAIIVLTITGIPLTVVYIFCKPILLLLGEPPEVASVAAMFVYGLIPQIFAYAVNFPIQKFLQAQSVVAPSTYISAATLVLHVALSWVVVYKLGFGIMGSSLMLSLSWWIIVGAQFLYVVSASKFKDTWSGFSVEAFSGLWDFVKLSAASAVMLCLETWYFQVLVLITGLLDNPQLSLDSISVCMAITGLTMHIGIGFNAAARVSNELGAEHPKSAAFSVIVVNMISFIIAVIEAVVVLALRRVVSYAFTDGETVANAVSDLCPYLAVTLILNGIQPVLSGE

SEQ ID NO: 120084 - protein, 206 aa, Glycine max
  Coding DNA Sequence Number=SeqID_28399
  Subcellular localization annotation: CTP_CleavageSite=32; ConfidenceScore=5.01e-01
MAYARSHALAQSSQRCSPLPPFHTRPSLDPINATESSSMDWGGDDWGSLSSSKKRRKNKVFDEVHGESLGNVEKEKLLGALRASSDANGKVKIKISKKELEKLLGSEKEINNKQLGEGHASAEQVLARLIHARDHDDVHHRPWRPVLQSIPELVRLGMCDLYIRHSASKTSKLGNQEETKSKKFRVLYRYSSNHDANRPVQKIYII

SEQ ID NO: 120085 - protein, 689 aa, Glycine max
  Coding DNA Sequence Number=SeqID_28400
  Gene Ontology: Mol. function=metal ion binding
  Homolog annotation: Hit_ID=A7R0M0; Match level="QueryCoverage=91%, HitCoverage=100%, E-value=0.0, Identity=78%"; Hit description =Chromosome chr10 scaffold_312, whole genome shotgun sequence
  Pfam annotation: Domain name=zf-MYND; Domain location=345-386; Score =36.7; E_value=8.2e-08; Accession=PF01753.9; Description=MYND finger
MTIGECSYSTVKEEEEVDDCGSVKSPHSIFMEGGSLSIEKMLGDDDYDENDFARQTKTMDLHLKSLFNRFLEQFGSGPGLGPGSGTCMMKVDGIAPNFIKSIYKASAALYRAEPWKRLRPGHLFGVRVGKDSDWPGKKQPFPCVQFIGGDGGDVGFYMFRSENDAKKMTGSRETIHVPNVELLRVTYEVESLMFPSNRKMIKSLSLEASGSDRFPVIDVARCTPSGDLRFRNPNLEELRFVYAFMKAISLVHSLLQVDRESGPKYSTVVCFEPFIETVDVQWPPEVAKGGYDLVAVTVSHPPGQAYDEKSNSASAGSTPTKYVEPPREDIFNDTKAYSSTGLRQCAICEKEVNGEQSLCCGRCRAVVYCSSICQKQHWNDTHKSMCGLYKAMMEREEELAIMIFMFPCSADQPCKWLESLGVHQKGMWRRKCSCYSHCPFGLLPVKGGLQELWGGIDEFEYPHDSPFNNHFISSPFLLSGWSEYYNLRSLPLSSPVADILSHPLTVYHILTTLNISSKNLILKGKEVIVHYLGPEGELDWMPAFAEVGHLLNGLGNVQIVMVGPEVPTNLSGTTSGIGSRVRVNLVRGVYQVEASYLPTPHVVIALNSRLAIYSSWGGALDVIKSIGVPAFFTDQSEVSCVNAKQVLRNAGLHITHPVTPNPFRSPVKNLTASSNLPSYSNGFVFGVNT

SEQ ID NO: 120086 - protein, 89 aa, Glycine max
  Coding DNA Sequence Number=SeqID_28401
  Subcellular localization annotation: CTP_CleavageSite=41; ConfidenceScore=5.31e-01
MKKATSFFSLSLGVVFSSHLCCMCPLVSLSLLALKTFEFLRLRMRAQRACLAEQELVTKRLTNVDALSVRSDKGFAERADFLAKQISLA

SEQ ID NO: 120087 - protein, 72 aa, Glycine max
  Coding DNA Sequence Number=SeqID_28402
MATVKLRGSLVYDECKAQGESGESLKGKDVGHGLHTLDSWNGMIGGLSDTPAPVDWGEAMKLSHETTYLPRR

SEQ ID NO: 120088 - protein, 279 aa, Glycine max
  Coding DNA Sequence Number=SeqID_28403
  Gene Ontology: Mol. function=protein binding
  Homolog annotation: Hit_ID=A7QUK1; Match level="QueryCoverage=69%, HitCoverage=51%, E-value=8e-77, Identity=70%"; Hit description =Chromosome chr10 scaffold_179, whole genome shotgun sequence
  Pfam annotation: Domain name=DUF266; Domain location=30-261; Score =267.6; E_value=2.6e-77; Accession=PF03267.5; Description=Arabidopsis protein of unknown function, DUF266
  Subcellular localization annotation: CTP_CleavageSite=51; ConfidenceScore=5.19e-01
MASMARGAKRRHAVISKKMLILFSASLSCVVVLVIFSLFRFHSPKPPISISISRVVFDGPPKIAFLFLVRRNLPLDFLWDAFFQNGDVSRFSIYVHSAPGFVLDESTTRSQLFYGRQISNSIQVLWGESSMIQAERLLLAAALEDHANQRFVLLSDSCVPLYNFSYVYNYLMVSPRSFVDSFLDAKEGRYNPKMSTKIPREKWRKGSQWITVVRKHAEVIVDDDVIFSVFKKYCKRRPPIDTSKGKLNLWCTFFAFEWKILIQGRLGSLSYVDCVYSSK

SEQ ID NO: 120089 - protein, 57 aa, Glycine max
  Coding DNA Sequence Number=SeqID_28404
MTLAVATMVPLKVVVISGGGVVIVTMSMMMVIANNNIGDYDAIDVNNDSDGRGDNAD

SEQ ID NO: 120090 - protein, 526 aa, Glycine max
  Coding DNA Sequence Number=SeqID_28405
  Homolog annotation: Hit_ID=A7QZN7; Match level="QueryCoverage=96%, HitCoverage=67%, E-value=2e-58, Identity=33%"; Hit description =Chromosome chr10 scaffold_282, whole genome shotgun sequence
MLESSMQCLKCSKEEATKWNTALNNNEACNKFNMLHGMKHVEEKQIVGDCYFGVTNLLELLRAQRSINELKATQKSSKKTVEQFLQNLEDKRVSQKCRECLKIGTMLDNIKDKLAREKRSRERMELFNTKLVHELAKTKISAKQYMTNYKKEKRERKLIEEVCNELAMQVREDTAKLEVLLSDSVKICKEVEEEREMMEMAELWREERVQMKLADVQFLLEDKYNQMVQLIAFLQVFLRSRGAELDTTELEDAELIKQVVESVNIKRILELSYDFSKSDDTVSTFEELRKENTEEGKIKPCYSHTTLTSPMSTIYIENLDEELNESSILHHNSPSSDYNFGLEPTNYSLETIGYIEDRKFSSMPQRGDTYSVNVNYQDKDLLGSEKACLESLKTGVNGECSVSIGDLKRKVCLTSKQLRSCSNNGGITISSTKCSQHRRLGDDGWHKQKECNHRLPTSSIQCQGSVEGSFKHSELLEQGNSTYNNTNPHIIRGMRGCTEWPRGIPKSSFEVTPFGKERKAKNIGYT

SEQ ID NO: 120091 - protein, 43 aa, Glycine max
  Coding DNA Sequence Number=SeqID_28406
MFEDKKWQRQQLVGGIGRFTLIGGGYKMLAKNFLAGNIIVTFC

SEQ ID NO: 120092 - protein, 45 aa, Glycine max
  Coding DNA Sequence Number=SeqID_28407
  Homolog annotation: Hit_ID=Q2HTI6; Match level="QueryCoverage=55%, HitCoverage=7%, E-value=8e-07, Identity=96%"; Hit description =Alternative oxidase
MAYHFSECVESHAFETYDKFIKVQGGPRPISARLCLGVPVIQHVS

SEQ ID NO: 120093 - protein, 46 aa, Glycine max
  Coding DNA Sequence Number=SeqID_28408
MAFRSFRFLTRFAKPHNPFPSTRRSPLSSLHAPPPHHEQPNLEDRL

SEQ ID NO: 120094 - protein, 127 aa, Glycine max
  Coding DNA Sequence Number=SeqID_28409
MVPPQRGKEEEDMNILVRVKGWEVEDYEYWKMDWGLGVPLKAMMHDDTDRLFEGGVSKGVDEDGAKDVMAEVCGEGVGGTAKEREEEAVQWWPKKGVSFGLWWRNGSLEEGEKIEKERRKMTKEKGK

SEQ ID NO: 120095 - protein, 262 aa, Glycine max
  Coding DNA Sequence Number=SeqID_28410
  Homolog annotation: Hit_ID=Q2HT43; Match level="QueryCoverage=99%, HitCoverage=99%, E-value=9e-69, Identity=57%"; Hit description =Putative uncharacterized protein
  Subcellular localization annotation: CTP_CleavageSite=50; ConfidenceScore=5.80e-01
MASFSITGPIKCKTFASFSPLSFSATYNSCNITISNNLTRKVRAHSNSLSSFSYQSSCHRSLYSEKLQRGQSLIAFDGNNSESEAEDDHALDSVMKLYSAFKNKNTHELSADERRRVSNFLSFFETFQGRTQVLEFFSYLTSILGNNIQIIFKPTPHEGVNVGLQWKFEWNKIHLPLWKGFGLHISHTYHGRAVIRNIETFMEPLLHLKPFGLKMKIGLGEFMEKIASFMVSEFGNKAKRVLYLVLAVSSLTAFLFFMKLAS

SEQ ID NO: 120096 - protein, 356 aa, Glycine max
  Coding DNA Sequence Number=SeqID_28411
  Gene Ontology: Mol. function=RNA polymerase II transcription factor activity; Cellular component=nucleus; Biological process =transcription initiation from RNA polymerase II promoter
  Homolog annotation: Hit_ID=Q2HT28; Match level="QueryCoverage=82%, HitCoverage=43%, E-value=3e-71, Identity=53%"; Hit description =Transcription Factor IIF, Rap30/Rap74, interaction
  Pfam annotation: Domain name=TFIIF_alpha; Domain location=18-356; Score=-30.6; E_value=4.7e-07; Accession=PF05793.3; Description =Transcription initiation factor IIF, a
MSTDLQLKSSCSGCGSTTDLYGSNCKHMTLCLSCGKTMAEKRAKCFDCGATLTRLIREYNVRASSTNDKNYFIGRFINGLPDFSKKKSAENKWSLQKDGLHGRQITDTLRVLKSILVLLLLLCRYSFQAWYLVRRSALKHCISQKKCSLKNWKLVILKYYFMLRNTTTYHVTEKYKNKPWLLEDETGQSQFQGHLEGSQSATYYLLMKERKEFVAIPAGSWYNFNKVAQYKQLTLEEAEEKMKNRKKTADGYQRWMMKAANNGPAAFGEHGKFDDKESNTGGVRIRKKTGEDDEGHVSDKGEEDEEEESERKSRLGLNKRAGDDDEEGPRGGDHDLDDDDVEKGEYLAFFVHDVSD

SEQ ID NO: 120097 - protein, 155 aa, Glycine max
  Coding DNA Sequence Number=SeqID_28412
  Gene Ontology: Cellular component=plasma membrane; Biological process= auxin mediated signaling pathway
  Homolog annotation: Hit_ID=Q9FGK4; Match level="QueryCoverage=94%, HitCoverage=46%, E-value=4e-15, Identity=30%"; Hit description =Genomic DNA, chromosome 5, P1 clone:MNJ7
MVGKLLVMRLVLVIYMLSTVILKSSAQACKNKTFNDNKVFAKCRDLPQSSSYLYWTYDQATGKLDMTFTHAGITAPERWVAWAINPNNNLKTAMGTFRILTQAWRLPVKTMRSLSMLSCTKVVHLWQDGPLSSSIPQAHQLATSNIQAKGILHLV

SEQ ID NO: 120098 - protein, 307 aa, Glycine max
  Coding DNA Sequence Number=SeqID_28413
  Homolog annotation: Hit_ID=A7QZN7; Match level="QueryCoverage=85%, HitCoverage=35%, E-value=6e-41, Identity=40%"; Hit description =Chromosome chr10 scaffold_282, whole genome shotgun sequence
MHGATRIRKRCNEGFHEFTAETNSEEGTVKKRRNEEGEDNVKGTKLESSIPHLNGSKGVATIWNPTRNEASNEFIMIHSRKLLEDKKVVGNHNSVVSTLLEELLQAQRSINKLKAEQKSLKKNVEHFLQNLKVENIFLKHKEHYKIKATLDDLKGMLERERRSRERMELLNTKLVHELAEANLLAKQFMTNCEKEKKERELMEEMCEELAMQIGEDKAKFTVVLSESMRICEKVEEERNMMQMAELWREERVQMKLADAQLVLEDKYNQLVQLYASLEMFFMSRGTELETTELEDAESIKQEVESIN

SEQ ID NO: 120099 - protein, 123 aa, Glycine max
  Coding DNA Sequence Number=SeqID_28414
  Gene Ontology: Mol. function=binding
  Homolog annotation: Hit_ID=Q3EC58; Match level="QueryCoverage=64%, HitCoverage=9%, E-value=1e-23, Identity=68%"; Hit description =Uncharacterized protein At2g06210.2
MPEVAMQKFSASTLQKAKRIEDEVRATVAELQNVVRVFSQFFATSNLHIHGFDGEKIDTHVGYCNHLLSVAKVHLEAAEREEQQGLGFKIMIVPLSLYSIFGVGHSALLFGIGYYGIIQVNQE

SEQ ID NO: 120100 - protein, 116 aa, Glycine max
  Coding DNA Sequence Number=SeqID_28415
  Homolog annotation: Hit_ID=A7R2A3; Match level="QueryCoverage=95%, HitCoverage=96%, E-value=5e-26, Identity=57%"; Hit description =Chromosome undetermined scaffold_410, whole genome shotgun sequence
MALRWVLHSACHVLGYPTRNIEEEECKKIEGYSNIGEAKSVKGLSLSNNFNEVDQCYPCSGFQMPLHYPRYTKQDYESMEEWKVDLLLKQYGLSFKGTLDEKRAFAMGAFLWPDQD

SEQ ID NO: 120101 - protein, 334 aa, Glycine max
  Coding DNA Sequence Number=SeqID_28416
  Gene Ontology: Mol. function=nucleotide binding; Cellular component =cAMP-dependent protein kinase complex; Biological process=fatty acid biosynthetic process
  Homolog annotation: Hit_ID=Q7XYX7; Match level="QueryCoverage=87%, HitCoverage=100%, E-value=1e-133, Identity=79%"; Hit description =AKIN beta2
  Pfam annotation: Domain name=AMPKBI; Domain location=200-290; Score =139.3; E_value=1.1e-38; Accession=PF04739.6; Description=5'-AMP -activated protein kinase, beta subunit, complex-interacting region
MGNVNGRDDVNGTPSGTEGEEEEAGEEGGSDSVADCMSSNPGHRAPSELMGHSPPASPRATQSPFMFTPQVPVVPLQKPDEMHAPSPSWMQTTSGYEDMYCELGIPTMITWSYDGKEVAVEGSWDNWKTRMALQRSGKDFTIMKVLPSGVYQFRFIVDGQWRYAPDLPWAQDDAGNAYNILDLQDYVPEDIGSISSFEPPKSPDSSYNNLQLSSEDYAKEPPLVPPYLQMTLLNIPSTNMEVQPLTSRPQHVVLNHLYMQKGKGSPSVVALGTTHRFVAKYVTVVLYKSLQRNSEHHKDHYMKVKIVVHIMQLLDGHSSCNSVSILTSFDDAIL

SEQ ID NO: 120102 - protein, 68 aa, Glycine max
  Coding DNA Sequence Number=SeqID_28417
MEGNGGGYCLTGCKISVPIALAGSLLGQITAEALTPLFLSQESPLSFKCSAFHISRENSSFKRGSLAS

SEQ ID NO: 120103 - protein, 130 aa, Glycine max
  Coding DNA Sequence Number=SeqID_28418
  Gene Ontology: Mol. function=nucleoside-triphosphatase activity; Cellular component=nucleus
  Homolog annotation: Hit_ID=Q9FJW0; Match level="QueryCoverage=72%, HitCoverage=27%, E-value=9e-12, Identity=42%"; Hit description=RuvB DNA helicase-like protein
MAETMETNSRDKKRACLHSHIHGLALDSSLEPRLPQTAWSGNKTAIAMGMAKSLELETPFAMITASEIFSLQILKTKAPSLSTSRKKPKSSRFKWTVPRHELLSIHMPAYSDSIVKGVSTVMVQTPVGMV

SEQ ID NO: 120104 - protein, 197 aa, Glycine max
  Coding DNA Sequence Number=SeqID_28419
  Homolog annotation: Hit_ID=A5C4S3; Match level="QueryCoverage=49%, HitCoverage=11%, E-value=2e-12, Identity=38%"; Hit description =Putative uncharacterized protein
MFLMGMNESFSTIRGQILSVDPFPPITKVFALIVQEEKQKEVGASTFGTFASEVSHAFAFKNSFNERNNSDNRSKGFSKNTPCVVIVLHGYPPNYKKNGYSSKVEKQSSSSSKPSHKVAHQVSVDMPQSQPSSVDLGSQFQLIAQQYSQLMNPLQSHATNIVIPHGVSSSSGEASLQEDWQRGFHPRPLCPRPQGHL

SEQ ID NO: 120105 - protein, 104 aa, Glycine max
  Coding DNA Sequence Number=SeqID_28420
MSLKSTRSRNASNVGDLLRQSNEKIAPEAIQAHGQGNRNIVRARCATHGSCGCGHVHCGDLISGKARWIWKGEGWCTIVMEVRGEKFEGKKNVVHGKVEGMFVI

SEQ ID NO: 120106 - protein, 217 aa, Glycine max
  Coding DNA Sequence Number=SeqID_28421
  Gene Ontology: Mol. function=lactoylglutathione lyase activity; Biological process=carbohydrate metabolic process
  Homolog annotation: Hit_ID=A7R058; Match level="QueryCoverage=51%, HitCoverage=82%, E-value=1e-50, Identity=66%"; Hit description =Chromosome chr10 scaffold_297, whole genome shotgun sequence
  Pfam annotation: Domain name=Glyoxalase; Domain location=78-213; Score=20.8; E_value=0.0012; Accession=PF00903.16; Description =GlyoxalaseBleomycin resistance proteinDioxygenase superfamily
MAEAAKLVNNADVSNRTPSIATIAKLLPDVSKIKVFTGQTFHCWQERVHTLLEMHGVVFALSTPKLDAVYRHTLLSALSNHLFDVYCSYKESKEIWDSLILKYIVEDLALGLRVVKKTDRPEYKYTIAMLGYAEEHETTVLELTYNYGVTEYTKGNAYAQVAIGTDDVYKSAEVVNIVTQELGGKITRQPGPIPGLNTKITAFLDPDGWKTVRNFFV

SEQ ID NO: 120107 - protein, 168 aa, Glycine max
  Coding DNA Sequence Number=SeqID_28422
MEGLVKLTNMVWELRISEAKRLRHIDVLRDGVPLATRQAVCREIEPSVLCLSRKSHLFPMTLRFSYEGTSVQVPLAMSALSSSNMVNLFRFENSILRASHHGSLIEILHLGFEFGLMFGDMVKLRLEKVGLIREVGLDLNVVEVIRFAGRNWSLVGSVIKQLPIKDRN

SEQ ID NO: 120108 - protein, 61 aa, Glycine max
  Coding DNA Sequence Number=SeqID_28423
ENKTTTPEKVSLGDAGDERDHQRFQDTLSLSMSSRPSSHSFLNRSHTGPDANDVSLELTLC

SEQ ID NO: 120109 - protein, 74 aa, Glycine max
  Coding DNA Sequence Number=SeqID_28424
MAPTLLLLNPFCPCDRRHWYRYRWHGRRPRRWCWVVALELAWAWVEWEKEMMGIEAEKEIIKNNDIPIAPMIAL

SEQ ID NO: 120110 - protein, 239 aa, Glycine max
  Coding DNA Sequence Number=SeqID_28425
MQRYLMVIRTFCQLEASEPVDTQRLTSSCAPVPEMSTSSDRDCEKVSFVIRQTQGSDAKSEDMQRYLMVIRTFCQLEASEPIDMQRLTSSFAPFPKMSASSGRDCEKVSFAILQTQGSDGKYDDMRRYLMVIRTFCQLEESEPVDTQRLTSSFPPFPKMSASSGRDCEKVLFAIHQTQGSGSGSMQRYLRVIHTFRQLEASEPVDTQRPMWSSAPFPEMSASSDRDRKKVSFLPSNSSV

SEQ ID NO: 120111 - protein, 144 aa, Glycine max
  Coding DNA Sequence Number=SeqID_28426
MAEVSTEAIASSPINAHGREFEEIPGCPLGGRKPYLFSGFYPSLARISKIVKISAQELDQGKQVKNGVVGVPRKCLEAKARALASQDEWAPFIDVLALLIFRVVLFPNVDGLVDLATIDAFLAFHDCKESPVVAILANLYDTFD

SEQ ID NO: 120112 - protein, 71 aa, Glycine max
  Coding DNA Sequence Number=SeqID_28427
STLEDPTFTSFPCPTPDQFRAEVAWPGDWPEAQAGEAPAGAPAEAPDEADEAREHEEMTDLLDFLGGSGAT

SEQ ID NO: 120113 - protein, 24 aa, Glycine max
  Coding DNA Sequence Number=SeqID_28428
ESRKGLNRSSTFFIRSSSFFDLQR

SEQ ID NO: 120114 - protein, 118 aa, Glycine max
  Coding DNA Sequence Number=SeqID_28429
  Subcellular localization annotation: CTP_CleavageSite=66; ConfidenceScore=5.81e-01
MATCLLRVGRFTSIDSRSLFVSTASFSSSFSSPSSSGKSKTGKKLTDRLSSVIDAVNDRKLPPELRGQHNNVSFIFIGFGYLSLSALPQVAKTLVGGGWCQAQTELVSKTIFKTIVFG

SEQ ID NO: 120115 - protein, 161 aa, Glycine max
  Coding DNA Sequence Number=SeqID_28430
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARENVYESFMIITAPHSASCGLNYAALWSGNPGRASCINESANARGEAVCVLGALPLPRSLTRCARSFGCGERYQLTQR

SEQ ID NO: 120116 - protein, 159 aa, Glycine max
  Coding DNA Sequence Number=SeqID_28431
MEEENARRVTLEDYSSTTTSQFFTSIARLEVQVANISYPHSLNQLIQGNLFHGLPNKDPYAHLTTYIEICNMSQRLPRGRWKYPHSINFLMNHSARLRKTPTHGYNEPEQLNIFIDSLRPQSKQLLDISVGGKIKLKKPEEAMELIENMTANDHAILCD

SEQ ID NO: 120117 - protein, 206 aa, Glycine max
  Coding DNA Sequence Number=SeqID_28432
  Homolog annotation: Hit_ID=Q2HW90; Match level="QueryCoverage=99%, HitCoverage=54%, E-value=1e-21, Identity=29%"; Hit description =Putative uncharacterized protein
SLDVTSLKELGRLMGPLQRQAFRKVYGKILDLTAVEVFTEAVVSLAQYYDQPLRCFTFGDFQMVPTVEEFEEILGCPLGGRKPYLFSGFLPSLSKTAAVWVPFADILALLIFGVVLFLNVDGLVDLAAIDAFLAYHHSKENPVVAILADLFDTFDRRCEKNSARIVCCLPALCVWLVSRLFQQDEGKEGVLFSCGDYPNVPLIGTT

SEQ ID NO: 120118 - protein, 118 aa, Glycine max
  Coding DNA Sequence Number=SeqID_28433
  Subcellular localization annotation: CTP_CleavageSite=45; ConfidenceScore=5.41e-01
MQRQDETKGQISVSFSTETASQVGKFRSNRRVPLVVEFQWRTTMRCSRERKLLAHSRHLRRDPNCQIMENCLVKLSTKFREDPTVNEGWEAFLPRQLHVAFSRSFIKRLPPEASLWLL

SEQ ID NO: 120119 - protein, 41 aa, Glycine max
  Coding DNA Sequence Number=SeqID_28434
MAPKTCSLPASAPDRASSIKRCLMFKGYSLLNNAYVFYGVS

SEQ ID NO: 120120 - protein, 69 aa, Glycine max
  Coding DNA Sequence Number=SeqID_28435
MGEVEEVQEQMKANIEALKEQMATMIKAMMSIKEIIKVNATAIATTSTIVEVDLPPIWPQPNKSSNPRY

SEQ ID NO: 120121 - protein, 82 aa, Glycine max
  Coding DNA Sequence Number=SeqID_28436
YILCGTSRGYIYLGIVILRTREASCGSVQVEGTFTWFFKENKEGYIPCGSLACKGFYKVERNLKNRRLLRELMQARFVAKPV

SEQ ID NO: 120122 - protein, 123 aa, Glycine max
  Coding DNA Sequence Number=SeqID_28437
MAPTRHPLDPDKSNRALGFPALITRLCQSFDVPVAPSMAANHRAHVQTHDCLYQMSLSLQSQGFTSFPCPTPDQFRAEVAWPGDWPEAQAGEAPAEAPDEADEAREDEEMTDLLDFLGGSGAT

SEQ ID NO: 120123 - protein, 286 aa, Glycine max
  Coding DNA Sequence Number=SeqID_28438
  Gene Ontology: Mol. function=oxidoreductase activity, acting on single donors with incorporation of molecular oxygen, incorporation of two atoms of oxygen
  Homolog annotation: Hit_ID=A7ZNW0; Match level="QueryCoverage=100%, HitCoverage=91%, E-value=1e-141, Identity=79%"; Hit description =Gentisate 1,2-dioxygenase
  Pfam annotation: Domain name=Cupin_2; Domain location=62-135; Score =82.4; E_value=1.5e-21; Accession=PF07883.2; Description=Cupin domain
HLVPQTPNANCAPAYWNYQEIRPHLLASGELIGAKEAVRRVLVLENPMLRGQSSITPTLYAGLQLIMPGEVAPSHRHNQSALRFIVEGKGAFTAVDGERTQMHEGDFILTPQWCWHDHGNPGEEAVVWLDGLDLPLVNLLGCGFAEDYPQEQQPVTRQEGDYLPRYAANMLPLRHQKGNSSPIFNYRYDRSREALHDLTRLGEVDEWDGYKMRYANPVTGGYPMPSMGAFLQLLPKGFSSRKARTTDSTIYHVVEGRGQADEDTVLFSFSDRPVQEALGLFREARY

SEQ ID NO: 120124 - protein, 209 aa, Glycine max
  Coding DNA Sequence Number=SeqID_28439
DLDYLGPGVECSLVLQPDPYISYIRPYCGQSQSNSCRLGFPTLLTTLCRARGVVSNNLTFERLSPAINLAYIRKNCWNIDDLTVAFPGARRARVRPVDIPSTFATPSPTPTSTFAAPSVPAHMVSSPESILSVDQFLEKVAWLGAHPSLDREGGGPTAQVAQQVQDASFETTIPEPFTLHHEVGEEQVRPKIDVTSERSLEGTSEPPTP

SEQ ID NO: 120125 - protein, 173 aa, Glycine max
  Coding DNA Sequence Number=SeqID_28440
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPAIDEEKAREEEDADAEMQLNINQESDEFRLPTKEECLNFGRVTEEKGTELEFVIMVIAVSCVKLLSAHNSTQHTSRKHKV

SEQ ID NO: 120126 - protein, 276 aa, Glycine max
  Coding DNA Sequence Number=SeqID_28441
  Homolog annotation: Hit_ID=UPI00006A2D9E; Match level="QueryCoverage =47%, HitCoverage=87%, E-value=4e-08, Identity=18%"; Hit description =UPI00006A2D9E related cluster
LHVLTFRGLHVLAIRGLHALTFRGLHVLALRGLHALTLGLHVLTIRGLHALASRGLHVLALRGLHALSLGLHVLTFRRLHALAFRGLHVLTIRGLHALTSRGLHVLAFRGLHVLTFRRLHALAFRGLRVLTFRTSSFLLTVPGAPPDIGGGPTVRAQPEREAITQLLCILGQDFTRAAAKRRQHSAQRPQCQSPPAEVSVGLCRPDMGIAPTKTPSEPEEVQKGPGVSSSGYGPLSVLQGARTPPARSRHHRIAPARHPVDPKKSNRVLELSSSNY

SEQ ID NO: 120127 - protein, 109 aa, Glycine max
  Coding DNA Sequence Number=SeqID_28442
MAAQLIHDRVEMECLEGAWETLEGNTRCRFRGTIRFTATSLVTSSEEDPEEDPEELPPEPAVDALDFLEGDEDPLPEVDSPEEVMSASEADFTEDSGPGEMAISGGSSS

SEQ ID NO: 120128 - protein, 229 aa, Glycine max
  Coding DNA Sequence Number=SeqID_28443
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPENFAEFFSSCFQSLSVKEMEACVREYVEGKKHRLMGKQIVAVDQVVFQATKVLTQWSGAQAMEKSLDVQRDRELVVALGLHRKMTS

SEQ ID NO: 120129 - protein, 73 aa, Glycine max
  Coding DNA Sequence Number=SeqID_28444
  Gene Ontology: Mol. function=hydrolase activity, hydrolyzing O -glycosyl compounds; Cellular component=extracellular region; Biological process=cell wall organization and biogenesis
  Homolog annotation: Hit_ID=A7P0K6; Match level="QueryCoverage=57%, HitCoverage=8%, E-value=2e-12, Identity=73%"; Hit description =Chromosome chr19 scaffold_4, whole genome shotgun sequence
YGVQIAASGEYAHALEAIKWGTDYFIKAHTQPNVLWLELTGGIDLNVGRVNGFVRNFLQSRRDWRLLSLSAGA

SEQ ID NO: 120130 - protein, 61 aa, Glycine max
  Coding DNA Sequence Number=SeqID_28445
MTEGCIGVWVLGWSVRRWAAAAAVEDDPFLSLTILPLMKSSKPSGNRLQAACSCVIDYTEW

SEQ ID NO: 120131 - protein, 133 aa, Glycine max
  Coding DNA Sequence Number=SeqID_28446
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=23%, E-value=2e-62, Identity=71%"; Hit description =Photosystem I P700 chlorophyll a apoprotein A2
GALDARGSKLMPDKKDFGIVFLAMARDEAGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARL

SEQ ID NO: 120132 - protein, 103 aa, Glycine max
  Coding DNA Sequence Number=SeqID_28447
MNENAIHGAPKKVENGELHQAITTHSSKLEGGGHINENAILGAPKKVENGELHQAITTHSSKLEGGGHMNKNAILGAPKKGLRMENYTKQSPRIAAKSKAEDT

SEQ ID NO: 120133 - protein, 38 aa, Glycine max
  Coding DNA Sequence Number=SeqID_28448
MWTTTGEVVAAQLAQASSARPGEPACFLQKQQPSGGIF

SEQ ID NO: 120134 - protein, 274 aa, Glycine max
  Coding DNA Sequence Number=SeqID_28449
  Gene Ontology: Mol. function=nucleic acid binding; Cellular component= mitochondrion; Biological process=metabolic process
  Homolog annotation: Hit_ID=Q8ZQI1; Match level="QueryCoverage=100%, HitCoverage=51%, E-value=1e-144, Identity=91%"; Hit description =Putative Fels-1 prophage DNA or RNA helicases of superfamily II
  Pfam annotation: Domain name=Helicase_C; Domain location=198-273; Score=38.9; E_value=1.8e-08; Accession=PF00271.22; Description =Helicase conserved C-terminal domain
MFCAPYQILSTQTANRFVEYGCTGDEIGYVWADHPNYDPTLKIQIASADTLIRRVFPDNIDLLIIDEAHLRKKRILQDIERLREKGVKVIGLSGTPFSPFLGKYYDRLIKPTTIGELIQRGDLSKYEFYAPTKPDLKGVKTSPSLQYGTDYNEAQLAEIMCGSTLVGDIVQNWLENGRDLPTIAFCVNVDHANFLTIQFNQAGVNAEVMTADTPAEERQTIIHRFETGATKIIVSVGVLVAGFDSDVRCIIYARPTKSEIRWLQALGRGLRTAP

SEQ ID NO: 120135 - protein, 129 aa, Glycine max
  Coding DNA Sequence Number=SeqID_28450
LQMVAPPGSILSIEQFLEQVAWPGAQPSIVRTGGRFAAQAPQQEGSDEADTPPEPTPMQAEPMPDDPHSPVADPSSPKLEVAPPSLPIIIISKDSTESASGEAVALSDSSVFHMIDEEDAQTRDTQDLS

SEQ ID NO: 120136 - protein, 72 aa, Glycine max
  Coding DNA Sequence Number=SeqID_28451
MLKKLGYTPCKHMFDQNLEKFRQLSPTIATWTNRISKEKWTMAYDKEGRRYGHMTNNLSECHTHNSVGGINI

SEQ ID NO: 120137 - protein, 166 aa, Glycine max
  Coding DNA Sequence Number=SeqID_28452
MSASDHAILRGRTHQPMKKSLIELSSHDALLAQNKLLSKQLEILIETLGLMKQANVLPLKKTLKKFIIWEINSDKGILKEDFQASSRFNKDQSGPSNRPIQQGPNIFQRTTKLEETLTQFMQATMSNHKSTESTLKNLEVQVGQLAKQIADKSSNSFVANMEQNPK

SEQ ID NO: 120138 - protein, 77 aa, Glycine max
  Coding DNA Sequence Number=SeqID_28453
MSARVQPIAFLCFLRTDNNFSSCSSAREADIITGKLLLSSKGKHHHQTCNQYHFQIHSQHQIQTYDQAQFQTQCMKS

SEQ ID NO: 120139 - protein, 232 aa, Glycine max
  Coding DNA Sequence Number=SeqID_28454
  Homolog annotation: Hit_ID=A6X1G0; Match level="QueryCoverage=98%, HitCoverage=23%, E-value=1e-116, Identity=89%"; Hit description =Sporulation domain protein
MTDSSANPRNYGERPLHEDDPLMELSRIMDFGTPADDNVAWNERRPSYFEDSRTEPGFDPSLDLERELLGDFNDYSQPTDQSQFAATPAQDDSHLLDEPLIHEEELASALEDELDLQMDEDEQAPELETPSFEALEFEEADRTEPVPQFDYSDYSAARDSNEETYAASSSVYARRETVEPLHVDQTDYDPTIYQPAIEPHQEAYQPARDHEWNVQAVEPAEQSYATAAPGFT

SEQ ID NO: 120140 - protein, 139 aa, Glycine max
  Coding DNA Sequence Number=SeqID_28455
GPVDKPSGGRHVLQRFGPARPTRLDGINSSPSMICKQWPGVLPWYEQVALGLYHFRKGGWWILPGDITAIWLATRGGKRSSYVIGIGLELGGLPLDGHGIPRLYGGLTYASVEVMAWVSPSFLFAPVALILLALVPVKE

SEQ ID NO: 120141 - protein, 160 aa, Glycine max
  Coding DNA Sequence Number=SeqID_28456
  Homolog annotation: Hit_ID=A6FJQ2; Match level="QueryCoverage=33%, HitCoverage=97%, E-value=2e-11, Identity=73%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGSPEKASKDDALKKTLQVSNLSPLLTVEQLKQLFGFCGTGYRARIRNHVGKPVVPAALMNRPTRGERRFAYWALFRFLAH

SEQ ID NO: 120142 - protein, 205 aa, Glycine max
  Coding DNA Sequence Number=SeqID_28457
  Gene Ontology: Mol. function=ATP-dependent DNA helicase activity; Cellular component=cytoplasm; Biological process=DNA unwinding during replication
  Homolog annotation: Hit_ID=A1FTD1; Match level="QueryCoverage=21%, HitCoverage=6%, E-value=2e-13, Identity=86%"; Hit description=DNA helicase II
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLNPAQREAVSAPPGHHLVLAGAGSGKTRVLTHRIAWDPLESTCRHASLALAVVYNVVTGKTLALPNLIALQHIPLSPAGVIAKRPAPIALPNSCAA

SEQ ID NO: 120143 - protein, 233 aa, Glycine max
  Coding DNA Sequence Number=SeqID_28458
  Homolog annotation: Hit_ID=Q6WAY6; Match level="QueryCoverage=84%, HitCoverage=31%, E-value=2e-27, Identity=38%"; Hit description =Putative uncharacterized protein
MDSARGLDRIKQTRNGIAGLPRKYLEDKAKDMASQGDWVTFMDVLALLIFGVVLFPNIDGLVDLAAIDAFLAYHHSKESPVVAVLADLFDTFDRRCEKSSARIICCLPTLCVWLVSHLFQQDTRHPCPLQSHRSCTEKRRIDWDQLLAGIGGRTINWFPRWKEGKEGVLFSCGGYPNIPLIGTRGCINYNPVLAIRQLGYPMRWAPGEESMSPFLVRNFGAQNFKAIQKIHKA

SEQ ID NO: 120144 - protein, 232 aa, Glycine max
  Coding DNA Sequence Number=SeqID_28459
  Homolog annotation: Hit_ID=Q5PEG8; Match level="QueryCoverage=100%, HitCoverage=100%, E-value=1e-120, Identity=88%"; Hit description =Putative uncharacterized protein
  Pfam annotation: Domain name=CRISPR_assoc; Domain location=1-230; Score=318.2; E_value=1.5e-92; Accession=PF08798.2; Description =CRISPR associated protein
MYLSRIQLRFNNLRPEMLKKWDSARPYASHQWLWQLFPEQETRQFLFREEPHGGFFMLSAIPPLTQHSLFLIETKPFNPQLINGLELDFQLRANPVITRNGKRSDVMMNAKYQAKENDVAQERWWELQQQAAQTWLEKQGQQHGFRLLEPEPDDFAQWTGAEYSEMQAHCGCVQAYQQHRFVRNDQEKPIAFSSVDFSGTLCITDASLFEQALFSGLGKALGCGMLMVKRKR

SEQ ID NO: 120145 - protein, 99 aa, Glycine max
  Coding DNA Sequence Number=SeqID_28460
  Homolog annotation: Hit_ID=A2UN34; Match level="QueryCoverage=68%, HitCoverage=61%, E-value=6e-07, Identity=46%"; Hit description =Putative uncharacterized protein precursor
EPRKQFHRFIPAGAGNIRIGSPSFAVFAGRFIPAGAGNMELRLIVFAVHPVDVWSGTGGLSPLARGTSAIREDMADYMRFIPAGAGNIKPTEWRSRPGT

SEQ ID NO: 120146 - protein, 168 aa, Glycine max
  Coding DNA Sequence Number=SeqID_28461
  Subcellular localization annotation: CTP_CleavageSite=33; ConfidenceScore=5.01e-01
MRSWVRGQWIPFDADAIGQLLGISVGCWKRARSASMARGGTGLMGSMRRPLPNCYIYRGRILPGLLPEDGCGSLRTNMTTLTQIWMTLLLSNILPTDHNSDLPLPKCQLVYAILTRMSVHVAQLIADAIYIFAVPVAPTKLIRPPITRAFIEKYCTQRQAQGDAPQSA

SEQ ID NO: 120147 - protein, 83 aa, Glycine max
  Coding DNA Sequence Number=SeqID_28462
MSASDIMQVENYRKVGIRPPHMYAAFANQCGGYEKVGFIRKDIYNEEGRMRKQHSSDARGALKYLYDLRKKEPMMYVSYTADG

SEQ ID NO: 120148 - protein, 69 aa, Glycine max
  Coding DNA Sequence Number=SeqID_28463
MHAQRACLTERELVTGHLVDVHTLSVRSNKGFAGRASCVLSTMLSDFTFSRVLLALGELAFLAKWVSVA

SEQ ID NO: 120149 - protein, 154 aa, Glycine max
  Coding DNA Sequence Number=SeqID_28464
  Homolog annotation: Hit_ID=Q5NRP4; Match level="QueryCoverage=41%, HitCoverage=4%, E-value=8e-07, Identity=39%"; Hit description =Putative gag-pol polyprotein, identical
  Pfam annotation: Domain name=zf-CCHC; Domain location=70-87; Score =28.3; E_value=2.8e-05; Accession=PF00098.14; Description=Zinc knuckle
MELLLLRAGLREEESTSIARFLSGLNMEVRDKDQAHGILGAAPLNPIEDKGKTIEKYTPKTSSQERTSNIKCFKCLGRGHIASQCPTKKNMIMRGQDIYSSQEQTTSCPSSSESEDEVRGEESSEEVYPHEEGHWIEDSKKIWPKMQEKALGFS

SEQ ID NO: 120150 - protein, 92 aa, Glycine max
  Coding DNA Sequence Number=SeqID_28465
MVNVIQRCFDHNNDDKGDKQKAQRSKNKSSESKNISSESRTSQEFKNQEEFKTQEESLESRIKNQDSRSQESRSRFKTQDSRMKKILNQNKY

SEQ ID NO: 120151 - protein, 172 aa, Glycine max
  Coding DNA Sequence Number=SeqID_28466
MDDDLQIVYGMKSGIKMNWVLLIEDIMMKCCHLVDYEFPYVVLASGFIDYFNVDISNEVMHFTKASSDITKRHLKNLGMRFVDHEWIMVGEPAVGNVDEMQENAEVEAPQELAHQWSPFETLMIKKMDVMLHLHQEHSAKVHSSLENITTQLEDIETRLTLSNLLSHDEDQA

SEQ ID NO: 120152 - protein, 113 aa, Glycine max
  Coding DNA Sequence Number=SeqID_28467
  Homolog annotation: Hit_ID=Q51617; Match level="QueryCoverage=53%, HitCoverage=88%, E-value=4e-09, Identity=59%"; Hit description =Putative uncharacterized protein
  Subcellular localization annotation: CTP_CleavageSite=43; ConfidenceScore=5.69e-01
MLCKKAVSSFGPPIVVRSKLAAVLSLMVMAALHNSLTVMPSVRCFSVTGVSRGPFVSRVSVMTVKHLTHAAPGDGSQLVCKRMPGADKPVRARQRVLAGVGAGLTMRHQSRLY

SEQ ID NO: 120153 - protein, 80 aa, Glycine max
  Coding DNA Sequence Number=SeqID_28468
SEVGQVHLRMRKMLLVEVLDTAFLTSMIRPSKVGMIPPPGIVPVAGEHKLQVVQLLQIVAQKGKGLCGARSRSINHRVWR

SEQ ID NO: 120154 - protein, 40 aa, Glycine max
  Coding DNA Sequence Number=SeqID_28469
MAPLIPCGTHLAAPFWNGISRLGKDAAAAVDCAKEKRRNK

SEQ ID NO: 120155 - protein, 375 aa, Glycine max
  Coding DNA Sequence Number=SeqID_28470
  Homolog annotation: Hit_ID=Q6WAY6; Match level="QueryCoverage=85%, HitCoverage=59%, E-value=3e-27, Identity=27%"; Hit description =Putative uncharacterized protein
MEPLHMQAFRKTYGKILELTLAEVSIEAIASLTQYYDQPLRCFTFGDFQLVPTIEEFEEILGCPLGGRKPYLSFGCLPSLSKIATVVKDSARGLDRIKQTRNGIAGLPRKYLEDKARDMANQGDWVPFMDVLALLIFGVVLFPNIYLDTFNRRCEKSSARIICAYRPLCLVGFSTCSRQDTRHPCPLLSHRSCTEKRRIDWDQLLAGIGGRQSVGSPDGRKKRRSPFLMWRYPNIPLVGTRGCINYNPALAIRQLGYPMRGAPTEESMSPFLVRDLGAQSSKTIQRIHKAWETPLRKDQELRGIRNGIIGGYHEWLKVHIRGLDWLTKLKVISEESFEAPEEDEEVQALKSELGKAKLAKEKFKLAATHVRKECA

SEQ ID NO: 120156 - protein, 105 aa, Glycine max
  Coding DNA Sequence Number=SeqID_28471
MSHHSSSVNGEGTSHKDPLSRILDELSSLNSHVPCKSLSEELRDYFEGSHWSHLRPHSHRREKERKPQEANINLSYFHGKDNVEAYLDWKIRVEQQLKRKSTSKS

SEQ ID NO: 120157 - protein, 112 aa, Glycine max
  Coding DNA Sequence Number=SeqID_28472
  Subcellular localization annotation: CTP_CleavageSite=74; ConfidenceScore=5.80e-01
MSLSTSPSPSRCPLSISASAPFSMFYSAPTSSSTSIVVPIPAQNPRLERRLFLRLSWMDWSCACFFDSEEALTNLERKEEEGFGTSSFAAEEEKRRPSLNHAALSPLQVNSS

SEQ ID NO: 120158 - protein, 46 aa, Glycine max
  Coding DNA Sequence Number=SeqID_28473
MAKIQGLKEGKTYSNIYKEERTQPWSMGSKLYPGDLCSLRIEAFES

SEQ ID NO: 120159 - protein, 125 aa, Glycine max
  Coding DNA Sequence Number=SeqID_28474
MAAQLIRDRVEMECLEGAWEPSKATRDEPARTLQRTVEWILPTPTPYRLVEPVQVIEVTSSEEDPEEDLEELPPEPAVDALDFLEGDEDPLPEVDSPEEVMSASEADSTEDSGPREMATSGGSSS

SEQ ID NO: 120160 - protein, 251 aa, Glycine max
  Coding DNA Sequence Number=SeqID_28475
  Homolog annotation: Hit_ID=Q1GY43; Match level="QueryCoverage=98%, HitCoverage=95%, E-value=7e-55, Identity=46%"; Hit description =Putative uncharacterized protein
  Pfam annotation: Domain name=SoxZ; Domain location=148-249; Score =67.4; E_value=4.9e-17; Accession=PF08770.2; Description=Sulphur oxidation protein SoxZ
MALGMAGQVYAEADPKLWAVVKEAFFPKREIQEVDFLKIEAPRRAESGAQVPVTLIYDKAAANGVVLKKLYVIVDANPIQLASTYHLTDMLNGFQMATRIRQETDSFVRLIGETADGKLYMGKREIRAAGGCGGTVDNNEAEVRAAAGKIKLNVDAPKFGEPATATFNIRHVMRTGLQRDLVSQGYVPAFYINKTTFTYNGKEVMTVDVGVGTSEDPYMKFSFIPEAPGKLEVVATDNEGKTFTQSLDVHS

SEQ ID NO: 120161 - protein, 83 aa, Glycine max
  Coding DNA Sequence Number=SeqID_28476
PLGPSRIFLQKAVASGGSNLARLGELGGNHLPYFAINRGGSEEEKAEALPKRFRNVFREEFRKGFNRSSTFFIRSSSFFDLQR

SEQ ID NO: 120162 - protein, 65 aa, Glycine max
  Coding DNA Sequence Number=SeqID_28477
MGCKSPKKAEGVYLVKWGANSTQGHLGPPEYLQKAVASGGSNWLAGRAELAGRAGRQPPPLFCYK

SEQ ID NO: 120163 - protein, 71 aa, Glycine max
  Coding DNA Sequence Number=SeqID_28478
MSCTSSLSAPLHLSKCTASVHPLSEKGSLDWDSELCLSRVSRERKVQVPESFERFCCVKIYRDQSFKQEPV

SEQ ID NO: 120164 - protein, 212 aa, Glycine max
  Coding DNA Sequence Number=SeqID_28479
MIESFQQQQQMSVLELYVEKDVAGSSIFHSANSVLSCGHNLSHHESKLPRSISNLHDNEDDDLASNSYIEESLNEDDSVDGISDTDDEVTNIIEPISIVHPTEGVPGIQNPFWNDALHHNNVNWSHPDEDICGLDMPTTFNVGQELYVRMDFDSKDAVKNALKQYVMKVHQSFKVAETESHKYIVCCPNNSAESPCPFYMRAIYLKKLMPGK

SEQ ID NO: 120165 - protein, 215 aa, Glycine max
  Coding DNA Sequence Number=SeqID_28480
MTTLTQIWITLLLNNVLPNDHNSDLPLSKCQLVYAILTRMSVHVAQLIADAIYLFLVLITGLCQSFGVLVTPSKVIRLPITRAFIEKYCTPRQAQADAPQAADAPLPPHQADPAGSFGMERYLQHLVHQQAANHKGQVQLHECLYQLSLSQQSQGFAPFACPTPHQVRAEVAWPGDWPEAQAGEAPAEAPDDAEEARMDEEMTDVLSLLGGSGAT

SEQ ID NO: 120166 - protein, 774 aa, Glycine max
  Coding DNA Sequence Number=SeqID_28481
  Gene Ontology: Mol. function=motor activity; Cellular component=cell projection
  Homolog annotation: Hit_ID=UPI00006A2D9E; Match level="QueryCoverage =23%, HitCoverage=87%, E-value=1e-15, Identity=17%"; Hit description =UPI00006A2D9E related cluster
MRGTVHEPQAHLGAGQKFSPVDGGPLGTSTLALRGLHTLAFRGLHDLTFRELHALAFRGLHDLAFRGLHALAFRGLHVLAFRGLHALTYRGLHVLAFRGLHILDFKGLHVLHSESYTGLHVLAVRGLHAFAFRGLHALAFRGLHVLAFRGLHACTFKGLNTLAFRGLHVLTFRGLHALAFRGLNVLAFRGLHVLAFRGLHICAFRELKFLGHPSDLRGGPTVGAQLKEEAGNAPARHPVDSEKSNRVQGFPALIMNLRQFYGVPVTPSRVIRPLLTRLSLRSIVPPGRRRARHHSSGQQMHCHHLSSSTKAGVLPTTCGRPVGDQVQRQRDGKSNDMRRYLMVIHTFCQLEASESVDTKRLTSLSPPFLEMSASYGRHCENVFFAIHQTQGDGKSDDMRKYLMVIRTFCQLEASEPVDMRRLTSSSAPFPEMSASSGRDCEKVSLAIHQTQGDSKSDDMWRYLIVIPTICQLEASEPVDTQRLTSSFASIPEMSASSCPDCERVSFAIRQTQGDSKSNDMRGYLMVIHTFFQLEASEPVDTQRLTSSSAHFPEMSTSSGRDCEKVSLAIHQTQGSGCMQTLTSSSAPLSSRDGKSDDMRRYLMVICTFCQLEASEPIDTQRLTFELVDTQRPTSSSAPFLEMSASSGQDCKKVTLAIRQNQGDNKSDDMRRYLMAIRTLFQLEASESVDMQRPTSSSASFPEMSTSSDRDYKKVLYAIRQTQGKVSFAIRQTQGDGKSDDMWRYLMVIRTFFQLEASEPLDMQRLTSSSAPFSE

SEQ ID NO: 120167 - protein, 156 aa, Glycine max
  Coding DNA Sequence Number=SeqID_28482
MAQSLNILISSVSIYYGTESDIRVKSYCRLKSLRELRSFNFERLDIFGPQSDIRVKSYCRLNWLRASTFNFERLDILRASIRQLSKKLLSFELAQRFKTFNFERLDILRDYIRHPSKSYCRLNFLERFNISSVSIYYGPQSDIRIQRYCRLNWLRA

SEQ ID NO: 120168 - protein, 318 aa, Glycine max
  Coding DNA Sequence Number=SeqID_28483
GCINYNPALAIRQLGYRMRGAPMEESMSPFLVRDFGTQNFKAIQRIHKVWETPLRKDKELRGIHNGIIGGYHEWLKVHTRGLDWLAKLKVVSEESFEAPKGDEEVQALKNELGKARLAKEKFKLAATDIRKECAGLREENVTAARALEQETKRARKEEYGRNKFRGALWGSNSELKLRREERDQSRAHGMVLKEELVACSRSKRNLSQRLCETETNMLAIIAKYQEELSLATAHEHRVADEYAQVYAEKEARGRVIDSLHQEASMWDGPICSYLERESRTSPIASQGQSNGGHLLRPRGDPRTSRLLPAHDRFNDPYN

SEQ ID NO: 120169 - protein, 164 aa, Glycine max
  Coding DNA Sequence Number=SeqID_28484
  Homolog annotation: Hit_ID=A7PKN6; Match level="QueryCoverage=100%, HitCoverage=26%, E-value=7e-18, Identity=34%"; Hit description =Chromosome chr7 scaffold_20, whole genome shotgun sequence
  Pfam annotation: Domain name=zf-C2HC_plant; Domain location=20-75; Score=62.8; E_value=1.1e-15; Accession=PF07567.3; Description =Protein of unknown function, DUF1544
MAEPSSDVATASATRKNKTDPDWKYCHSLVEGDTNTIVCNFCEKITKVGIFRVKQHLIGKSGNVAACKKTPPNVVEELKKYMATKKSGTTYNTSGSEDEFVDSCNAAASAKTKCGTKKGPMDKFCKNPENAINRRKMEMLRQMNIRESMDKNEVLKVHQNIARF

SEQ ID NO: 120170 - protein, 75 aa, Glycine max
  Coding DNA Sequence Number=SeqID_28485
MKKQQWKRRCSGRQRRRGERRRHPLGNKPWKKEFHHQDEPWIKKLGEDASMEEKKEGEKERGGSTKLKDEKGREV

SEQ ID NO: 120171 - protein, 141 aa, Glycine max
  Coding DNA Sequence Number=SeqID_28486
  Homolog annotation: Hit_ID=A2Q6B4; Match level="QueryCoverage=99%, HitCoverage=55%, E-value=2e-11, Identity=30%"; Hit description =Ribosomal protein L33; Nucleic acid-binding, OB-fold
MARIPDKIRSIDGSKETLKLAVRIIDLWFVGTPNKSEQAEMVFVDSEFACFRVIKFMLFVPSDHLKSWKADLKENCTYVMHNFKVVKNDGQFRVCEHEYKLFFIGVTVVREADLQELSFKEFRFVAFANLVAGNFVSGLLV

SEQ ID NO: 120172 - protein, 67 aa, Glycine max
  Coding DNA Sequence Number=SeqID_28487
  Gene Ontology: Cellular component=chloroplast
  Homolog annotation: Hit_ID=Q3BAJ0; Match level="QueryCoverage=80%, HitCoverage=66%, E-value=8e-13, Identity=72%"; Hit description =Putative uncharacterized protein
MDEYASIRFMLVLGISKIRVAEAEAATFEVTERKATTGVGESESKRGFLTSFSHSKPCMRLSSRTAP

SEQ ID NO: 120173 - protein, 96 aa, Glycine max
  Coding DNA Sequence Number=SeqID_28488
  Homolog annotation: Hit_ID=A5B4R8; Match level="QueryCoverage=98%, HitCoverage=10%, E-value=6e-15, Identity=33%"; Hit description =Putative uncharacterized protein
MWIIDSGATLHVTARKEFFTFYAPGDLGVLKMGNDGVSEVLEDACYDNHFGSRKWKLTEGNLVVTKGEKISKLYWMKALFARDYVNAMDMEASLWH

SEQ ID NO: 120174 - protein, 125 aa, Glycine max
  Coding DNA Sequence Number=SeqID_28489
VDPWVLVPITLRGLHVLAIRGLHVLNFRGLRALAIRGLHVLALRGLHALTLGLHVLTIRGLHALTSRGLHVLALRGLHALTLEGYTPSPWVLVTLTVERTTRPRLERTTRPHHQRARTPSLQRTT

SEQ ID NO: 120175 - protein, 222 aa, Glycine max
  Coding DNA Sequence Number=SeqID_28490
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=3e-15, Identity=29%"; Hit description= UPI00006A17C9 related cluster
  Subcellular localization annotation: CTP_CleavageSite=72; ConfidenceScore=5.29e-01
MLVRMIRTRLFATAQVKSCPGMHSSCVTASLSGCARTVGPPPISGGGPRTVKGKLLVWIWSPLKVRTHSPLKARACSPLKFKTCRLSKARECSPMMARTCNPLKVRACSPTKVKAHDPLTAGTCSPLKLKVHDPLKARTCSPLKVKARTYSPLEVRACSPLVVRTCSPLKARTCSPLTVRVRACSPLKARTCSPLEVRACSPLMVRTCSPLKGRTCSSLNGE

SEQ ID NO: 120176 - protein, 264 aa, Glycine max
  Coding DNA Sequence Number=SeqID_28491
MVNPHTPLAIQTQSCPMARRDKLWSFCTLLSSRGGGPDDMRRQIMVITHILLPFRHSRVRWHAETNYGHSAPLYHPEVAGPMTCGDKLWSFRTPLLPFRHSRVQMARRDKLWSFCTLLSSRGGGLDDMRRKIMVIPHTPFAIQTQLCPMARRDKLWSFCALLSSRGGGSDDMRRQIMVIPHTPFAIQTQSCPMARRDKLWSFCTLLSSRGGGPDDMRRQIMVIPHTPFAIQAQSCPMARRDKLWSFCALLIIQRRRPMTCGDKL

SEQ ID NO: 120177 - protein, 146 aa, Glycine max
  Coding DNA Sequence Number=SeqID_28492
MGKAEEVQEQMKADMEVMKEQMATMVEAMMSMRKIMEANAVAIAATSAVAKVNPVPPYDLNQMSHPTSDMVGKDLGSTDDPMMCKFKTSMPSRHMACLPTIHHPMWHTLPMRMLITPLPYSLRADNLIMYMSLNPWGRYMKFPTTI

SEQ ID NO: 120178 - protein, 141 aa, Glycine max
  Coding DNA Sequence Number=SeqID_28493
LARQGASAVVAGCRCWLNYAASEQIVLAIGAGLFDITPAGERGMCCKAIKLAPRQGFPSHDVEWFKVVSTNRDQDLVSKKRVINDILSEDDNGCEDRNNSNDAPGCASAMNDIADQEVVDHGIARNGKLFESAGGVPSSNS

SEQ ID NO: 120179 - protein, 85 aa, Glycine max
  Coding DNA Sequence Number=SeqID_28494
MSQAEPINVNIGNPIEEMICDLGQEGFEQAHAPLDEFAEMHCYPICGVSRYRVNDGEYSVDATANNRRLAKRKYIMLSMMIAGPR

SEQ ID NO: 120180 - protein, 91 aa, Glycine max
  Coding DNA Sequence Number=SeqID_28495
DGAYETPYGPREVQWGPGVPSFDHGPLPDLRSARRRQQGHSASHYQSLHREVLHPQASAGLGTAAARGGSAASGKCATAATRGGIVFEIPL

SEQ ID NO: 120181 - protein, 82 aa, Glycine max
  Coding DNA Sequence Number=SeqID_28496
MGGRTVARDLAPINLEIEATCRRNNAARKRREKEAQGCSQTSPPPTPQSYIQMEEKHARQMTLGDYSSTATPQFFTSIARPE

SEQ ID NO: 120182 - protein, 208 aa, Glycine max
  Coding DNA Sequence Number=SeqID_28497
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=98%, E-value=7e-14, Identity=28%"; Hit description =UPI00006A17C9 related cluster
  Subcellular localization annotation: CTP_CleavageSite=12; ConfidenceScore=5.34e-01
MLVRMIRTRLFAAARVKSCPGMHSSCVIASLSGCARTVGRPPISGGGPGTVRMWSTLKMRTHSPLKARACSPLKFRTCRLSKARECSPMMARTCNPLKVRTCSPLKVRACSPTKVKAHDPLTARTCSPLKLKVHDPLKARTCSPLKVKARTYSLLEVRACSPLVVRTCSPLKARTCSPLTVRVRACSPLMVRTCSPLKARTCSPLNGE

SEQ ID NO: 120183 - protein, 76 aa, Glycine max
  Coding DNA Sequence Number=SeqID_28498
MSVKNHPGRLGVHNKTHHTMGLSGLKEHSNPVTPKAYTPKSPSGPLPPDLGPTPKIILHADTAHELYNTHDLTLVF

SEQ ID NO: 120184 - protein, 410 aa, Glycine max
  Coding DNA Sequence Number=SeqID_28499
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=38%, E-value=0.0, Identity=76%"; Hit description=NBS-LRR type disease resistance protein Rps1-k-1
  Pfam annotation: Domain name=LRR_1; Domain location=149-170; Score =6.9; E_value=16; Accession=PF00560.24; Description=Leucine Rich Repeat
  Pfam annotation: Domain name=LRR_1; Domain location=284-305; Score =3.5; E_value=69; Accession=PF00560.24; Description=Leucine Rich Repeat
  Pfam annotation: Domain name=LRR_1; Domain location=307-329; Score =3.7; E_value=62; Accession=PF00560.24; Description=Leucine Rich Repeat
  Pfam annotation: Domain name=LRR_1; Domain location=365-388; Score =13.8; E_value=0.66; Accession=PF00560.24; Description=Leucine Rich Repeat
  Pfam module annotation: Pfam domain module=LRR_1::LRR_1::LRR_1::LRR _1; Domain location=149-170::284-305::307-329::365-388
MAEDLLKKPRKGRTLEEVGHEYFDDLVSRSFFQRSNTSRSSWPYGKCFVMHDLMHDLATSLGGDFYFRSEELGKETKINTKTRHLSFAKFNSSVLDNFDVVGRAKFLRTFLSIINFEAAPFNNEEAQCIIMSKLIKLTKLPSDMCNLVNLRHLEILGTPIKEMPRGMSKLNHLQHLDFFAVGKHEENGIKELGALSNLRGQLEIRNLENVSQSDEALEARMMDKKHINSLQLEWSGCNNNSTNFQLEIDVLCKLQPHFNIESLYIKGYKGTRFPDWMGNSSYCNMMSLKLRDCDNCSMLPSLGQLPSLKVLKIARLNRLKTIDAGFYKNEDCRSGTPFPSLESLAIHHMPCWEVWSSFDSEAFPVLEILEIRDCPKLEGSLPNHLPALKHLQLEIVSCLALLSQKAPAIQ

SEQ ID NO: 120185 - protein, 73 aa, Glycine max
  Coding DNA Sequence Number=SeqID_28500
  Subcellular localization annotation: CTP_CleavageSite=21; ConfidenceScore=5.07e-01
MKARACSPLKVRTCSPLKVKTCSPLKERTCSPLKARTCSPLKKDYDSSCNLILSFANLSKNSLRVYVLFDLVT

SEQ ID NO: 120186 - protein, 37 aa, Glycine max
  Coding DNA Sequence Number=SeqID_28501
MPRAHKSTTHHSAYFGKRALETGRGVAFAGIPRFWIL

SEQ ID NO: 120187 - protein, 109 aa, Glycine max
  Coding DNA Sequence Number=SeqID_28502
GSRPQDTQWTRRSQHGPEVSSSDYEPLSVLRSACRPQQGHQTHTNRAFIKMYCAPRQAQGEAPQQPGDGRQRAADALPPPPKPLSSSTKAGALPTTRGRPAGDQVQSQR

SEQ ID NO: 120188 - protein, 232 aa, Glycine max
  Coding DNA Sequence Number=SeqID_28503
  Homolog annotation: Hit_ID=Q6WAY4; Match level="QueryCoverage=80%, HitCoverage=33%, E-value=2e-19, Identity=31%"; Hit description =Putative uncharacterized protein
MRHHVKSLELASLQRLGQWIDQVQCQAFRKAYWKIWDLAMIEVSVEAIASLAQYYDQLIRCFTFGDFQLVPTIEEFEGILGCPLGRRKPYLFFGFYPSMEIVAKVVKISAQELDRLKQKMSGVVGIPRQHLEEKAKSLADQEEWTSFMDILALLVFGIVLLPNVDGLVDLAAIDTFLAYHHNKESPVIAILANAYDTFDLRCQKSSVDLFVPYKVIACVPKREKQIGRNSWQ

SEQ ID NO: 120189 - protein, 78 aa, Glycine max
  Coding DNA Sequence Number=SeqID_28504
MEETLAQFMQVSMSNQKSTKSAIKNLEVQVGQLAKSRMEIHVDESEAEKKIEEHKQQLAPKPALESVSDFVELEDINE

SEQ ID NO: 120190 - protein, 77 aa, Glycine max
  Coding DNA Sequence Number=SeqID_28505
MRIPFLQAKVQKGLRLCFNGVFYPGNPNLDIWGETNLGVKSWLHQVGPQASRLWHCDTTVGNYTDPTFPNYVLLSAQ

SEQ ID NO: 120191 - protein, 166 aa, Glycine max
  Coding DNA Sequence Number=SeqID_28506
TWLRRKVRPFKEYVERWRDPGSTSGPFHGRKGDDYHDGYMPSSFADLVFAGERIEVGLKRGKFDYVSSTSTNARRIGATGAKRKEGDTHAVTSAPVMGQATVDLSWYPSGGPPSSSSNHDSPGQQCPLWCQFQRDEELSPEANSRIHPDPNDLRRPLAVPHRQPDG

SEQ ID NO: 120192 - protein, 136 aa, Glycine max
  Coding DNA Sequence Number=SeqID_28507
MDRARLVYGLVTHMDMNIDALISGQISSIAQSNSFRLRFPALITALCRARGVTSDTLTYESLSPTINLAYIKKNCWNMDDLIVNFRGARKARARPTDVPSSSTPPAPSTFATPTPTSPGPSAQDSQRFESMLQSLY

SEQ ID NO: 120193 - protein, 209 aa, Glycine max
  Coding DNA Sequence Number=SeqID_28508
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=45%, HitCoverage=10%, E-value=5e-09, Identity=35%"; Hit description =Gag/pol polyprotein, 3'-partial, putative
  Pfam annotation: Domain name=G-patch; Domain location=43-82; Score =25.6; E_value=0.00015; Accession=PF01585.14; Description=G-patch domain
MPYVEAAEESLEMTFQSFEVVSIASVDSFFGQPCLSDAAIMMARVMLGNGYEPGMGLGKDNGGITSLISAKGNRGKFGLGYKPTQADIKKGITGRKSRGQGSQLGQEVKRGPPCHISGSFISAGLGHEGQVVAICEDDSPCGSESDDESLEGTNTWDPTIDFEQETNQTEDEENKDVGLPPESDKIVAHEDQEMWPHKKETELVNLGTD

SEQ ID NO: 120194 - protein, 180 aa, Glycine max
  Coding DNA Sequence Number=SeqID_28509
MAPRKLASKRSRKDKLAEGTSSAPEYDSHRVRSAEHQQRFEAIKGWSFLQERRAQLRDDEYTDFQEEIVCRRWASLVTPMAKFDPDIVLEFYANAWPTEEGVRDMRSWVRGQWISFDADAISQFLGYPLVLEEGQECEYGQRRNRSDGFNEEAIAHLLCILGQILPGLLPGDGCGSCAPT

SEQ ID NO: 120195 - protein, 155 aa, Glycine max
  Coding DNA Sequence Number=SeqID_28510
  Homolog annotation: Hit_ID=A0ST23; Match level="QueryCoverage=28%, HitCoverage=85%, E-value=2e-12, Identity=81%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPIADFGLAKILQGGAGNWTNVIAGTVGYMPPVGKPVVPAALMNRPTRGERRFAYWALFRFLAH

SEQ ID NO: 120196 - protein, 244 aa, Glycine max
  Coding DNA Sequence Number=SeqID_28511
  Gene Ontology: Mol. function=motor activity; Cellular component=cell projection
  Homolog annotation: Hit_ID=UPI00006A2D9E; Match level="QueryCoverage =94%, HitCoverage=97%, E-value=1e-15, Identity=18%"; Hit description =UPI00006A2D9E related cluster
MRGIVHEPQGEPLGTSTLTSRGLHVLAIRGLHVLTFVGLHALTFRGPHILTFRGLHALAIRGLHVLTFRGLHALAIRGLHVLTFRGLHALAIRGLHVLTFVGLHALTFRGLHVLANRGLHALTLRGLHALAIRGLHVLTFVGLHALTFRGLHVLANRGLHALTLRGLHALAIRGLHVLTFVRLHALTFRGLHVLANRGLHALSLRGLHVLANRGLHALTLRGLHALTSRGLHTLALRGLHALNF

SEQ ID NO: 120197 - protein, 48 aa, Glycine max
  Coding DNA Sequence Number=SeqID_28512
MVVAHRDWFLSSKPSGNRLQAAVIDYRLSVLVQSITLNGNRLPEHKLG

SEQ ID NO: 120198 - protein, 71 aa, Glycine max
  Coding DNA Sequence Number=SeqID_28513
MTPTHDALRYYNGRWNMPCQNDFVDYSFTRKNLKKFDIPSGCSMDELKDLIKQVAPHGIPPYGIHETQMLM

SEQ ID NO: 120199 - protein, 187 aa, Glycine max
  Coding DNA Sequence Number=SeqID_28514
MAPRKLVSKRSRKDKVAKGTSSAPEYDSHRFRSAEHQQCFEAIKEWSFLRERRVQLRDDEYIDFQEEIVRRQWASLVTPMAKFDPDIVLEFYANAWPTEEGVRDMRSWVRGKWIPFDADALSQFLGYPLVLEEGQECEYSQRRNRSDGFDEEAIAQLLCIPGQDFARTAAGRQVRIMRTNMTTLTQI

SEQ ID NO: 120200 - protein, 63 aa, Glycine max
  Coding DNA Sequence Number=SeqID_28515
MEVLLSPIALKVVGPLLLDSNSSRDGTNPPFNSYMATHKQGNKETSDNQRPKKLNMKAKPMEF

SEQ ID NO: 120201 - protein, 105 aa, Glycine max
  Coding DNA Sequence Number=SeqID_28516
  Subcellular localization annotation: CTP_CleavageSite=82; ConfidenceScore=5.14e-01
MRTRSPLKVRACSPLKARMCSPLEVRACSPLLARMSLCWRGRVVLSRRGHVVLWRKCRPLLARTCSPLKARTCSPLEVRACNLLMVRTCSPLKARTCSPLNGEGN

SEQ ID NO: 120202 - protein, 218 aa, Glycine max
  Coding DNA Sequence Number=SeqID_28517
  Homolog annotation: Hit_ID=A2Q4S5; Match level="QueryCoverage=74%, HitCoverage=26%, E-value=4e-18, Identity=34%"; Hit description=IMP dehydrogenase/GMP reductase, putative
  Pfam annotation: Domain name=DUF1723; Domain location=125-174; Score =58.4; E_value=2.4e-14; Accession=PF08330.1; Description=Protein of unknown function (DUF1723)
MYKDNWTQPWPMGSEIYPKVHENPRAFFNSSSPIFLEPLAHGSSDWSLPREDCIKGFPSGPHDASVLRDFENHIALRVWNGEERPELKLSSHGRKMVKFGRPALEIEGLVAASGLCPLITCSLDTNDRELMSAFVECWLKETRSFHFPVGEVTITLDDITPLLHLPIVGALHSFELLHVDDAVDMLVELLEVSAAKARAEMIQCHGSYVRLSWLRDVY

SEQ ID NO: 120203 - protein, 75 aa, Glycine max
  Coding DNA Sequence Number=SeqID_28518
TLVSIATSLRLEFIPQVKELLDEGLVRKRLNPCALLVLRKKAQSFKNLGISGQILFKGQGMMASYPARALDRTLQ

SEQ ID NO: 120204 - protein, 414 aa, Glycine max
  Coding DNA Sequence Number=SeqID_28519
MPANYVDLVFAGERIESGLRKGKFEYASNAAPNNNRRAPVVGARKKEGDTYAVTTGPTWMKAPQNIQSSYQPNPPNFSIRAGSSLPTQVEGAPAAERTPAQHTAPATPRPVNNTAPDTSYNNARCPPPKDDFSLIPMAYSELWPSLLENHLVVAIPAKVFQPPYPKWYNPEAKRALTLKLTPLASHGGASINAIGKRMGHHGQRDWKMWLHLGVHLPVAASGMHGLSVVLPAVEELLQRLKDWGQLEVSKGGREEPQICMQSEEKKVPPTPKALVICFTRKGTGSTPIYPWTAPKPISIAYQSNKVVPWKYTPPAFGERVATEVDSLSAKVTNITGLSGVTRSGRVFAPPHSAELPSKGKAPMIQEPADVATPSKEVDPPVERGAEKKKGLQGKTVTLEEAHEFLRLIQQSEFK

SEQ ID NO: 120205 - protein, 192 aa, Glycine max
  Coding DNA Sequence Number=SeqID_28520
  Homolog annotation: Hit_ID=A5BSR3; Match level="QueryCoverage=65%, HitCoverage=43%, E-value=1e-07, Identity=31%"; Hit description =Putative uncharacterized protein
  Pfam annotation: Domain name=Transposase_23; Domain location=80-141; Score=-14.0; E_value=0.04; Accession=PF03017.5; Description =TNP1ENSPM transposase
MARTKKTGEMTTEAAKKIAEKIGSFVPHGRQDVLAAAIGRPEHPGRVRATGAGVTIKQYFGSAPRTSRSASSLPPDELQQLTQQIRDQLEESITEKVTRQETILRQVTLTVKVSVDEVKDADAPVPVPTDEVSLVGQALHTFLAWPTHLVKSLSHQVVVSPPKPPPKPDPEVDDPLYLMTLTIPKLFLRPYQ

SEQ ID NO: 120206 - protein, 91 aa, Glycine max
  Coding DNA Sequence Number=SeqID_28521
  Homolog annotation: Hit_ID=Q9KHC4; Match level="QueryCoverage=46%, HitCoverage=8%, E-value=2e-07, Identity=69%"; Hit description=SocE
MVELVKNSRVMKKAQAKVSIHGLPFLGYRARIRNHGHSCFLRETCRASCINESANARGEAVCVLGALPLPRSLTRCARSFGCGERYQLTQR

SEQ ID NO: 120207 - protein, 341 aa, Glycine max
  Coding DNA Sequence Number=SeqID_28522
  Subcellular localization annotation: CTP_CleavageSite=12; ConfidenceScore=5.26e-01
SSFLSLTHSLSLAAAETRRVAAILTVPPLPSRRVAAILTVPFQLEKEVKRQNPVRVVVCSSLLVSLLMSETPKLDILTAAIGRPEHPSRVCAVGAGVTIKQYFGSTSRTSHNSSFPPDAEALVLVPTDEVTLVGQTLNTFLAWPTHLAAVSPAKPPESPDEEVDDPLYLMTLTIPQLFLKPLQVMWDATIFGVFNQNFPLYIKHEDLTEIAHGGQCLSISVIQLWILHLTETSVRAGNSDVYGFLEPQSIQKSGQSQFESESYIKNWIQSSKRDVYLGAYLNGGHWQMVVILPKENLVVWFCSLHNKSDNYLKRIINSALKGLDDTPQPKSKAATRWIVVK

SEQ ID NO: 120208 - protein, 304 aa, Glycine max
  Coding DNA Sequence Number=SeqID_28523
  Gene Ontology: Cellular component=membrane; Biological process =protein secretion
  Homolog annotation: Hit_ID=Q1H0T1; Match level="QueryCoverage=82%, HitCoverage=83%, E-value=1e-44, Identity=42%"; Hit description=Type II secretion system protein
  Pfam annotation: Domain name=GSPII_F; Domain location=159-289; Score =51.0; E_value=4.1e-12; Accession=PF00482.14; Description=Bacterial type II secretion system protein F domain
MNIFWLIATLLMLLAAGFLLYSAQKDNHPKHIHRRFREALQQEGIHISARFTPLNLTEIIQATLAKVSHSEMEEMQHLLLQAGWPGAKATFTFLLLAWLLPVAFGLLAAFYAILTQDSAVNVLFHLVFAFAATFVLIRRLLRWKAQKRREAIRKEVIPFLHLLRMLFEAGLSLEHILLVIEQQGRDLIPNLAKELEGVIKRIHTGQDRADALVEMAAPLEVTELNDTIAMLKQVTRYGGNVRDSLAEYTTLTEQRQVSQLREYVSKLSAKRTIVMILFLFPALMAFLAGPGFIGLSKALKGVGG

SEQ ID NO: 120209 - protein, 53 aa, Glycine max
  Coding DNA Sequence Number=SeqID_28524
MVKACQKGGNRGRWLPPSSPRRAGLLPPEGIAFCWNTLEGPSGPGCYLHTPFY

SEQ ID NO: 120210 - protein, 145 aa, Glycine max
  Coding DNA Sequence Number=SeqID_28525
  Gene Ontology: Mol. function=nucleic acid binding; Biological process= DNA integration
  Homolog annotation: Hit_ID=A5AYU6; Match level="QueryCoverage=50%, HitCoverage=13%, E-value=1e-14, Identity=49%"; Hit description =Putative uncharacterized protein
RAYFYLGYNTENSRGYISCGSVQVERTSTWCYIEHKGGDILWGSLLEKDFTRLKEISRTGGCLGTGCRHGRFQDYDEDQANLCLMTKSHEKNEEEFVKKKWYIDSGCSKHMTGDISKFTTISPKKSGHVTYGDNNKGKIIGVGKI

SEQ ID NO: 120211 - protein, 191 aa, Glycine max
  Coding DNA Sequence Number=SeqID_28526
  Gene Ontology: Mol. function=3-oxoacyl-[acyl-carrier-protein] synthase activity; Cellular component=chloroplast; Biological process=biosynthetic process
  Homolog annotation: Hit_ID=Q5ECI5; Match level="QueryCoverage=50%, HitCoverage=19%, E-value=3e-34, Identity=79%"; Hit description =Plastid 3-keto-acyl-ACP synthase II-B
  Pfam annotation: Domain name=Ketoacyl-synt_C; Domain location=67-182; Score=77.6; E_value=4.1e-20; Accession=PF02801.13; Description=Beta -ketoacyl synthase, C-terminal do
MRKEKIPHQAPFAIQAAQLLGRAIGAGLFAITPAGERGMCCKAIKLGNARVFPVTTLSTLEDPHIALCPCRSFQAYTCAYVFFIPSQTGAGVILCIEKALAQSGVSKEDVNYINAHATSTPAGDLKEYQALMHCFGQNPELRVNSTKSMIGHLLGAAGTELEFVIMVIAVSCVKLLSAHNSTQHTSRKHKV

SEQ ID NO: 120212 - protein, 61 aa, Glycine max
  Coding DNA Sequence Number=SeqID_28527
MSPDFTGQDDKGAEDDTLGSLDSKGCVRVTVRCLRMPPDSWVTVTKGGVVDKSRAFAPTYP

SEQ ID NO: 120213 - protein, 89 aa, Glycine max
  Coding DNA Sequence Number=SeqID_28528
  Homolog annotation: Hit_ID=Q7PDL8; Match level="QueryCoverage=68%, HitCoverage=8%, E-value=6e-07, Identity=40%"; Hit description =ERYTHROCYTE MEMBRANE PROTEIN PFEMP3
  Subcellular localization annotation: CTP_CleavageSite=80; ConfidenceScore=5.37e-01
MCSPLKVRTCSPLKVRACSPLMVRTCSPLKVKVHDPLKARMCNPLKVRACSPLMARTCSPLKARTCSPLMARTCNLLKVRVLVPKGPSL

SEQ ID NO: 120214 - protein, 67 aa, Glycine max
  Coding DNA Sequence Number=SeqID_28529
LGGRTFRHKLQENGSNVACSIASEYNLGLRPFHSNPQFKKTSTKVSYPNFVQGPLLDDMRLLFGPCE

SEQ ID NO: 120215 - protein, 90 aa, Glycine max
  Coding DNA Sequence Number=SeqID_28530
  Pfam annotation: Domain name=zf-CCHC; Domain location=10-27; Score =12.9; E_value=0.017; Accession=PF00098.14; Description=Zinc knuckle
MGAKYLEAVKQSFNCQKFGHFADECYSKPNNKREPKGDDAKLAQEEDDDTEQSQVKFADDRTLSAEGIGKVLIKTKDRGQSCITDVLFVP

SEQ ID NO: 120216 - protein, 321 aa, Glycine max
  Coding DNA Sequence Number=SeqID_28531
  Gene Ontology: Mol. function=RNA-directed DNA polymerase activity; Biological process=regulation of transcription, DNA-dependent
  Homolog annotation: Hit_ID=A5C5U6; Match level="QueryCoverage=82%, HitCoverage=12%, E-value=3e-47, Identity=38%"; Hit description =Putative uncharacterized protein
MEPEYWDKNPFKATAKVFPPRFHYRSTAINKTRKFYEFILIDTNSVSIKHFKDPKDPNLNTHSTIQILKVMQPRHYGSNLNQPKKIFAPFDPAGYNYWDYIDAWTNVLWHQNSKIKHSWLIYFKNNTVYNFPNWFLQWWNYFGPIPQIFPEEVQQGFQQFNKLYNSKESRIPTDLKYFSSFALSWIFSWQYRYGKTENSKQYPPLQRHAFVKWWSQFDTSKAAPDQVKNWFQSNPEFLKPADPETSLFLNQKSQLAAFLASSKSKESLAQNLKEVLQLVQQEVEEEPSKKEAESSETNDDQEDDPFYQNEDDCFGISLDDD

SEQ ID NO: 120217 - protein, 252 aa, Glycine max
  Coding DNA Sequence Number=SeqID_28532
  Homolog annotation: Hit_ID=Q84VH5; Match level="QueryCoverage=100%, HitCoverage=37%, E-value=1e-72, Identity=61%"; Hit description =Envelope-like protein
MATSPKETSASGSPSVPSSPHQGQPEFNIQPIQIIPGQAPVPEKLVPKRQQGVKISENPSLATSPREVDTEMDKKIRSIVSSILKNASVPDADEDVPTSSTPNVSVPDADKDVPTSSTPNAEVLPSPSEEESTEEEDQATEETPAPRAPEPAPGDLIDLEEVESDEEPIANKLAPGIAERLQSRKGKTPIKRSGRIKTMAQKKSTPITPTTSRRSKAAIPSKKRKEISSSDSDDDVELDVPDIKRAKTSGKK

SEQ ID NO: 120218 - protein, 68 aa, Glycine max
  Coding DNA Sequence Number=SeqID_28533
MALTPHTHIEILGPIPGSIVSHKDWSSICGHAGSSTRLITVKPHLEFSSFGDALSLTVLIATMYYLRG

SEQ ID NO: 120219 - protein, 93 aa, Glycine max
  Coding DNA Sequence Number=SeqID_28534
  Homolog annotation: Hit_ID=A5C306; Match level="QueryCoverage=92%, HitCoverage=6%, E-value=6e-13, Identity=45%"; Hit description =Putative uncharacterized protein
MVRSMGYKFYDPTLRSIFETGNARFLEEVEFGKEENIRKVLFEEKPIIDSSQVLIPIVVQETTPVIENSVQTIVDDIVQEQDNDEVLPQIPIQ

SEQ ID NO: 120220 - protein, 111 aa, Glycine max
  Coding DNA Sequence Number=SeqID_28535
  Homolog annotation: Hit_ID=Q2A9E0; Match level="QueryCoverage=61%, HitCoverage=4%, E-value=1e-10, Identity=52%"; Hit description =Putative uncharacterized protein
MASDKLDSSAVCDLKLKLISDRKTDGRLYNLPNAFEVAALIVGDEHTTNNRDIIIEKQTGMLQRINELHPAYLPLQYPLLYPHGCNQGIMKHEQYFIQEDCFTNGLLMGIV

SEQ ID NO: 120221 - protein, 130 aa, Glycine max
  Coding DNA Sequence Number=SeqID_28536
  Homolog annotation: Hit_ID=B0HC01; Match level="QueryCoverage=26%, HitCoverage=74%, E-value=2e-11, Identity=94%"; Hit description =Putative uncharacterized protein
SGSEQESARGSFQGDTPGIFIVLSGFATSDLSVDFCDARQGDGAYGKTPATRPFYGSWPFAGLLLTCSFLRYPLILWITVLPPLSELIPLAAAERPSAANRLSPRVGRFMNAAGTTGFPTGKRAVSATQL

SEQ ID NO: 120222 - protein, 85 aa, Glycine max
  Coding DNA Sequence Number=SeqID_28537
  Homolog annotation: Hit_ID=A6FJQ2; Match level="QueryCoverage=44%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGLREFYGSITEAPKAIFQQNEVEGCRPARPSELGCFLLK

SEQ ID NO: 120223 - protein, 230 aa, Glycine max
  Coding DNA Sequence Number=SeqID_28538
MSEPSFLGRLLLWPSLTPEDLDFLLLSQLYARPEEFPPIVLSLKGSRRPRARPAKTPSTSAAPHPASTSAAPPPARIAATPSTPPPGEFQHFKAMLRSIHQGQIILLQTWPGTQPPLHRDDEDPAAQVPHQPLDESSESSTPKPLIRKRRVVVTQEAAATPEKSPEATPEPPVPMANTTSPQQAADPSTPEVQTTPVLSPNTSLVATPVLHLTNEEEVQTQDTQDQSQDL

SEQ ID NO: 120224 - protein, 92 aa, Glycine max
  Coding DNA Sequence Number=SeqID_28539
  Gene Ontology: Cellular component=nucleus; Biological process=cell division
  Homolog annotation: Hit_ID=A7NUY9; Match level="QueryCoverage=97%, HitCoverage=16%, E-value=2e-12, Identity=36%"; Hit description =Chromosome chr18 scaffold_1, whole genome shotgun sequence
ADKAIAEIEAKCGQKIEECKEEHRQQLMRIEDEHTLLIKALRCELEDECQKLEEELHLQKSKEDRQRALLQLQLKVMSDKPKEDQEVNSKQI

SEQ ID NO: 120225 - protein, 211 aa, Glycine max
  Coding DNA Sequence Number=SeqID_28540
MPISPYGSISRSVLFRHRDRTHKTPSGPGEVQQGPEVSNFGYGPQSVLQGAHSPQQGVAPTRHPVDPEEPNRALGFPALVTSLCQSYRAPIPPTSSCHRDIGITPARHSMDPEKSNMVLGFPALIIGLCQFYGVPISPNKVIKPPTNRAFIKKYCAPRLAQGETPSQPGDGQQQATYAPPPPPKPLSPSTKAGMLPTTCGRPAGDQVQSQR

SEQ ID NO: 120226 - protein, 221 aa, Glycine max
  Coding DNA Sequence Number=SeqID_28541
  Homolog annotation: Hit_ID=Q84VH5; Match level="QueryCoverage=93%, HitCoverage=30%, E-value=3e-68, Identity=69%"; Hit description =Envelope-like protein
MIPGQAPVPEKLVPKRQQGVKISENPSLATSPREVDTEMDKKIRSIVSNILKNASVPDTDEDVPTSSIPDVAVPDAEKDVPTSSTPNTEAVSSPSKEESTEKEEQATEETPAPRAPEPAPGDLIDLEEVESDEEPIANKLAPGIAERLQSRKGKTPIKRSGRIKTMAQKKSTPITPTSSRRSKVAIPLKKRKEISSSDSDDDVELDVTTSKRTKTSGKKVP

SEQ ID NO: 120227 - protein, 126 aa, Glycine max
  Coding DNA Sequence Number=SeqID_28542
MVGYMPLSFADLVFAGERIEVGLRRGKFDYATSTSAGNRRIGTGGAKKKKGDAHARMPTQPQRLPPHNPFPAQPRPTGNPNPDTNTNPRRNFLERKPAEFTPILMPYANLLPSLLSNQMAVVSPGK

SEQ ID NO: 120228 - protein, 280 aa, Glycine max
  Coding DNA Sequence Number=SeqID_28543
PLDKGRREEEAKTRVLAFPVETKERMFRGNNDDEFEFDGGFDFDKEEALYKELETLIHSENTAPSMMFPLEDATHVHSGDSDSDGGSDNNKLQVFELENSLVQLPPKLSSLSVPPPTESMLPHTQFHGGFDEWDDTLVYLPPIEETLDQLENTAPRLLSPSAEETLDHLLSLSTPMLLQELLESKNTAPAPSLLPLSTPMLLQDTLVHLPPLSLPDNTSPRVFTPAGHITLLPQTQTANRPSTSSASSSHNRCNRWTNEEHMLFLQGLAIYGKGDWKNIA

SEQ ID NO: 120229 - protein, 100 aa, Glycine max
  Coding DNA Sequence Number=SeqID_28544
MHRSPTGNLVPLDLEIEATLRRNRAKRRRKLLQDRTIASILEEQTHFSDSLSPGSPSSRESATQLPETTIMANEQHQRITLEDYSSSSVPQFFTSIAHPK

SEQ ID NO: 120230 - protein, 38 aa, Glycine max
  Coding DNA Sequence Number=SeqID_28545
MDCKGPRDKELQIDRGMTLTDTPKSSMAFFNIVVPNNA

SEQ ID NO: 120231 - protein, 71 aa, Glycine max
  Coding DNA Sequence Number=SeqID_28546
MKKVREQRSEEGETNSMFGGTISPGWIHKRKTARKPHYKRNLKESWASSSKGNNTRKSSLPWIQTENANET

SEQ ID NO: 120232 - protein, 144 aa, Glycine max
  Coding DNA Sequence Number=SeqID_28547
MAREAKVVKISAQELDQVKQNRNRVVGMPRKHLEEKEKALADQGEWTSFIDVLALLLFGIVLFPNVDGLVDLAVIDTFLAYHRNLSAPYKVITCVPRKEKQIGRNSWQARTQGITWLPKLKSPSGGEAEVLEESEESASLESRA

SEQ ID NO: 120233 - protein, 110 aa, Glycine max
  Coding DNA Sequence Number=SeqID_28548
MKFLYLFRAHLQLLVLCPGDNLVVWFCSLLKKPDASIKGVVNSAMKSVSKTAEGKPPQHGPQWIEAKSHVQTGNYECGYYVMHWIWCIVSAGLKDEWIHVYFLLFISSSL

SEQ ID NO: 120234 - protein, 228 aa, Glycine max
  Coding DNA Sequence Number=SeqID_28549
MGPSVATEDEEVQALRAELEQAQTVKVKFKSAALKIRKENVELRDTNIATTKALERETKRARREEHIRNKFRRAMWGSNSELKLQREERDQSRVDSLILKDELKACSRSKRSLSQQLCEAETHMLAIISKYQEELNLATAHEHKVADEYAQVYAEKEARGRVIDSLHQEATMWMDRFAFTLNGSQELPRLLAKAKAMANTYSVPEEIHGLLSYCQHMIDLMAYIIRNR

SEQ ID NO: 120235 - protein, 94 aa, Glycine max
  Coding DNA Sequence Number=SeqID_28550
MVPVLITTCIPIIIIAQTTTLFIRQGTTVDRRMRPHFEIPPACLIALRQTTEQWIFIINIEQRHTFDDFPGSLKVKHNGLPKSIPTCSGDSFLS

SEQ ID NO: 120236 - protein, 136 aa, Glycine max
  Coding DNA Sequence Number=SeqID_28551
  Homolog annotation: Hit_ID=UPI0000ECBAF8; Match level="QueryCoverage =30%, HitCoverage=48%, E-value=1e-16, Identity=100%"; Hit description= UPI0000ECBAF8 related cluster
ACRPQQGHQVPPTNRAFIKKFCVSRQAQGETPQQPGDGRQRATDAPPSPLEFTSAHPQKGLSIAYTTWPTNRRPSPKPKSRPAGMQAWHWPSFYNVVTGKTLALPNLIALQHIPLSPAGVIAKRPAPIALPNSCAA

SEQ ID NO: 120237 - protein, 56 aa, Glycine max
  Coding DNA Sequence Number=SeqID_28552
  Homolog annotation: Hit_ID=A0ST23; Match level="QueryCoverage=80%, HitCoverage=91%, E-value=1e-11, Identity=73%"; Hit description =Putative reverse transcriptase
MAWLSFQVAWGTELEFVIMVIAVSFGKPVVPAALMNRPTRGERRFAYWALFRFLAH

SEQ ID NO: 120238 - protein, 127 aa, Glycine max
  Coding DNA Sequence Number=SeqID_28553
VDSRGSLEDYTSLPSEGYTPSTLEDYMSSPSKGCTPSPSEGYTASPSGGLHVLTFRGLHALSFKGRHILNFRGLHALAFRGLHTLAFKGRHILNFRGLHALAFRGLHVLTFSGLHIHILREFKVLCP

SEQ ID NO: 120239 - protein, 128 aa, Glycine max
  Coding DNA Sequence Number=SeqID_28554
MYPPLELIHKRCTLSCSQSTTQVDVPSTCTTNDVPSNVLRQSSQAVKPLKLCEWGYKTILRREKGDTKEFRRLVLRSFGKGRRETQKEFRRLVLRSFGKGRRETQKEFRRLVIGEFFLAKGEGNEKDE

SEQ ID NO: 120240 - protein, 236 aa, Glycine max
  Coding DNA Sequence Number=SeqID_28555
  Homolog annotation: Hit_ID=A2Q6B4; Match level="QueryCoverage=67%, HitCoverage=86%, E-value=4e-14, Identity=24%"; Hit description =Ribosomal protein L33; Nucleic acid-binding, OB-fold
  Pfam annotation: Domain name=DUF223; Domain location=20-118; Score= -7.1; E_value=0.014; Accession=PF02721.5; Description=Domain of unknown function DUF223
MARIPDKIKSIHGSKETLKLAVRITDLWFVGTPNKSEQAKMVFVDSESWKANLKENSTYVMHNFKVFKDAGQFRVCKHEYKLFFIGVTVVREADLHELPFKQFRFVEFSNVVVGNFVAGLGEILSCTLWENYCIQFLSYLNEHGDDGPMVIILTHARIKDAQGSYPASVSNSFKASKLLINDPILEIQEFKERLLDLGVEVSPVLIPGDQASSQVSGGSQLSSKDSFLSKAEIKTI

SEQ ID NO: 120241 - protein, 91 aa, Glycine max
  Coding DNA Sequence Number=SeqID_28556
MEKSDKKNFKDKKEKKTYITWKDNDMDSSSDSKNEIINLGLMAKDYKIGVEDAFNDLHKESIKLAKLVSYSKKTISSLEKEILKLNVVRKS

SEQ ID NO: 120242 - protein, 121 aa, Glycine max
  Coding DNA Sequence Number=SeqID_28557
MPISPCKSISWSVSSRRGDRTHKDTQWTRKSQTGPWGFQLWLRASISPTGCPYPPPRQGHVIIGIAPARHPVDPKNSTEYLSPPARASGPLLIELSSRSTAPPDGRRAKHHGSIGMAGSGQ

SEQ ID NO: 120243 - protein, 146 aa, Glycine max
  Coding DNA Sequence Number=SeqID_28558
  Homolog annotation: Hit_ID=Q6WAY6; Match level="QueryCoverage=94%, HitCoverage=24%, E-value=2e-08, Identity=25%"; Hit description =Putative uncharacterized protein
MGSSQTPSLKMRFYQVKVKSLGITSLKKLGQLMGQLQQQAFRKAYGKIWDLAMVEVSTEAFASLAQYYDQPLRCFTFGNFQLSPMVEEFEEILGCPLGGRIPYLFSGFYPSLARISKIVQISAQELDHRKQFENGVVGIPRKYLEA

SEQ ID NO: 120244 - protein, 202 aa, Glycine max
  Coding DNA Sequence Number=SeqID_28559
  Pfam annotation: Domain name=Transposase_23; Domain location=37-107; Score=-8.2; E_value=0.0094; Accession=PF03017.5; Description =TNP1ENSPM transposase
MQSQGLALPLELEVGASAACVSTKESCVDPSGNDPDTGDSDKCRLYIEENPPCLVSLGRLYEESTTVHKIPLLHDQVKVGVEEVRDADASILVPTEEVQLVGQTLNTFLALLTHLLKHLSEQGAVGPAKPTDGLDYDVDDPLYLMTLTIAQLFLKSLQVMWDATVFGVFNENFPLYIKYEDLFEIAYGDQCLSISVIQLWIL

SEQ ID NO: 120245 - protein, 167 aa, Glycine max
  Coding DNA Sequence Number=SeqID_28560
  Homolog annotation: Hit_ID=A3B031; Match level="QueryCoverage=79%, HitCoverage=6%, E-value=6e-13, Identity=34%"; Hit description =Putative uncharacterized protein
  Pfam annotation: Domain name=XH; Domain location=74-165; Score=-34.8; E_value=0.0052; Accession=PF03469.5; Description=XH domain
MILDMSVKDDENQALKKKVQEAKTELEDARQQIIKLLAVGIVLSQLMLSVQKLIECICLTIQELPRFLKGVTKIQIKKFGEVSARSFKKVCMNRYKNNKKASSESVKLCAKWQKEILDSTWHPFKIVEVEGKEIQNIYIGSKTDVESDDVECMNVNIGFGDPMLTYI

SEQ ID NO: 120246 - protein, 164 aa, Glycine max
  Coding DNA Sequence Number=SeqID_28561
  Gene Ontology: Mol. function=potassium ion transmembrane transporter activity; Cellular component=integral to membrane; Biological process=potassium ion transport
  Homolog annotation: Hit_ID=Q2NQ98; Match level="QueryCoverage=98%, HitCoverage=26%, E-value=3e-47, Identity=59%"; Hit description=Low affinity potassium transport system protein kup
MSQSEKQSLPAGMLAAAGIVFGDIGTSPLYTLKECLSILPDGAPSALAVMGFLSLIFWALTLIVTLKYVCFVMRADHDGEGGILTLMSLARRNVGRKAGHIIVLAGLIGGAFFYGDGVITPAISVLSAIEGIQVVSPGLEKYVVPLALTILALLFIIQKHGTEK

SEQ ID NO: 120247 - protein, 203 aa, Glycine max
  Coding DNA Sequence Number=SeqID_28562
MAKFDPDIVLEFYANAWPTEEGVRDMRSWVRGQWIPFDADAIGQLLGYPLVLEEGQECEYGQRRNRFDGFDEEAIAQLLCIPGQDFAWTAAGRWVRIMRTNMTTLTQVWMTLLLNNIQPSDHNSDLPLPKCQLVYAILTQMSIHVAQLIADAIYVFAGMAPTRHPLDPDKSNRALGFPALITGLCPSFGVPVAPSKVIRPPIT

SEQ ID NO: 120248 - protein, 161 aa, Glycine max
  Coding DNA Sequence Number=SeqID_28563
  Homolog annotation: Hit_ID=A7PT07; Match level="QueryCoverage=78%, HitCoverage=7%, E-value=2e-11, Identity=34%"; Hit description =Chromosome chr8 scaffold_29, whole genome shotgun sequence
QQGFEQFNKLYNSKESRIPADLKYFSSFALSWIFSWQYRYGKTENNKQYPPLQRHAFVKWWSQFDTSKAAPDQVKNWFQSNPEFLKPADPETSLFLNQKSQLAAFLASSKSKESLAQNLKEVSNYFNRKWKKNLPRRKLNHPRLMMTKKMIHSSRVKMTVL

SEQ ID NO: 120249 - protein, 203 aa, Glycine max
  Coding DNA Sequence Number=SeqID_28564
  Subcellular localization annotation: CTP_CleavageSite=21; ConfidenceScore=5.44e-01
RIPPSPSDASASPSAVKQTRKASRLRSLSTRPPGVERPVVHVDPATGKADGPHKKKLRTYLGIVARDKVDITYENWTEVPTAQKDLIWEDIQRLLTVGRKGSYYRQWGRDEGSLNQTSRGNGPLQPIRTVSRTLFVTNTTSARKSGPSFARLIETLLGRMCASRHKPSKSRILPPHVLSRGGYDYLEQKLLASSTIHPRSDAT

SEQ ID NO: 120250 - protein, 270 aa, Glycine max
  Coding DNA Sequence Number=SeqID_28565
MARIAKVVKISAPNLDRVKQNINGVVGLPRKHLEEKVKALADQGEWASFIDVLALLVFEVVLFPNVDGLVDVAVIDAFLAYHHSKESPVVAVLTHAYGTFDRRCKKSGARIVYYTPALYVWLVSHLFLHESRSICPLQGHYIDPNARLLQRVQKAWNVVERKDGELRGSGNGIVGGYHKWLKARMQEITCLPKLKISSLEEVETPEESKEVQALKAELERAQVVKEKFKTTTIRVRKECDKLRDVNVATTEVLERETKRARKEEWGQNKF

SEQ ID NO: 120251 - protein, 64 aa, Glycine max
  Coding DNA Sequence Number=SeqID_28566
MKDEMKSMQDDGVWNLVELPKGLGSSSSMDSFASWEMNGCGMEKEEREEMPLQGEDESRRSSPP

SEQ ID NO: 120252 - protein, 261 aa, Glycine max
  Coding DNA Sequence Number=SeqID_28567
  Homolog annotation: Hit_ID=Q2HW90; Match level="QueryCoverage=48%, HitCoverage=30%, E-value=6e-09, Identity=26%"; Hit description =Putative uncharacterized protein
MVEEFEEILGCPLGGRKPYLFSGFYPSLARISKKVQISAQELDRQRQVENGVLGITRKYLEGVLFPNVDGLVDLAAIDVFLAYHNHKESPVVAMLADLYDTFDRRCEESNARIVCCTPALYVGLVSHLFLQEGRPVYPLQGRKNQDSIFMRRMSKCSLDGNKGKDIELRGSSNGSIGGYHKWLRVWTQGLDWLPNLKTMRDDEVKASEESDEVQALKAELERARVVEEKFKAAIVSSSSEEVKGIITGQRHDLEGRAKGLP

SEQ ID NO: 120253 - protein, 207 aa, Glycine max
  Coding DNA Sequence Number=SeqID_28568
  Gene Ontology: Mol. function=helicase activity; Biological process =viral genome replication
  Homolog annotation: Hit_ID=Q2R017; Match level="QueryCoverage=32%, HitCoverage=4%, E-value=3e-17, Identity=58%"; Hit description =Helicase, putative
  Subcellular localization annotation: CTP_CleavageSite=42; ConfidenceScore=5.32e-01
MQNYQHAKRCDSAKARTNRKRVMQQKRHDHAQSSSQPTVNCTSEYNSSVSNFMTPFEDCQSPTNQPVINTEDIVMHKCGMMKEYQKIRIIRIQGSVYVVEMAELNCHYYKIHPHICNNFYFMMIQLIVKIINITCKHNNMMFAFTSAGIKLDKTINNSRGPPTIRIQGQPCHRIGSLLPMLGKKPKFAQLYIFDTENEVQNRINVMR

SEQ ID NO: 120254 - protein, 199 aa, Glycine max
  Coding DNA Sequence Number=SeqID_28569
ITRTRHPVDPEKSNRTLGFPALVKGLCPSYRVPIPPARSCHCAIGVAPIRHQVDPEKSNRALGFPALVTGLCHSYRVPIPPTRSCHHDIGTAPARRPMDQKKSNRVLGFPALVTSLCHSYRVPVPPTRSCHHDIGITPARRLMDLKKSNRVLGFPALITGFYQFYRVPIAPSKFIRPPINRAFIKKYCAPRQAQGEKPQ

SEQ ID NO: 120255 - protein, 149 aa, Glycine max
  Coding DNA Sequence Number=SeqID_28570
  Gene Ontology: Mol. function=hydrolase activity, acting on carbon -nitrogen (but not peptide) bonds
  Homolog annotation: Hit_ID=A1FX75; Match level="QueryCoverage=95%, HitCoverage=35%, E-value=8e-60, Identity=79%"; Hit description=N -isopropylammelide isopropylaminohydrolase
MAAAGRTMAAVLAFREFPMTLQFIHGGVDRQGAPLHFHIRDGRISGLNGEAAPADGAEYVDLQGFTVLPGLVDGHIHLDKSFVGDRWHPHQPVNSLRERLAVEKAAVAGAAPMVDRAEALIRQCSAFGTVAMRCHVDFDASTGLGHLEA

SEQ ID NO: 120256 - protein, 168 aa, Glycine max
  Coding DNA Sequence Number=SeqID_28571
MERSMIDAVSGGALGDMTPAKARNLIEKMASNSQQFSARSDVIVIRGVHEVATNSSGETKKLEGKLDALVNLVTQLSMNKKSAPVARICGLCSSSDQHTDLCPSVQQSEAIEQPEAYAANIYSRPPQPQQQNQPQQNNYDLSNNSPSRPYVPPPIQQQQQQQGPETAK

SEQ ID NO: 120257 - protein, 69 aa, Glycine max
  Coding DNA Sequence Number=SeqID_28572
MNENAIHGAPKKRLRMEKCTKQSLPMAPNSWCGGRMNENAIHGAPKRVEMENCTKQSPCMAPNSKVEDT

SEQ ID NO: 120258 - protein, 144 aa, Glycine max
  Coding DNA Sequence Number=SeqID_28573
  Subcellular localization annotation: CTP_CleavageSite=20; ConfidenceScore=5.04e-01
MGIAPTKTPSGPEEVQQGPRVSSSGYGPLSALQGARSPQQGLCPQDTQWTRRSPTGSTEYLSPPARSSGPPTNRAFIKKYCVSRQAQGETPQQPGDGRQRATDAPPSPLEFTSAHPRKGLSIAYTTWPTNRRPSPKPKDAPSCS

SEQ ID NO: 120259 - protein, 318 aa, Glycine max
  Coding DNA Sequence Number=SeqID_28574
  Gene Ontology: Mol. function=nucleotide binding; Cellular component =intracellular; Biological process=small GTPase mediated signal transduction
  Homolog annotation: Hit_ID=P42641; Match level="QueryCoverage=99%, HitCoverage=81%, E-value=1e-145, Identity=81%"; Hit description =Uncharacterized GTP-binding protein yhbZ
  Pfam annotation: Domain name=GTP1_OBG; Domain location=3-158; Score =379.2; E_value=6.6e-111; Accession=PF01018.13; Description=GTP1OBG family
  Pfam annotation: Domain name=MMR_HSR1; Domain location=160-286; Score= 143.0; E_value=8.6e-40; Accession=PF01926.14; Description=GTPase of unknown function
  Pfam annotation: Domain name=Miro; Domain location=162-286; Score= -7.4; E_value=0.049; Accession=PF08477.4; Description=Miro-like protein
  Pfam module annotation: Pfam domain module=GTP1_OBG::MMR_HSR1::Miro; Domain location=3-158::160-286::162-286
MKFVDEATILVVAGDGGNGCVSFRREKYIPRGGPDGGDGGDGGDVWLEADENLNTLIDYRFEKSFRAERGQNGQSRDCTGKRGKDVTIKVPVGTRVIDQGTGETMGDMTKHGQRLMVAKGGWHGLGNSRFKSSVNRTPRQKTMGTPGDKRDLQLELMLLADVGMLGMPNAGKSTFIRAVSAAKPKVADYPFTTLVPSLGVVRMDNEKSFVVADIPGLIEGAAEGAGLGIRFLKHLERCRVLLHLIDIDPIDGSDPVENARIIVGELEKYSEKLANKPRWLVFNKIDLMDKAEAEGKAKAIAEAMGWEDKYYLISAASQ

SEQ ID NO: 120260 - protein, 46 aa, Glycine max
  Coding DNA Sequence Number=SeqID_28575
MAFGGPAAHPGKLRLSHEAIDSPRRARDWYTLKNLIPTIVGVGKTL

SEQ ID NO: 120261 - protein, 106 aa, Glycine max
  Coding DNA Sequence Number=SeqID_28576
  Homolog annotation: Hit_ID=A8ARU6; Match level="QueryCoverage=39%, HitCoverage=58%, E-value=2e-08, Identity=60%"; Hit description =Putative uncharacterized protein
MAYERGGDFLEDARKILNREAFPPGGSLVRSPVPAFRFTGVIPLLWPRLSHSTPDTQFRGRQFAPSWTVCTNPPFSPTAAPYPVTIVFESNPERHAKAPLAAATGK

SEQ ID NO: 120262 - protein, 103 aa, Glycine max
  Coding DNA Sequence Number=SeqID_28577
MFSDENHETGQIQAKGPSGEGRRPKWRRMKAQTYQGNPCGVYPDLSSFTGSGVYPDLSSFTGSGVYPDLSSFTGSGVIQTFVACIKRSAPTQVHIIWYQSFGS

SEQ ID NO: 120263 - protein, 94 aa, Glycine max
  Coding DNA Sequence Number=SeqID_28578
MKGNQQGSPVESPTVATYPSAGGRRETRGMRVPRKEYARSRHQRLFEENVGKTGKDAIYELLSERFGSCIYARGRVFPFAPTYSSIWDEKIRPT

SEQ ID NO: 120264 - protein, 67 aa, Glycine max
  Coding DNA Sequence Number=SeqID_28579
MGLGKDNGGITSLINAKRNRGKSDDEFPEGTNTWDPPINFEQETNQMEDEGNEDVGLPPRIRKDGRP

SEQ ID NO: 120265 - protein, 95 aa, Glycine max
  Coding DNA Sequence Number=SeqID_28580
MVEDARIALGNQFVGLRTRWWRMHEWQSIHGAPDLIVEDARTALGNQFMGLRDASSIGACRPRIFFINGFLCFLEDKWQRNGEGRERGDATSRRR

SEQ ID NO: 120266 - protein, 113 aa, Glycine max
  Coding DNA Sequence Number=SeqID_28581
MVGYTPSSFANLVFTDEKIEVGLRRGKFDYPALINREPGENGENEKEGGTHVVTVVPTRPNFPTSSIISILSQYQPFSLPTTLSTKNTQSSIKATPKSATKPTYRTSNIKHHP

SEQ ID NO: 120267 - protein, 136 aa, Glycine max
  Coding DNA Sequence Number=SeqID_28582
MVGYTPSSFTDLVFASKKIEVDPKRGKFDHPTRTTEKIGANEEGEKEGETHAVTAIPIRPSFPPTQQCHYSANNKPPPYPPPSYPQRPSLNQPQSLSTALPMTKTTFSTNKKKNTNKKEFCSKKPVGFTPNSIVIC

SEQ ID NO: 120268 - protein, 159 aa, Glycine max
  Coding DNA Sequence Number=SeqID_28583
VYDVTAYQAKLDACCSSTGGCHLIRDGSICVNDRFLCLPIDAVKLRGMSVIRGIAFLFVCIYAISRFFSSRPPFLLSFFVGSQGYRLLVVRGGISGSAADPNYPSGDSVTHCFLSFQSLWVLCFKSLVYLSFNGLPSGEALTTGISGSSSPATGTSLAT

SEQ ID NO: 120269 - protein, 162 aa, Glycine max
  Coding DNA Sequence Number=SeqID_28584
  Homolog annotation: Hit_ID=Q0ZCD6; Match level="QueryCoverage=100%, HitCoverage=20%, E-value=2e-07, Identity=26%"; Hit description =Integrase
  Subcellular localization annotation: CTP_CleavageSite=69; ConfidenceScore=5.17e-01
YNPCWRNHPNLRWASPPLQQQPVPHFQNAAGPSKPYVPPSIQQQQQQRSQKRQQATEAPPQPSLEELVRQMTIQNMQFQQETKASIQSLTNQMGQMATLLNQAQSQNFDKLPSQTVQNLKNVSAITLRSSNQIQVPRPVAAPAPKPVKFHSTPEKEDEIVAQ

SEQ ID NO: 120270 - protein, 98 aa, Glycine max
  Coding DNA Sequence Number=SeqID_28585
MPISPCGSISWSVPSRHRIAPARHPVDPKKSNGVLELPALITGLCQFYGVLVTPSKVIRPPTNRAFIKKYCAPGKCRVKHHNSLGMAGSGQQTHRHHL

SEQ ID NO: 120271 - protein, 16 aa, Glycine max
  Coding DNA Sequence Number=SeqID_28586
MTNDSSKMTSKFAKLD

SEQ ID NO: 120272 - protein, 78 aa, Glycine max
  Coding DNA Sequence Number=SeqID_28587
MPLRALADLGMNSYEPAKSDQGYYSGNEKYQMGETRYFNEIYYLTKMAVSPSACHDHNYQDSTVFCFAAATPFLTCPH

SEQ ID NO: 120273 - protein, 89 aa, Glycine max
  Coding DNA Sequence Number=SeqID_28588
MWHTLFGVDRYVNLERPDLKLVSHGRKVTLIGRPVPEIEGLVGATGLRPLIDCSVVTGDLGLIFTFMERCHSVDQHLLPFGRRVDNHIG

SEQ ID NO: 120274 - protein, 90 aa, Glycine max
  Coding DNA Sequence Number=SeqID_28589
  Subcellular localization annotation: CTP_CleavageSite=25; ConfidenceScore=5.04e-01
MGLNQFRFFNMVHDILVKVKLEVTRTSTVLNVFGSKQSSDRKMQGSRMKTKGMQFVEQKERYVHYDAMKRCLCMLEIKCGSDLIRIDFSE

SEQ ID NO: 120275 - protein, 103 aa, Glycine max
  Coding DNA Sequence Number=SeqID_28590
MKIQRKGVPMNPKRIKVIPEWPTPPTPLIELVRNHVPSWEDAQEMGFQTLPYFNIPNTTNTYVFVLFTGVKEKSPEFQKPQDLRSIPFQGGGNDAILPHKGIG

SEQ ID NO: 120276 - protein, 102 aa, Glycine max
  Coding DNA Sequence Number=SeqID_28591
MNEGVEVPYPVVPSKKEKDRHLARFLDIFRKLEITMPFGEALQQMLSQPTLLRVSEARHTGASSIGGKCVESPLTFIERKTLEKPKETGHEEYSRFGSYLYV

SEQ ID NO: 120277 - protein, 38 aa, Glycine max
  Coding DNA Sequence Number=SeqID_28592
  Homolog annotation: Hit_ID=A5ALW7; Match level="QueryCoverage=100%, HitCoverage=5%, E-value=1e-09, Identity=65%"; Hit description =Putative uncharacterized protein
MRLCVDYFQLNKIDLRSGYHQIRVKSEDIPKTVFRTRY

SEQ ID NO: 120278 - protein, 173 aa, Glycine max
  Coding DNA Sequence Number=SeqID_28593
  Gene Ontology: Mol. function=pantothenate kinase activity; Cellular component=cytoplasm; Biological process=coenzyme A biosynthetic process
  Homolog annotation: Hit_ID=Q2KCZ7; Match level="QueryCoverage=100%, HitCoverage=82%, E-value=2e-77, Identity=84%"; Hit description =Pantothenate kinase protein
MADNLANGLKARGETAAVLPMDGFHMDNAVLIERGLLARKGIPETFDVRGFLDIVRAVRPADQEVLVPVFDRSRELAIASARPISPHDRFIIIEGNYLLFTQGKWADLDGIFDFTIMLAPPIEVLEERLWERWRGYKLSEEEASAKVYGNDLPNGRLILENRRPSDVTLEIAL

SEQ ID NO: 120279 - protein, 96 aa, Glycine max
  Coding DNA Sequence Number=SeqID_28594
SMMIGCGITWMLWKLGRIDGDPSLRGTRIRATWEYVSSVGGGQQGMVGYTVVPGDMSWGSGDLGDVRRAPGSQQIKGTKTTKQGGLCGGWPAVNFD

SEQ ID NO: 120280 - protein, 133 aa, Glycine max
  Coding DNA Sequence Number=SeqID_28595
MGKAKEVQEKVKADMEAMKEKMATMMEAMMSMKKIMEANAVTIAATSTVAKVNPMPPSGLNQMNHPTLDMVGKDLGSRGGPHYAQNEHAFPPYGLPLNYTPPNLAYTPNEDVNNSTPIPIESQQPQTDHAHVS

SEQ ID NO: 120281 - protein, 232 aa, Glycine max
  Coding DNA Sequence Number=SeqID_28596
  Gene Ontology: Mol. function=chloramphenicol O-acetyltransferase activity; Biological process=response to antibiotic
  Homolog annotation: Hit_ID=P62577; Match level="QueryCoverage=93%, HitCoverage=99%, E-value=1e-127, Identity=98%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDECRRGVIFLRQYWCLEIFI

SEQ ID NO: 120282 - protein, 197 aa, Glycine max
  Coding DNA Sequence Number=SeqID_28597
  Homolog annotation: Hit_ID=Q6WAY4; Match level="QueryCoverage=85%, HitCoverage=30%, E-value=2e-21, Identity=36%"; Hit description =Putative uncharacterized protein
MGTNQTGKRFYQVKIKGLDVTSLKELGRLMGPLQMQAFRKAYGKILDLTIAEIFTEAVVSLTQYYDQPLRCFTFGDFQLLPTVEEFEEILGCPLGGRNPYLFSGFLPSLSKIAIVVRDLLRELDRVKQTRKSVVGLPQKYLEGKARDMANQEEWVPFMDVLALLIFGVVLFPNVDGLVDLAAIDAFLAYHNSKESPV

SEQ ID NO: 120283 - protein, 121 aa, Glycine max
  Coding DNA Sequence Number=SeqID_28598
MAVPKSEKMQRQDETNKRQAVPLGVENNDCLWWLMVVVGDGESAWNFRNDFGRKKEEEMTHLLKDPNGQIMDKCLVKLQTKFREDPMVNEGWTAFLPRQLHVVFSRSFIKRLPPEASSWLL

SEQ ID NO: 120284 - protein, 119 aa, Glycine max
  Coding DNA Sequence Number=SeqID_28599
MRGLHVLALRGLHVLTIRGLHALTFRGLHVLALRGLHALTLGLHVLALRGLRVLTIRGLHALTSRGLHVLALRGLHALTLGTSYPQRERTTRPHLQRTTRPRHQRTACPHLRRATCPHL

SEQ ID NO: 120285 - protein, 180 aa, Glycine max
  Coding DNA Sequence Number=SeqID_28600
  Homolog annotation: Hit_ID=Q6WAY4; Match level="QueryCoverage=95%, HitCoverage=30%, E-value=1e-17, Identity=31%"; Hit description =Putative uncharacterized protein
MGQLQRQAFCKAYGKIWDLVMVEVSTEAIASFAQYYDQPLRCFTFGDFQLSPMVEEFEEILGCPLGGRRPYLFLGLYPSLARISKIVQISAQELDCRKQVENGVVGIPRRCLEEKARNLAGKGEWAPFIDIVVMLIFRGVLFPNVEGLVDQAVIDAFLAYHSHKESPVIAILADLYDTFD

SEQ ID NO: 120286 - protein, 273 aa, Glycine max
  Coding DNA Sequence Number=SeqID_28601
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=28%, HitCoverage=9%, E-value=5e-15, Identity=59%"; Hit description =Homeodomain protein
MPGSRQARQGASAGVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQSQAEREDGGYYVGDDDDDEEQDLNMGIATPSSSLPSILSHSKTQQQIHHSNSSMSQDYHHHHQGIFSFPNGFERSAAATTMTHQDPHQQQIRRDKVRVQGFEPPPSHQTLVPIEEDESGSLPVYETAGGYRARIRNHGHSCFLCEIVIRSQFHTTYEPEA

SEQ ID NO: 120287 - protein, 43 aa, Glycine max
  Coding DNA Sequence Number=SeqID_28602
NDQILSLRVIGPAATGRHKGADNRKGADNRKVSPRVIGPAASG

SEQ ID NO: 120288 - protein, 94 aa, Glycine max
  Coding DNA Sequence Number=SeqID_28603
  Gene Ontology: Mol. function=aspartic-type endopeptidase activity; Cellular component=small subunit processome; Biological process=DNA integration
  Homolog annotation: Hit_ID=A5AMP0; Match level="QueryCoverage=62%, HitCoverage=5%, E-value=5e-17, Identity=61%"; Hit description =Putative uncharacterized protein
  Subcellular localization annotation: CTP_CleavageSite=21; ConfidenceScore=5.04e-01
MDPSSSTSSHHSDSDWPIAFRKGTRSTRNPHPIYNFLSYHRLSPLTVPTNIYETLDHPKWRQAMIDEMQALENNDGSILLRSGPMVRLISLRLD

SEQ ID NO: 120289 - protein, 83 aa, Glycine max
  Coding DNA Sequence Number=SeqID_28604
MDFNSDDFMDKLREALRNVDLRDERWRPRRGEPRPNVDEFKITELPEFNGSADPEVYLEWERKIDRMLEGHEMERRKSTLGSP

SEQ ID NO: 120290 - protein, 116 aa, Glycine max
  Coding DNA Sequence Number=SeqID_28605
SGRPKVQKTMLVTARQLTHLPLVNEWCGKPRMSPDFTGQDAQMVYEDDANLRAPRLVCPWLTKGAGNHMVAPHITWLHGSGRQKVQQTMSGRQKEQKTMLVTARQLTHLPLVNEWC

SEQ ID NO: 120291 - protein, 73 aa, Glycine max
  Coding DNA Sequence Number=SeqID_28606
MEQYLRHIVRQQAANHRAHSQGFASFSCPTPDQFRAEVAWPGDWPEAQVGEAPPEVPARRRGGPRARGDGRFA

SEQ ID NO: 120292 - protein, 213 aa, Glycine max
  Coding DNA Sequence Number=SeqID_28607
  Homolog annotation: Hit_ID=Q6WAY6; Match level="QueryCoverage=92%, HitCoverage=35%, E-value=2e-15, Identity=30%"; Hit description =Putative uncharacterized protein
EGRIGVLISCGGFPNVPLLGTRGCISYNRVLATRQLGYLMRGSPLEDELTPVISRGFNKTNMETLQKVRKAWEVVKKKDKELRGNNNGPIGGYHEWLKAHVQGLDWLPSLRTAKREKDEAPEEDEEVQALRTELKQAQTVKERFKSAALKIRKKNAELRDINIATTKALEQETKRARREEHGRNKFRGALWGSNNELKLRREERDQSRVDRMS

SEQ ID NO: 120293 - protein, 122 aa, Glycine max
  Coding DNA Sequence Number=SeqID_28608
  Homolog annotation: Hit_ID=B0HC01; Match level="QueryCoverage=27%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLKLMRKAFRTKED

SEQ ID NO: 120294 - protein, 63 aa, Glycine max
  Coding DNA Sequence Number=SeqID_28609
MCNWMHRTLAQMGLSNQSNSTSFCNKLDEWKDYLAKISYKALVESCMTKKRSHLSHARGVRQL

SEQ ID NO: 120295 - protein, 97 aa, Glycine max
  Coding DNA Sequence Number=SeqID_28610
EKWARLVKCRIYERAKPGHVLGEPSAKRTMLRLSVQKNLEEGCVAQRVFGCGETEKELSLTRKPSYGALDEILRDCEEVSLLWRAKSSVGSSYGVLD

SEQ ID NO: 120296 - protein, 87 aa, Glycine max
  Coding DNA Sequence Number=SeqID_28611
MTKARQKGVRKEKEGDACLPARQGELGCFLQKQPPSGGTSWKAQVDYVIIPFPPSGMLRNFTNCAFTLPFDFRHVTKIHGLCNNAFF

SEQ ID NO: 120297 - protein, 116 aa, Glycine max
  Coding DNA Sequence Number=SeqID_28612
MLSFSQMQSQFQSQMQSLGLALPPELEVGPSAARVSTKESCVDPSRNNPDTGDSEKYGLYIKENLPQLVALGRLYEGSTTVHNIPLRPDQVQVGVEEVRDADAPIPVPTQEVLVVG

SEQ ID NO: 120298 - protein, 342 aa, Glycine max
  Coding DNA Sequence Number=SeqID_28613
LNTFLETPVVLAEGETLPAYSKYCRLPTDFREIEAALCIPDRGFILNSEGQPGKILRKDLTTLAQVWSVLSYSNLAPTSHTYNLTIDRAKLIFGLVSHLDMNIGALISGQMTSIAQSNTSRLGLPALIIALCRSRGVVSNSLTFERLSPDLTVSIRRARRARARPAELPFTSAAPTPASTSAAAFVPAQKNSQRFEAMLQSIHQGQIILLQSLQIMAPPDFIPTIEQFNDMVAWPSTQPFLHKEDKGPTAQVPQHMEDKSSEATILEPFDIGEEAEETQVRQVAATTPERSLAATSEPSALVVNLPSPQPAVDPSTPLLQMPEDPTTPVLAMDTSPPTTLVL

SEQ ID NO: 120299 - protein, 298 aa, Glycine max
  Coding DNA Sequence Number=SeqID_28614
  Gene Ontology: Mol. function=glucose-1-phosphate adenylyltransferase activity; Cellular component=chloroplast; Biological process =glycogen biosynthetic process
  Homolog annotation: Hit_ID=Q1H1K1; Match level="QueryCoverage=88%, HitCoverage=61%, E-value=1e-104, Identity=66%"; Hit description =Glucose-1-phosphate adenylyltransferase
  Pfam annotation: Domain name=NTP_transferase; Domain location=4-161; Score=-51.4; E_value=0.00025; Accession=PF00483.14; Description =Nucleotidyl transferase
MAAIYSGAGRRPYLQNGLWPDAGHPCTQQCRYDDCCIDVPLEDAKGFGVLEVDATDRVVAFDEKPAQPKSIPDDPAKAFASMGIYIFNAKFLYEQLIRDAYAPHSHHDFGQDIIPYIINRYHVQAHRFTESCVGAQSGNYYWRDVGTIDAYWEANMELTKVIPELNLYDSEWPIWTYQEQLPPAKFVFKDEGRTGKATDSLVSGGCLISGSCVSNSVLFSGVHVADYCDLDGAVVLPKVKINEGVVVKNAVIDRGCDIPAGMHIGIDLSRDSKRFHVSEKGIVLVTPDMLGQDLYRVK

SEQ ID NO: 120300 - protein, 127 aa, Glycine max
  Coding DNA Sequence Number=SeqID_28615
MAPTRHPLDPDKSNRALGFPALITGLCQSYGVPVTPSKVIRSLITRAFIEKYCTPRQAQGDAHQATDAPPPPRQADPAGSQAANHRGQVQIHECLYRFSLSQQGQGSTSFACPTPEKFGAEVAWPGD

SEQ ID NO: 120301 - protein, 42 aa, Glycine max
  Coding DNA Sequence Number=SeqID_28616
MGETFDRPLGSLEAHARCPSLPQCKALRFMHGAFHCPSVGLR

SEQ ID NO: 120302 - protein, 235 aa, Glycine max
  Coding DNA Sequence Number=SeqID_28617
  Homolog annotation: Hit_ID=Q84VH5; Match level="QueryCoverage=100%, HitCoverage=43%, E-value=9e-70, Identity=53%"; Hit description =Envelope-like protein
  Subcellular localization annotation: CTP_CleavageSite=39; ConfidenceScore=5.70e-01
FPNSSQRFTKPFQRLCFSMATSPKDTSSPGSPSVPSSPSSTKAPSNQEQPEFHIQPIQMIPGPAPVPEKLVPKRQQGVKISENPSIETSPREVDTEMDKKIRSLDVPTSSTPNAEVLSSSSKEESTEEEDQATEETPAPRAPEPAPGDLIDLEEVESDEEPIAKHTPITPTTSRWSKVAIPSKKRKEISSSDSDDDVELDVPDIKRVKKSGKKVPGNVPDAPLDNISFHSIGNVE

SEQ ID NO: 120303 - protein, 408 aa, Glycine max
  Coding DNA Sequence Number=SeqID_28618
  Gene Ontology: Mol. function=motor activity; Cellular component=cell projection
  Homolog annotation: Hit_ID=P15305; Match level="QueryCoverage=99%, HitCoverage=81%, E-value=5e-20, Identity=20%"; Hit description =Dynein heavy chain
MHDFGGLHVLTFRGLHALTFKGLHILTFKGLHVLTFRELHVPTFRGLHVLNFRGFHALSFRGIHALSFRVLHVLTFRGLHTLAFRAQHILAITGSRILTFRGMHALAFRRLHVLVFRGLLALAFRGLHVLAIRGLHVLTLRGLHVLAIRGSHTHTFRGLHILAIRRTTCPRLQKTTRPRLQRATCRCLYRTTCLAIRGLHDFTFRGPHVLAIRGLHALTFRGLHVLAFRRLHVLTLRGLYVLAFRGLYVLAFRGLHVLDFRGLHVLAFRGLHVLAFRGLHVLAFRRLYVLTFRGLHALSFRGLHALSLRGLHVLGFRGLHVLSFRALHALAFRGLHVLTFKGLHALAFRGLQALAFGRLHVRAFRGLHVLAFRRLYVLIFRGLHALSFRGLHAVSLRGLHVLRFRGLH

SEQ ID NO: 120304 - protein, 26 aa, Glycine max
  Coding DNA Sequence Number=SeqID_28619
MATPMSTACYLDKDKTGRSIDIKQYR

SEQ ID NO: 120305 - protein, 187 aa, Glycine max
  Coding DNA Sequence Number=SeqID_28620
  Gene Ontology: Mol. function=phosphoprotein phosphatase activity; Biological process=intracellular signaling cascade
  Homolog annotation: Hit_ID=A7R8Y3; Match level="QueryCoverage=100%, HitCoverage=57%, E-value=2e-26, Identity=33%"; Hit description =Chromosome undetermined scaffold_3090, whole genome shotgun sequence
MCSATDYKVKSIGGVCILIQMWAWERCTTLTPKRMPPVIENKPLGHRWLRQGNQHIGNDDLRVFLRKLDLIKRHEEPYTTTVMATLPQICVVGSVAWFAVVPLICFHVVEWHQPDRVLQQFGLQKPIPGCPSQPQNLHGITLKGKQDENWFHLLAPIISQWNNRAEFRVDVYPRQEGLLGFNSDNMV

SEQ ID NO: 120306 - protein, 114 aa, Glycine max
  Coding DNA Sequence Number=SeqID_28621
  Subcellular localization annotation: CTP_CleavageSite=45; ConfidenceScore=5.13e-01
MNMNGDKKKKRRRKKNMNKKCRRKSKTKGCRNRKRKKKAVGRERRRMHVSYGRNCSFIYIIRVKDIFAISPYVQGAPAKMLGAPSNTLRWISALKMFGFFVFLVERCLGILVPK

SEQ ID NO: 120307 - protein, 361 aa, Glycine max
  Coding DNA Sequence Number=SeqID_28622
  Gene Ontology: Mol. function=transferase activity, transferring hexosyl groups; Cellular component=integral to membrane; Biological process=carbohydrate biosynthetic process
  Homolog annotation: Hit_ID=A9PDQ7; Match level="QueryCoverage=90%, HitCoverage=90%, E-value=1e-141, Identity=74%"; Hit description =Putative uncharacterized protein
  Pfam annotation: Domain name=Glyco_transf_8; Domain location=66-336; Score=288.6; E_value=1.3e-83; Accession=PF01501.11; Description =Glycosyl transferase family 8
  Subcellular localization annotation: CTP_CleavageSite=30; ConfidenceScore=5.04e-01
MKFNPKSKPPPHLLYFLIILSLSFFFPCVSSSRKQQFKEAPQFYNSPNCPSIEHHDILSSSEEAVHVAMTLDTTYIRGSMAAILSVLQHSSCPQNTFFHFVCSSNANANANTNTNASLLRATISNAFPYLNFQLYPFDDAVVSNLISTSIRAALDCPLNYARSYLPNLLPPRVKRVVYLDSDLVLVDDIAKLATTSLGQNSVLAAPEYCNANFTSYFTPTFWSNPSMSLTFAERKRKACYFNTGVMVIDLERWREGDYTRKIEEWMELQKRMRIYELGSLPPFLLVFAGNIVSVDHRWNQHGLGGDNFRGLCRDLHPGPVSLLHWSGKGKPWMRLDANRPCPLDALWAPYDLLKTSFSLDS

SEQ ID NO: 120308 - protein, 285 aa, Glycine max
  Coding DNA Sequence Number=SeqID_28623
  Gene Ontology: Mol. function=metal ion binding
  Homolog annotation: Hit_ID=A7NTJ6; Match level="QueryCoverage=64%, HitCoverage=38%, E-value=2e-63, Identity=63%"; Hit description =Chromosome chr18 scaffold_1, whole genome shotgun sequence
  Pfam annotation: Domain name=LIM; Domain location=118-174; Score =22.4; E_value=1.4e-05; Accession=PF00412.13; Description=LIM domain
  Pfam annotation: Domain name=UIM; Domain location=44-61; Score=13.8; E_value=0.57; Accession=PF02809.11; Description=Ubiquitin interaction motif
  Pfam annotation: Domain name=UIM; Domain location=76-93; Score=11.0; E_value=1.3; Accession=PF02809.11; Description=Ubiquitin interaction motif
  Pfam annotation: Domain name=zf-C3HC4; Domain location=145-181; Score= -0.2; E_value=0.096; Accession=PF00097.16; Description=Zinc finger, C3HC4 type (RING finger)
  Pfam module annotation: Pfam domain module=LIM::UIM::UIM::zf-C3HC4; Domain location=118-174::44-61::76-93::145-181
MGWLSRIFKGSDHNKLSEGHYYKEDAGYYLPSTSGDAWNQSQNQNENEDIDRAIALSLVEETQKANNNVNDYRSQLEEDEQLARAIEQSLNLESPPRYGNENMYQPPIQYFPMGSRICAGCYTEIGYGRYLNCLNAFWHPECFRCRACNLPISDYEFSTSGNYPYHKSCYKESYHPKCDVCKHFHIKTKERQTIRPNHSQICVSQHSHHLVNFIQTITKTTTFPASATVKHTLYHDHPSAISAKYRLHTLQQSPHCSSPPQSRLQSQFSTKQHLSFHSEHHLLNG

SEQ ID NO: 120309 - protein, 464 aa, Glycine max
  Coding DNA Sequence Number=SeqID_28624
  Gene Ontology: Mol. function=transferase activity; Biological process= biosynthetic process
  Homolog annotation: Hit_ID=A7NTK4; Match level="QueryCoverage=89%, HitCoverage=63%, E-value=1e-138, Identity=60%"; Hit description =Chromosome chr18 scaffold_1, whole genome shotgun sequence
  Pfam annotation: Domain name=DUF616; Domain location=154-455; Score =570.3; E_value=1.9e-168; Accession=PF04765.4; Description=Protein of unknown function (DUF616)
MFHNNNNNSVSISVSDDEPDELGRMRIRARRKRKKLGNRRLVRKLLLKYWMLLIIVPALALLVFEATRIARSPSSNTETRNNKADRSRKEPPANLNRLDPTTHVVAGVRERCLKLLPPEKLEQLDIPVEEESSSVPVGEVLYMSESDRSFVGGSVTLSQLRTEDTRFNLFTGNQTFDQRDQSFEVKETLAVHCGFYSVNGGFKISDEDKSYMQGCKVVVSTCAFGGGDDLYQPIGMSEASLKKVCYVAFWDEITLKAQELVERRIGENGFIGKWRVVVVQDLPFADQRLNGKIPKMLSHRLFPQAKYSIWVDSKSQFRRDPLGVLEALLWRTNSLLAISEHGARSSVYDEAKAVVKKNKAKPEEVEVQLNQYRKDGLPEDKRFSGKKALCEASVIVRKHTPVTNLLMCVWFNEVVRFTSRDQLSFPYVLWRLKAFKNINMFPVCTRKDLVNSMGHVRKAKPLQS

SEQ ID NO: 120310 - protein, 240 aa, Glycine max
  Coding DNA Sequence Number=SeqID_28625
  Homolog annotation: Hit_ID=A7NTK6; Match level="QueryCoverage=67%, HitCoverage=16%, E-value=2e-69, Identity=83%"; Hit description =Chromosome chr18 scaffold_1, whole genome shotgun sequence
MEKKNVVRRRDPIKDGRSGFSVGISHQQGWWILRPDVIGDIISDVGVLEKHWPLTLFFLNNFSYVQIETRNNNLEMQSVNNKSLIEELDKLLERLRVPSEYATNLTGGSFDEARMLQNVEACEWLTSALRGLGVPNLDPSYANMRTVKEKRAELEKLKSTFVRRASEFLRNYFASLVDLMISDKSYFSQEFIGITFSSSSEQRGQLKRPDHADLRYKCRTYARLLQHLKVKIWDSGPVYF

SEQ ID NO: 120311 - protein, 100 aa, Glycine max
  Coding DNA Sequence Number=SeqID_28626
  Homolog annotation: Hit_ID=Q2HTC4; Match level="QueryCoverage=97%, HitCoverage=18%, E-value=4e-28, Identity=57%"; Hit description =Conserved oligomeric Golgi complex component 4, related
MVNDVFYVLLSCLRRAISTSNISSAVTVLSGASCLLGNEYHEALQHKLIREANLGAKVLPAQADREKVKSCLTELADSNNAFKQALNTGTEQLVATINLE

SEQ ID NO: 120312 - protein, 24 aa, Glycine max
  Coding DNA Sequence Number=SeqID_28627
MNNIGTKHDPPVQYQHSQMGPIFA

SEQ ID NO: 120313 - protein, 169 aa, Glycine max
  Coding DNA Sequence Number=SeqID_28628
MSQEQSVPFAGKWHHFTVRTDGEKVVPEPHGDAEQTEAWESEVMIPFAVERTVYAFGGPLPDQESLSSAMNKVFPCYPTCEPRIFDSEPYNFNCLSKPHKLFRSAPSIAHRDYLPWLDRVEQAYEDFWKTYGIFDLIQFSRSGPEYRPEMLIAAMHFFESSTNTFQFKC

SEQ ID NO: 120314 - protein, 548 aa, Glycine max
  Coding DNA Sequence Number=SeqID_28629
  Gene Ontology: Mol. function=transporter activity; Cellular component= integral to membrane; Biological process=transport
  Homolog annotation: Hit_ID=A7NTP4; Match level="QueryCoverage=95%, HitCoverage=95%, E-value=0.0, Identity=69%"; Hit description =Chromosome chr18 scaffold_1, whole genome shotgun sequence
  Pfam annotation: Domain name=Xan_ur_permease; Domain location=53-436; Score=173.2; E_value=6.7e-49; Accession=PF00860.11; Description =Permease family
MGEEHHNHPPPPVQAPPAGPPPPNLALSRGPVWHPAEQLSQLHYCIHSNPSWPVAILLGFQHYIVMLGTTVLIATTLVPAMGGDHGDKARVIQSLLFMSGLNTLLQTWFGSRLPTVMGGSFAFLLPVLSIINDYTDRTFPSEHERFIYTIRTIQGSLIVSSFVNIFLGFSKTWGNLTRLFSPIIIVPLVANCVQIGLPMLILLVIIQQYLKRLHHAALQVLERFALLLCIAVIWAFAAILTVAGAYNTAKSQTQVSCRTDRSYLMSSAPWIKVPYPFQWGTPIFRASHVFGMMGAALVSSAESTGAFFAAARLSGATPPPAHVLSRSIGMQGIGMLLEGIFGSIVGTTVSVENVGLLGLTHIGSRRVVQISCGKFGAFFASIPLPIFAAIYCVLFGIVAATGISFIQFANTNSIRNIYVLGLTLFLAISIPQYFVMNTAPDGHGPVRTGGGWKFRQYLRCNLPVPNVKNEYGSTWMFNDILNTIFSSAPTVAIIVGTLVDNTLEGKQTAVDRGLPWWGPFQNRKGDVRNDEFYRLPLRINEYMPTRFL

SEQ ID NO: 120315 - protein, 59 aa, Glycine max
  Coding DNA Sequence Number=SeqID_28630
MGGGVGGKIWRLERSLEGCARHDLSYTSISIQPSSHVIPVCTKDCPKGICSMQKTNYTW

SEQ ID NO: 120316 - protein, 195 aa, Glycine max
  Coding DNA Sequence Number=SeqID_28631
  Gene Ontology: Mol. function=single-stranded DNA binding
  Homolog annotation: Hit_ID=A7NTP7; Match level="QueryCoverage=68%, HitCoverage=78%, E-value=7e-23, Identity=33%"; Hit description =Chromosome chr18 scaffold_1, whole genome shotgun sequence
MERVVGGEERFPIPLLFSFPFSPQQQRFLFSTHNRHSFDEAVPGCSAVYQHVLKFQRPPTIRWSPHLENTASFIGTVAREPTRVNSTTGKFGVYTVLKLEVKEFEFVAQSSGYLGDKKLESVEVFFSNPNEWWDQRKSKRNPKQPDFKHKDTGEALWLSEYDPPWVKRQLQLFDSKIAGGSAGRRSRVTNWVYDE

SEQ ID NO: 120317 - protein, 102 aa, Glycine max
  Coding DNA Sequence Number=SeqID_28632
MKVHELGNITSFMNLLYRSTQMEFVDHLSGNGRVAISSSSNGFVKCAHLPPTKVAEQMHSSNNEKTMRRRRNQFLAPRKLVPKLVESVKQNPQLLNQMTTFD

SEQ ID NO: 120318 - protein, 46 aa, Glycine max
  Coding DNA Sequence Number=SeqID_28633
MEPRMKVKIWMKIYLSRRVSLWMRRTMSWSWGDEEDSSQDSSDESY

SEQ ID NO: 120319 - protein, 454 aa, Glycine max
  Coding DNA Sequence Number=SeqID_28634
  Gene Ontology: Mol. function=serine carboxypeptidase activity; Cellular component=extracellular region; Biological process =proteolysis
  Homolog annotation: Hit_ID=A7NTQ8; Match level="QueryCoverage=95%, HitCoverage=93%, E-value=1e-174, Identity=60%"; Hit description =Chromosome chr18 scaffold_1, whole genome shotgun sequence
  Pfam annotation: Domain name=Peptidase_S10; Domain location=44-446; Score=597.8; E_value=1e-176; Accession=PF00450.13; Description =Serine carboxypeptidase
AQKRSYGEASSMATNLGGDEHFSKVYVVKEQSGLMEGDKVKALPGQPSQGVDFDQYAGYVTVDAKAGRALFYYFVESPHNASNRPLVLWLNGGPGCSSFGYGAMQELGPFRVNSDGKTLYRNQYAWNNGTDELLQQLAVANVIFLESPAGVGFSYSNTSSDYTKTGDKSTAMDSYTFLLNWLERFPQYKTRDLFITGESYAGHYVPQLADTILTYNKLTNHTVINLKGIAVGNGWIDDNMCGKGMYEYFWTHALNSDETHEGIQRYCDFESGNLTGECSKYQSRGDTEIGSIDIYDIYAPPCDSAAKKPGSSPATNYDSNFDPCSDDYTNSYLNLAEVQEALHAKASVWYPCRGVGWTDSPATILPTINSGDTDGRVPITSSRYSVNALKLPVETTWRPWYSSNEVGGYLVGYKGLTLITVRGAGHMVPSYQPQRALTMISFFLLGELPPEFTS

SEQ ID NO: 120320 - protein, 1243 aa, Glycine max
  Coding DNA Sequence Number=SeqID_28635
  Gene Ontology: Mol. function=binding; Cellular component=integral to membrane; Biological process=defense response
  Homolog annotation: Hit_ID=A7NTR5; Match level="QueryCoverage=98%, HitCoverage=98%, E-value=0.0, Identity=60%"; Hit description =Chromosome chr18 scaffold_1, whole genome shotgun sequence
MYRFCFRTRPLLRFHLHRNISSSRKPIINPTNTTLENSQIAPQPNTDHRHTLSPVHSKSLSRIFVVALSAVSISAVVASAALLSDSDRGGGTNPLYEGAERAARKAADSCDRIFQHAKRTGVAAAVLWKSLRSVLSSANHEVRSGFEIRVAALLADISAANSGRRAAIVGAGSGAVVDWLLDSVAVAKDGGATQAESARALAYLIADPNVSAAVLGRPHAVPSLLRFIFSCQPRRSKNNKEIKREMEMEVENGMEDKFIVEIQASLKMLRIVSFLILTLVHSRHSAFDISDSLKGRSMLVAAIMDIVTSSCDNAEEVSFKPSLPGNAEIRDIAAALEVIEDGGLHLDEPPEGEDDGGGSGRKGIGIKILEGTPVLGLSRTNSDACHEELKHQTPKTLIYPNKYDNSPEQKNVSSAVVPGLWDDLHCEHVAVPFATWALANWATASQLNRSRIQELDRDGNAIMSALMAPERSVKWHASLVVWLLLEDRNTPLNESVSDWASSLLSTISQACKHEDVSLAQVASSAFLLSVERSPGVQKVVMEKGVNPMRDIAKQMTKHKQVQEPMAKALELVCTGELRLSLEESQKWSGILLPWVFGKFSSDTIRSSAIKILSQILEDYGPTCVPLSQGWLAMMLSEVQSSIKKSNDKGTNQPKSDNVKTLINNANIASAAQVANQLSSAVVNLAAKQLGNASNSGDASPLADFLSLEPLAGPFRSLKKDNLPKLDAADSALATLKGIKALTEVCAEDSVCQDMIVDFGILCLLRRFLLSDDYEKLAAIEAYDASSRAHEGKERISNVDGEPAISDVNDPASVRVPPTAHIRKHAARLLTILSLLPRVKKVITVDETWCKWLDDCANGRIPGCSDLKMQSYARAALLNMFCNDQPNGKSESGRGGPSDGGVKNYRNSCPRYDDMIFLINSHLPHWKCPKETDQQEAFSKEISLFTSTEMGDVIESVNGSNCSISNDSTKNNPDADCPPLDIVFVHGLRGGPYKTWRIAEEKSSTSSPLVEKIDEEAGKLGTFWPGEWLSSDFPEARMFTLKYKTNLTQWSGASLPLQEVSSMLLEKLVAAGIGNRPVVFVTHSMGGLVVKQILHKAKEERFDNLMKNTIGIVFYSCPHFGSKLADMPWRMGFVLRPAPTIGELRSGSSRLIELNDYIRHLHKKGLLDVLSFCETKVTPIVEGYGGWAFRTEIVPIESAYPGFGELVIKELVQKFFFHPSCSPTKGGGLSFKHPTSQLKRKPSY

SEQ ID NO: 120321 - protein, 237 aa, Glycine max
  Coding DNA Sequence Number=SeqID_28636
  Gene Ontology: Mol. function=hydrolase activity; Cellular component =vacuole; Biological process=lipid catabolic process
  Homolog annotation: Hit_ID=Q9AQT8; Match level="QueryCoverage=98%, HitCoverage=57%, E-value=3e-89, Identity=71%"; Hit description =Patatin-like protein
LKKRPDLNASLSDICISTSAAPTYLPAHSFETKTHHGVSKFDLIDGGVAANNPALVAMAEVTNQICHEGPCDSLNVEPMQYDKFLVISLGTGSQKQEMKYSALEAAQWGILSWVTTANGGTPLIDAFSQASADMVDFHISSLVRALNSEHNYLRIQDDTLIGDMSSVDMATEKNLNDLVKVGESLLKKPVSKVNLKTGVYEPVKSYETNEEALKGFAERLSKQKQFRKSQMSANANP

SEQ ID NO: 120322 - protein, 109 aa, Glycine max
  Coding DNA Sequence Number=SeqID_28637
MIACFAYGFPETLKYDVAKVDVSAKKSLKGGGRVHVGDVVCGGIMMVERDCVCGALKVEVTRVHELCAIVMVGTVHGGDGIRWWRNAEVGIEGVGEKMGEEEGGSGRGK

SEQ ID NO: 120323 - protein, 170 aa, Glycine max
  Coding DNA Sequence Number=SeqID_28638
  Gene Ontology: Mol. function=oxidoreductase activity; Biological process=electron transport
  Homolog annotation: Hit_ID=Q9FRK4; Match level="QueryCoverage=37%, HitCoverage=12%, E-value=4e-11, Identity=51%"; Hit description =Cytochrome P450, putative; 64213-66051
MCGDVEMCGEKKRKGGTHSGWGQRKWRGTWWLRAKEEEGCSGWGQRRGRTVVVGGGGNMKGEEERRKQEGEEKRKEKCEEGGGNMRVPWVIARPMALCHDTLERVCLFYHKWSRTYGKTVLYWHGSKPKLVLSDPDMIKEILLKTGEWFERIDPNPSATVLWRRRGMDCA

SEQ ID NO: 120324 - protein, 342 aa, Glycine max
  Coding DNA Sequence Number=SeqID_28639
  Gene Ontology: Mol. function=transferase activity, transferring hexosyl groups; Cellular component=soluble fraction; Biological process=carbohydrate biosynthetic process
  Homolog annotation: Hit_ID=Q8GWW4; Match level="QueryCoverage=92%, HitCoverage=52%, E-value=1e-134, Identity=71%"; Hit description =Putative uncharacterized protein At4g33330/F17M5_90
  Pfam annotation: Domain name=Glyco_transf_8; Domain location=50-261; Score=190.2; E_value=5.1e-54; Accession=PF01501.11; Description =Glycosyl transferase family 8
MTKSQLIKTIATYGTIKISEESKWIDKVYDTSNLEQSVQSEARAKREAYVTVLHSSEGYVCGAITLAQTLLQTGTKRDLVLLLDSSISVAKRRALELSGWKIRLITRIRNPRAENGTYNEYNYSKFRLWQLTDYERVIFIDADIIVLRNLDILFHFPQMSATGNDQSIFNSGIMVLEPSNCTFEILMSRRHDVVSYNGGDQGFLNEIFVWWHRLPRRVNYLKNFWANTTIEAGRKNAMFAAEPPKLYAIHYLGLKPWHCYKDYDCNWDVQDQRVYASDVAHRRWWKVHDAMDENLQKLCRLTRQRRMELNWERRKAGKLGLPDMHWKINVTDPRRAGSMLIG

SEQ ID NO: 120325 - protein, 233 aa, Glycine max
  Coding DNA Sequence Number=SeqID_28640
  Pfam annotation: Domain name=zf-BED; Domain location=55-98; Score =10.6; E_value=0.025; Accession=PF02892.6; Description=BED zinc finger
MGTPIVPSVNSIVPLETQQVVNDAHSNPVEEVENYPNIEEAEDIERSPNKRGLTSAAWTHFKRKKIEKKWKDICKYCEKKLGGDTRSGSLKSNMEFCSIVDDADTRTRTDPHGKGKTGQKIPPPQHGDDGEHERLGDGKRGSTLRPHPARLSVSITDCSQFSMINVLHEKKRKEKKEDDGKKVVLKSGKGDDGKKVADVTGNEMKCVQRHSFNSEQEAQELEGPISLLDYLLP

SEQ ID NO: 120326 - protein, 1018 aa, Glycine max
  Coding DNA Sequence Number=SeqID_28641
  Gene Ontology: Mol. function=microtubule motor activity; Cellular component=microtubule associated complex; Biological process =microtubule-based movement
  Homolog annotation: Hit_ID=A7NTV4; Match level="QueryCoverage=67%, HitCoverage=82%, E-value=0.0, Identity=54%"; Hit description =Chromosome chr18 scaffold_1, whole genome shotgun sequence
  Pfam annotation: Domain name=DUF827; Domain location=357-893; Score =754.0; E_value=9.6e-224; Accession=PF05701.2; Description=Plant protein of unknown function (DUF827)
MEDVDDKLPLPEPSSVSAELKPQAETTEENPEVINPPSSQSFVEAPINQINNNNNRMDSGTHLPVTEFSDLGVSLNAFDGTEQNHQGATVADSERGPSEEDIFNRQQDGVSTATASGDVDNPMNLSTSSSERKDLQTSPIELITEPPQIKLTDVPVDNSASTPNITVHVTEQSDQGAMSAESEAGALEDISDRQQHGSDVDNQMELLTSSSEEKELQNDHKELKIDPSQTKDTDVAVGAVGSPAVVAGNGADNQINHLDSPSEKIELQNDHKEQKIKLPQPKIADVSRGAVDSPAGSDDNQTKLSASSSEKIELQNDQTELKRDTSLTNICDIAVGAVDSPTYAKQIAARRGLIDTAAPFESVKQAVSKFGGIVDWKAHRVQTVERRKHVEHELDLVQQEIPECRKKSVVAEQAKTQVLQELDSTKRLIEELKLNLERAQTEERQARQDSELAKLRVEEMEQGIADDSSIAARAQLEVAKARYTSAITELTSVKEELEGLRGEYAALDVEKDEAIKRAEGAVASSKQVEKTVEDLTIELIATKEALEIAHTAHMEAEEHRIGTVMARDQDYLNWEEELKQAEEEIQSLNQKILSAKDLKSKLNMASALLLDLKAELNAYMESIPNHEGDKDGVSKGELEKPEKKTPNEIQEAVASAKKELEEVKLNIEKATTEVNYLKVAAASLKSELENEKSSFASIRQREGMASITVASLEAELDSTRSEMVLVQMKEKEGREKIAELPKKLQQAVEEANQANLLAQAAREELRRIKEEAEQAKAGASTMQSKLLAAQKEIEAARASERLAIAATKALQESESSSRNNNELDSSSWVTLSVEEYYNLSKQAHDAEQQANMRVAAANSEIEIAKESELKTLEKLNDVNREMAARRESLKIAMDKAEKAREGKLGVEQELRKWRAEHEQQRRNAGESGQRGVVKQSSKNPEVSFERHKEANSIDQTRSGPIPARYFSTPKSFSHSNSVASADAKTGKKKKKSFFPWSSEHLILSEASDILNLGFGKDM

SEQ ID NO: 120327 - protein, 23 aa, Glycine max
  Coding DNA Sequence Number=SeqID_28642
MTVDKEVGEGGGGMVMVMVVVVQ

SEQ ID NO: 120328 - protein, 1227 aa, Glycine max
  Coding DNA Sequence Number=SeqID_28643
  Gene Ontology: Mol. function=extracellular-glutamate-gated ion channel activity; Cellular component=integral to membrane; Biological process=ion transport
  Homolog annotation: Hit_ID=A0EXR2; Match level="QueryCoverage=37%, HitCoverage=91%, E-value=1e-162, Identity=64%"; Hit description=Cold- induced protein
  Pfam annotation: Domain name=ANF_receptor; Domain location=507-846; Score=98.5; E_value=2.1e-26; Accession=PF01094.19; Description =Receptor family ligand binding region
  Pfam annotation: Domain name=Lig_chan; Domain location=1031-1227; Score=-40.5; E_value=3.2e-08; Accession=PF00060.17; Description =Ligand-gated ion channel
  Pfam module annotation: Pfam domain module=ANF_receptor::Lig_chan; Domain location=507-846::1031-1227
MEDGDTTEEAVVVPVSIGDEQPFPHSLSRHRDSEEESPHETLRDTKASIENIVAEILSLKNQGKPKPLLTLRLRELLTQTFLHFVTLRQANRSILMEEERARTETERAKAPLELATHQLQNLTYEKSQFVKAIKACNDSKSKYPDIEVVSEEEFFRDAPQDMKDSVLSNHSEHNVVLKRLNFELFQRKELCKLGDKLEQKRKTLLETIASRKKFLSSLPSLLKSLKKASLPVQNQLGVQHTKKLKQHHSAELLPPPLYVIYSQLLAQKEAFGESIDVEIIGSVKDAQAFAHHQAHKETGIFITVESPKLENDEPNEEDGQRQSKRPRRFQGKESLDQEGIFQIHPLTVNLHVYDDEISDLESAKLTTLKFEYLMQLNIICVGNKASNDGPENDILSNLFPDDTGLELPHQSAKLFVGDAIMFNGDRTSRPYKWAQHLAGIDFLPEVAPLLLASRETSDSDEAAKEAIANANNDYEIEGSNIECPILNSKIVVNIGAIIDLSSRVGKEQKTAMEVAMEDVNRQSCYKLALNFNNNTHGNPSPTILAADFANNKEVQVVIGTKLDASTLFHSIDESSKDVPIISLTSTASPEITPIPLPHFIQMGNDVTFHMHCIASIIHQFNWRKVTAIYEHNNFFASHSEILTRLSYSLRLVNAEIDHYVAFPSITTTLSNPIESYIEQELVRLKNKSNRVFLIIQSSLEFATLLLEKAKQMGIMEEGSVWIIADDVATHLDSLDSSVMFNMQGVVGCKTNFMEMSETFKRFKFMFRRKFGLEYPEEENSQLPSIFALRAYDAVWTITHALKKSQGNFSLSENILHSNHEGLSGKISFKDKMLLEPPTFKIVNVIGKGYKELANWSPGSGFSENLVENMVVNTRRTSRAGSARVLLGSVDWPGGLKTVPKGWVYNSTEGRPLKIGVPAIDPCPQFVNVSHDKRLNETQFTGFSINVFESVVKRLPYHLPFVFVPFYGSYDQIVEQVNNKALDAAVGDIQVVEHRYAFAEFSHPYVESGIAMVVKVKPDRSKETWMFMDAFTKEMWMLMAVMHLFIAFVIWFIEGENNSELKSLGAILWFSVTTLFFVHREPVKSNLARAVLAPWLFAILIVTSSFTASLSSMMTVSHLEPSVPDIQTLLRTNAIIGCNKNTFLVHYLVDELKFQPENIRVFDSIHDFPRAFENKEIVASFTIAPHADVFLATYCKGYIKAGPTLKLGGLGFVSFSSISFPYNCHPTC

SEQ ID NO: 120329 - protein, 179 aa, Glycine max
  Coding DNA Sequence Number=SeqID_28644
  Homolog annotation: Hit_ID=A7NTG9; Match level="QueryCoverage=39%, HitCoverage=28%, E-value=9e-29, Identity=84%"; Hit description =Chromosome chr18 scaffold_1, whole genome shotgun sequence
  Subcellular localization annotation: CTP_CleavageSite=32; ConfidenceScore=5.03e-01
MKLKSKKGWKSIVPLHLKGKSASRFSLFRKVNSAGYGPGKTPVYLNVYDLTPMNGYVYWAGLGIYHSGVEALFGSLICKPYSEGSSEIWHQSRCHPPSPAAVRRNRRRHFPAAISPAKPGLGSPWEARASRPTRVSNGAATRRHAPPPSYASSGACSPRAAVPAPESRRASAVLLVGFS

SEQ ID NO: 120330 - protein, 35 aa, Glycine max
  Coding DNA Sequence Number=SeqID_28645
MNEPKFALLFCVLTVQPSYSKARLRRADCNAKVHP

SEQ ID NO: 120331 - protein, 174 aa, Glycine max
  Coding DNA Sequence Number=SeqID_28646
  Subcellular localization annotation: CTP_CleavageSite=33; ConfidenceScore=5.30e-01
MAPSLYRPKPSKAMPVNIASLSIHQRNSTSGVQKSHVVENLNPVDLAVVNLVLDRFDKVVVSNRVFTRFRERTGYKEDAGFVGSDEVVVEIGNGFGLLFRFGFFEDAASAGSREVVADLVEVLLRRANLPTPMVPRRTTNVRKRQRNVTVLWRHARCICRTRRGPRHRSSIAVH

SEQ ID NO: 120332 - protein, 36 aa, Glycine max
  Coding DNA Sequence Number=SeqID_28647
MKGGKEGKCAVGSGAEGKPWMKNNNTEKWKWKRKKK

SEQ ID NO: 120333 - protein, 383 aa, Glycine max
  Coding DNA Sequence Number=SeqID_28648
  Gene Ontology: Mol. function=transcription regulator activity; Cellular component=cytoplasm; Biological process=regulation of transcription, DNA-dependent
  Homolog annotation: Hit_ID=Q9LN63; Match level="QueryCoverage=80%, HitCoverage=99%, E-value=9e-73, Identity=48%"; Hit description =Protein BRASSINAZOLE-RESISTANT 2
  Pfam annotation: Domain name=DUF822; Domain location=10-165; Score =275.9; E_value=8.4e-80; Accession=PF05687.4; Description=Plant protein of unknown function (DUF822)
MVDDGATSAATSRRKPSWRERENNRRRERRRRAIAAKIYSGLRAQGNFNLPKHCDNNEVLKALCAEAGWCVEEDGTTYRKGCKPPLANGAGSSMRNITFSSSQNPSPLSSSFPSPIPSYQVSPSSSSFPSPFRLDVDKDNVSHLIPYIRNASLSLPPLRISNSAPVTPPLSSPTSRNPKPIPTWESIAKESMASFSYPFFAASAPASPTHRHLYTPPTIPECDESDTSTGESGQWVKFQAFAPSSSVLPISPTFNLVKPVVPPGMPDNSIQEMRTSSDEFGVQVKPWVGEKIHEVALDDLELTLGSGKFLAESRGWSVYLLAKYWHDHSLLQQSTFDEGTPENVQVISDDIIDRALEHMMYPFWLVLYAEQKLLNVHDEEEKM

SEQ ID NO: 120334 - protein, 261 aa, Glycine max
  Coding DNA Sequence Number=SeqID_28649
  Homolog annotation: Hit_ID=A7UQU7; Match level="QueryCoverage=43%, HitCoverage=24%, E-value=3e-13, Identity=35%"; Hit description=IMP dehydrogenase/GMP reductase, putative
  Pfam annotation: Domain name=DUF1723; Domain location=105-154; Score =31.3; E_value=3.5e-06; Accession=PF08330.1; Description=Protein of unknown function (DUF1723)
MDRKIRGVEVAGGDPSYKDSIPSHERDDAGERHRRLTVLACGWRHSLTKLEACPFDRIIGPPFGRGPVDLSLIRSYTDHCVGHPTVRAIMLRLGLSDIVTVQYPVANKVFVDALVEKKHQETSSFHLPVREMTITLDDVSCLMHLPMISRPFDHVPSIFSKEVMKFLLMTRLGILIEKKAIEVSIAGPKPRIDALDELVASRWKPTQRHKGVRPFPQQTLFFDFIRCETNEGFNVGCNLERQRKRVVKDGGKGGRKGGKGR

SEQ ID NO: 120335 - protein, 1031 aa, Glycine max
  Coding DNA Sequence Number=SeqID_28650
  Gene Ontology: Mol. function=microtubule motor activity; Cellular component=microtubule associated complex; Biological process =microtubule-based movement
  Homolog annotation: Hit_ID=A5B6X6; Match level="QueryCoverage=99%, HitCoverage=96%, E-value=0.0, Identity=72%"; Hit description =Putative uncharacterized protein
  Pfam annotation: Domain name=Kinesin; Domain location=15-405; Score =455.6; E_value=6.4e-134; Accession=PF00225.14; Description=Kinesin motor domain
MVEAGEDCCVKVAVHVRPLIGEEKVQGCKDCVSVVPGKPQAINADTSLSGDLKLGFPRCGRLALSARLNSRLNLRLRHCILVSKLDPVPFELQAHCTGSPSSAMFDECVASLVDGLFQGYNATVLAYGQTGSGKTYTMGTGFKDGCQEGIIPQVMSSLFNKIETLKHQNEFQLHVSFIEILKEEVRDLLDPSSMNKPETANGHAGKVTIPGKPPIQIRESSNGVITLAGSTEVSVTTLKEMAACLEQGSLSRATGSTNMNNQSSRSHAIFTITLEQMRKLNSHGEISLNDTMNEEYLCAKLHLVDLAGSERAKRTGSDGLRFKEGVHINKGLLALGNVISALGDEKKRKEGVHVPYRDSKLTRLLQDSLGGNSRTVMIACISPADINAEETLNTLKYANRARNIQNKPVVNRDPMSNEMLKMRQQLEYLQAELCARSGGSPEEVQVLKERIAWLEAANEDLRCELHEYRSRCSTVEQCEKDAYENSTCNVKTDGHKRGLPITASDYPMSETTGDSREIEEVEKEWEHTLLQNSMDRELHELNKRLEQKESEMKLFGIPDAEALKQHFGRKIMELEDEKRTVQRERDRLLAEVENLAANSDGQMQKSEDIHAQKLKTLEAQKKQESQVQLLKQKQKSDEAAKRLQDEIQSIKAQKVQLQHRIKQEAEQFRQWKASREKELLQVLQRKTEEAAMATKRLKELLEARKSSSRDISGSMNGSGTNGQSNEKSLQRWLDHELEVMVKEHEVRFEYEKQSQVRAALAEELAILKQVNGVAAKGLPPPRGKNGFARASSMSPNARMARIASLESMLNISSNSLVAMASQLSEAEERERAFTNRGRWNQLRSMGEAKNLLQYLFNSVGDARCQLWEKDTEIKEIKDQIKELVGLLRQSEMKRKETEKELKAREQAVATTLATPTSGNSPNSLKHYAEDIKEPLSPESVPVQKQRKYMPGITNGQVRESAAFVDQSRTDVRFAINADDTHWATVNEKTSNCRTSFWQAMEKPWRLSERIRHSDETIMRARPRSQALPHIM

SEQ ID NO: 120336 - protein, 46 aa, Glycine max
  Coding DNA Sequence Number=SeqID_28651
MGEVPTSCDVRHERMDFPLAPAPQLHHREWANSGGSGSVELTVLFP

SEQ ID NO: 120337 - protein, 151 aa, Glycine max
  Coding DNA Sequence Number=SeqID_28652
MLESFKQQQEMSVLELYIEKDVAGGSMFHSANSVTSCENYLSNDDTQPPTNMSNLHLDEDDDDDYYYLVSNSYVEESLDEDDSVDGISDTDNEVTEMIPPVYKEFRIHFGMMLCIIIISTGVILMRRTFVVWRCHPVLMLAKNYMLAWNLI

SEQ ID NO: 120338 - protein, 43 aa, Glycine max
  Coding DNA Sequence Number=SeqID_28653
MSFIFQEAKESIDEEDPRPTSSNGACIMWYQEHLHLGSINFHS

SEQ ID NO: 120339 - protein, 15 aa, Glycine max
  Coding DNA Sequence Number=SeqID_28654
GECCEIFPDARNGLG

SEQ ID NO: 120340 - protein, 365 aa, Glycine max
  Coding DNA Sequence Number=SeqID_28655
AGGGFDALAGRVDAAVAGADGVGGVQRHAVGLDGGAGGVGQDRTVLGVERDLAVVGAGLHILDRDVARGGLDRDVVAGGVGARGDAGQRQAAVAGDARFAIGDRGRQAAQQVAAAVQVERAVAGDGGRHRAVGRGDLDGRVARADTVLRRQRDGAGARARERAAAVQDAAGLGVQGQGVAGAVADRADQDVAGGGGDRQVAARAQVAQVDRAVLLEPDAARGGGGDVLDLRAQRQAGRADGVGRVARAGGQRQVARHDLGRAVHALDGAARVVVRVGRQRYRAVLRDVDVVQVDRAHGLVGEVQAGGVAHHGQRGGVVGVAAAERQVLGVDGQHARAAQVRALRVVADDGQVGQVGQVVDVDAAR

SEQ ID NO: 120341 - protein, 177 aa, Glycine max
  Coding DNA Sequence Number=SeqID_28656
YHKLPNDGCQAPHKDQRMVAGHQAKVPGRKSVYDTNFAPLGLTRIAGDHDLSFLEFHKLPNDGCQAPHKDQRMVAGHQAKEQKVQKTVSASACYQAFCLTDSKRMFIRITTRGADNRKVSPRIIGSRRLWMIQGCRMTKLGLCLSSGPPPLDDKRVRITGADNRKVSLRIIGPAASG

SEQ ID NO: 120342 - protein, 268 aa, Glycine max
  Coding DNA Sequence Number=SeqID_28657
QLGYPMRGAPTEESMSPFLVRDLGAQSSKTIQRIHKAWETPLRKDQELRGIRNGIIGGYHEWLKVDIRGLDWLAKLKVVSEESFEAPEEDEEVQTLKSELGKAKLAKEKFKLAATHVRKECAGLREENAITARALEQETKRARKEEYGRNKIRGALWVNCLFEVQKKLVSAFMRDGDQHASYHAKYQEELGLATAHEHRIADEYAQVYAEKEARGRVIDSLHQEATMWMDRFALTLNGSQELPRLLAKAKAMADTYSAPEEIHGLLGY

SEQ ID NO: 120343 - protein, 41 aa, Glycine max
  Coding DNA Sequence Number=SeqID_28658
MSSIMHSSSVIASLSSCARTVGPPPISGGGPGTVKRKLLVP

SEQ ID NO: 120344 - protein, 101 aa, Glycine max
  Coding DNA Sequence Number=SeqID_28659
MKRESPLSLHYKLFEGTHVPDIVSTSGKAAASGAVSKDALIAKLKDTCKLRKKKIQLSKKRQLRKRKMQQKRQNQMMMILKPPHDHQTFIFAFTSYRGMSL

SEQ ID NO: 120345 - protein, 186 aa, Glycine max
  Coding DNA Sequence Number=SeqID_28660
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A6YA17; Match level="QueryCoverage=72%, HitCoverage=26%, E-value=7e-49, Identity=76%"; Hit description=NADH -plastoquinone oxidoreductase subunit 2
  Pfam annotation: Domain name=Oxidored_q1; Domain location=3-186; Score=57.5; E_value=4.7e-14; Accession=PF00361.11; Description=NADH -Ubiquinoneplastoquinone (complex I)
MVLFLILNVMDLGSVGTSQGREKEVRNPLFDSDSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLS

SEQ ID NO: 120346 - protein, 311 aa, Glycine max
  Coding DNA Sequence Number=SeqID_28661
  Gene Ontology: Mol. function=two-component sensor activity; Cellular component=membrane; Biological process=signal transduction
  Homolog annotation: Hit_ID=A1JKG6; Match level="QueryCoverage=93%, HitCoverage=46%, E-value=5e-51, Identity=40%"; Hit description =Conserved DNA-binding protein
MAVEEVVKKCKTLKLQRSNRNKTEILAGENLNEFILNCKEQLSGNLLDNNWESNHWKKIFKFSKFKMKNVKLDSFIKAEDLDSSYIGFCKSYVAYIFCSNLKGFDKLTVPIVLRVIEKNLLVFTGSGDIKSLNPVILDECLSDINKNYTKGVAYSCGKFMERLVAFLNEKEFLNCGLMKWSSYNRPPESRLSISDNADNTRLAKLPNERALRAIGEIFSMQDYDLHERDLFVTSVFALLMCAPSRITEILSLRADCEIFEKNREGKECYGLRFYSLKGFGANIKWIPQIMVPTARLAIKRLSQLSENPRAR

SEQ ID NO: 120347 - protein, 71 aa, Glycine max
  Coding DNA Sequence Number=SeqID_28662
MIDQGRLEVGSEEEEEQHVYMQSADEEGPKRPKPLVIHFTRDPTPQRPQHPSAVSSGRPIPFPYHDSRAVP

SEQ ID NO: 120348 - protein, 158 aa, Glycine max
  Coding DNA Sequence Number=SeqID_28663
  Subcellular localization annotation: CTP_CleavageSite=31; ConfidenceScore=5.07e-01
MEEPSKKRKGSSSRSQRHSDTQETQIPSSISSSSLFSSEEQRIRLVCTNQVDMTERLLAGSLAFESRILHYLIVPILLPRSSNLAQVSEEDLIVIIPLDSEPYVPIKRSFLIGAAVIASFGYRKEHDGSWVKKGAQPIDEEGHLPIGEDSSLLQRIWT

SEQ ID NO: 120349 - protein, 50 aa, Glycine max
  Coding DNA Sequence Number=SeqID_28664
MLVNVVEEDDLISRLQMTLNKLKPLVAEPRDINGKNMAPGGCGCPLSNST

SEQ ID NO: 120350 - protein, 41 aa, Glycine max
  Coding DNA Sequence Number=SeqID_28665
MENSKHLATPMNTSCYLDKDESGQPVDPKQYRDFVDEATTI

SEQ ID NO: 120351 - protein, 139 aa, Glycine max
  Coding DNA Sequence Number=SeqID_28666
MNEMKMKAKKTRNELKVADSKTYPLKNEERTNNERRTDEERGKTFTDLLMKTSRKHYAKGVRDLWNNLPSPIYRKREEEVAAQLAQASWGYENFMKVPKAPKAILLQNGGGGCRPACPGELGCFHLKQGYAQNPLEDPD

SEQ ID NO: 120352 - protein, 96 aa, Glycine max
  Coding DNA Sequence Number=SeqID_28667
MNLIIVINGKGHALRRPYRTRARARVMGEVEEIQEKMKADMEAIKEKMATMMEAMMSVKKIMEANAVIVAATSAVAKVNPMLPSGLKQMNHPTSNM

SEQ ID NO: 120353 - protein, 230 aa, Glycine max
  Coding DNA Sequence Number=SeqID_28668
  Gene Ontology: Mol. function=chloramphenicol O-acetyltransferase activity; Biological process=response to antibiotic
  Homolog annotation: Hit_ID=P62577; Match level="QueryCoverage=76%, HitCoverage=80%, E-value=2e-93, Identity=93%"; Hit description =Chloramphenicol acetyltransferase
  Pfam annotation: Domain name=CAT; Domain location=6-180; Score=318.3; E_value=1.5e-92; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVAIWTTSSPRFHHGQYIRKATGADAAGDSVVLLHVFPGWTQDDSYRIRRSGRTERGVRAYSPAWSELPTRN

SEQ ID NO: 120354 - protein, 32 aa, Glycine max
  Coding DNA Sequence Number=SeqID_28669
KAVASGGSNPARHLPYFAINRGGSEKEKGSAP

SEQ ID NO: 120355 - protein, 63 aa, Glycine max
  Coding DNA Sequence Number=SeqID_28670
  Homolog annotation: Hit_ID=A6FJQ2; Match level="QueryCoverage=60%, HitCoverage=84%, E-value=1e-10, Identity=89%"; Hit description=50S ribosomal protein L5
MRKEKIPHQAPFAIQAAQLLGRPIGAGLFAITPAGERGMCCKAIKLGNARVLPVTTLGNIGLS

SEQ ID NO: 120356 - protein, 74 aa, Glycine max
  Coding DNA Sequence Number=SeqID_28671
MEDFPEGPHLGNHETQLQTRKWRTHEQREAITFMGLRKRAIMKHSSKLESGGHMNSPRQYVHGAPKKGENGGLP

SEQ ID NO: 120357 - protein, 115 aa, Glycine max
  Coding DNA Sequence Number=SeqID_28672
MSSHSDSVISNGSLRFLQFFPLPAPIEFPNVREMEKGLKPPFGLSSCDSFFSLQEHLSQIPTVKEHDIQILKGENARHWVANVVLKFHNNPMVNETEIVVFLRQVWWAAGKKKRF

SEQ ID NO: 120358 - protein, 69 aa, Glycine max
  Coding DNA Sequence Number=SeqID_28673
MGLRIRLRMENGRTALGNRGAGSRLDGGGHMKSARQSIHGSPNKIENGEWANSARQSICGVPDSMVVDT

SEQ ID NO: 120359 - protein, 67 aa, Glycine max
  Coding DNA Sequence Number=SeqID_28674
MYEYMHFDDAKEESNKATSKDKHCFKINTRLLQQTKPCFKITLRSSLASKQSDSKTCKALVIDYQVV

SEQ ID NO: 120360 - protein, 61 aa, Glycine max
  Coding DNA Sequence Number=SeqID_28675
LPNLKTVRDDEVKASEESDEVQALKAELERAPAIVSSSSEEVKGIITGQRHDLEGRAKGLP

SEQ ID NO: 120361 - protein, 256 aa, Glycine max
  Coding DNA Sequence Number=SeqID_28676
  Homolog annotation: Hit_ID=A2Q4S5; Match level="QueryCoverage=56%, HitCoverage=23%, E-value=8e-20, Identity=38%"; Hit description=IMP dehydrogenase/GMP reductase, putative
  Pfam annotation: Domain name=DUF1723; Domain location=180-229; Score =48.4; E_value=2.4e-11; Accession=PF08330.1; Description=Protein of unknown function (DUF1723)
MVRTRGLGRALARVIGRGRQDEHDVPRRRRPTASTRRQRVHIAVDEGVPQVTEDVPHMAEDVPQMTEDVPHMADDFPQMSEDAPQMTAGVDATIAEDLGRDGAEGSYADEGFPGGPRDPSVLTSFVEHVAHAIWTGHERSELKLVSHGRKVTLIGRPVPEIEGLVATTGLSPLIGCSVVTGDPGLISAFVERWHRETNIFHLPVGELKITLDDVSSLFHLPISGAFHSFEALSVDEAVFLLMELLEVSGEEARAEI

SEQ ID NO: 120362 - protein, 199 aa, Glycine max
  Coding DNA Sequence Number=SeqID_28677
MERSMIDAASVGALGDMTPAEARNLIEKMASNSQQFSARNDAIVIRGVHEVATNSAASSETKKLEGKLDALVNLVTQLALNQKSVPVARAFALPCNNLEQSSSLKLMLQIFTIDLPNLSSKINHSRTIMTSRATDTTLDGGITLTSDGPALSNNSNLLLPSKMLLAQADHTFLHQSNNSNNPRNSQQLRPLHNLPSKNL

SEQ ID NO: 120363 - protein, 339 aa, Glycine max
  Coding DNA Sequence Number=SeqID_28678
MEKAGEIPGMDPTKKLVLMAICDDASKDNRISYPGLQKLTLWSSRSERRVKEIVEDLICDGHLARRNFAHPGRRAEYIVFPTDAELASLDETDERLNASRKRPKRPRKPVDNFSGMGATGRTPGSENGGDISPNGGGPDRTPPVSTPKNSSSPVPAESPETPGVDNRGTGPKSPNPKALSTTHGKPLSPPDVFAAVGRQLPDTFDDIGLEQLGAEIIAKAASRVLDPTAYVIATIRGWHRPNFTGAHLVDAGTWLTRVDEIDRDRQELLMRTNLEVYCVAHPDPDTWIVYFPWTKNPLPLNGSHGHPLAHARKAKGIRQQAHTMIAHARIPRLGRCTAK

SEQ ID NO: 120364 - protein, 66 aa, Glycine max
  Coding DNA Sequence Number=SeqID_28679
MGQLQRQAFCKAYGKIWDLAIIEVFVEVIASRTQYNDQPLRLIRQALEKAVFTFSLSQYVGLASIR

SEQ ID NO: 120365 - protein, 149 aa, Glycine max
  Coding DNA Sequence Number=SeqID_28680
MPQELVARGDTLLLSAPRHSVTPSVMGEQRPMWSFAPLPEMSASSGGDFFKSQKLSRTTGGGPDDMRRQNLVIPHPFAIQTQSCPMACRDKIWSFCTLCHPEAAGPMTCGDKIWSFRTPLPFRHSHVPMARRDKIWSFCTLHQSRRQAR

SEQ ID NO: 120366 - protein, 81 aa, Glycine max
  Coding DNA Sequence Number=SeqID_28681
MSASKSGSRKRASESERAKSDKNKRSATDNFDLDLDFDLSDDIKGIVSALHLIRDKAQKDGQKKNEETISRYLKRLRFDRI

SEQ ID NO: 120367 - protein, 106 aa, Glycine max
  Coding DNA Sequence Number=SeqID_28682
  Homolog annotation: Hit_ID=Q84VI1; Match level="QueryCoverage=78%, HitCoverage=12%, E-value=4e-27, Identity=78%"; Hit description =Envelope-like protein
MATSPKEISAPGSPAVPSSPHQEQPEFNIQPIQIIPGQASVPEKLVPRRPQGVKIAENPSSATSSREVDPEMDKKIRSIVSSILKMLLCLMLRKMFQHRPTQCFCA

SEQ ID NO: 120368 - protein, 106 aa, Glycine max
  Coding DNA Sequence Number=SeqID_28683
MRLPGKESLLLKSPITINEILDVSISFLNDHLEETLGSTKIEEIHSKCINLAQGKDWHSHPGSRFMVSQDFGSKLVEWPDMIHVKVWFGSRIKGMPHIISTTQMQK

SEQ ID NO: 120369 - protein, 80 aa, Glycine max
  Coding DNA Sequence Number=SeqID_28684
MRGYLMITRTFRQPGANEPVDAQRLTSSSAPFAIQGQRVRWQAEIPYGHLHLSSTEGNEFDGIRMMFYSRRPETFKPGDA

SEQ ID NO: 120370 - protein, 204 aa, Glycine max
  Coding DNA Sequence Number=SeqID_28685
MGRNVSALIGKFVPHIPETCKDPARTKIDVYAGTLSMEFGDVVVHINILDAMKHPYEDHSVFRAEIIDQIVDDYMFDFDSVLHGRKHPFLFDLHTCHSLCIESDSEFEFDPISDFYAENESEFESGFDFLGVVPLDVDFLESECTNHVAGSTYTSDLLYEVQAEEPSSSPTLVPPTVQPPPTLELKPLLETLKYAYLEDKEKFP

SEQ ID NO: 120371 - protein, 186 aa, Glycine max
  Coding DNA Sequence Number=SeqID_28686
MACTHIPVKVEKMRLREDEGQRYQLHPFHLTLIYTRFSSNFSQHHLDLAPYASEPYNAQWNAPGLLCDKHTLRSSRILGEMEVDEPWLGIYTRFSSNFSQHHLDLTPYASEPYNAQWNAPGLLRDKHTLRSSRILGEMEVDEPWLGLWLPLNYQVDMGASQHRTLELGFMLKVVYVIGSAVGRLCG

SEQ ID NO: 120372 - protein, 83 aa, Glycine max
  Coding DNA Sequence Number=SeqID_28687
PLGPSRIFLQKAVASGGSNLARLGELGGNHLRYFAINRGGSEEEKAEALPKRFRNVFREEFRKGFNRSSTFFIRSSSFFDLQR

SEQ ID NO: 120373 - protein, 84 aa, Glycine max
  Coding DNA Sequence Number=SeqID_28688
MHPPPSSLEPREVIAVALFANSPFSTFYSETHECNFLALFMHPPPSSRSLAKLLRSAVRQFSILYFFRRAMNVIAKRCSCMGIL

SEQ ID NO: 120374 - protein, 92 aa, Glycine max
  Coding DNA Sequence Number=SeqID_28689
MASFSQMQSQLQSQMQSQGLALPLEPEVGPSAAHVSTNGSCVDPSPTDPEMGDSDKCGLYIEENPSRLVALGRVYEGFTVVHNITLLHGQVK

SEQ ID NO: 120375 - protein, 41 aa, Glycine max
  Coding DNA Sequence Number=SeqID_28690
MSFEGLRERLRAKSVHEGGNFEIMKATSIMSSKTIPFNFMS

SEQ ID NO: 120376 - protein, 69 aa, Glycine max
  Coding DNA Sequence Number=SeqID_28691
MCGCFRTFFAKKVGPFVRYKVIARAPRKERRIGTNSYLAWRGRPLIGSLAGRKEEPGLCPRAKDFQMFP

SEQ ID NO: 120377 - protein, 54 aa, Glycine max
  Coding DNA Sequence Number=SeqID_28692
MWVIINEYKEKLNQAVTHEQRLEDEYTKISAEREARERICLYFEWKSRASLTAS

SEQ ID NO: 120378 - protein, 71 aa, Glycine max
  Coding DNA Sequence Number=SeqID_28693
  Homolog annotation: Hit_ID=A6FJQ2; Match level="QueryCoverage=53%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVDSRGSPLYAFMPSTPPL

SEQ ID NO: 120379 - protein, 116 aa, Glycine max
  Coding DNA Sequence Number=SeqID_28694
MTGPLHESISCFLIRVDPWVLVPITFRGLHVLASRGLHVLVFRGLHVLAIRGLHVLAFRGLHALTIRGLHVPHSKGGYTALTFRGATCPHLHRTTHPRLQKATRPRNLQRATRPRL

SEQ ID NO: 120380 - protein, 135 aa, Glycine max
  Coding DNA Sequence Number=SeqID_28695
  Homolog annotation: Hit_ID=A6FJQ2; Match level="QueryCoverage=28%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFDRGLSKECKDLEAFHELKGPMTRSKTKLLQEEMAKRTKDGLLIKGKEGGSHKELNWTTLEIFLNVLLSETNWVPSSNS

SEQ ID NO: 120381 - protein, 220 aa, Glycine max
  Coding DNA Sequence Number=SeqID_28696
  Gene Ontology: Mol. function=hydrogen ion transporting ATP synthase activity, rotational mechanism; Cellular component=proton -transporting two-sector ATPase complex; Biological process =mitochondrial electron transport, NADH to ubiquinone
  Homolog annotation: Hit_ID=Q0JIM3; Match level="QueryCoverage=85%, HitCoverage=9%, E-value=3e-61, Identity=69%"; Hit description =Photosystem I P700 chlorophyll A apoprotein
  Pfam annotation: Domain name=ATP-synt_DE; Domain location=172-219; Score=63.3; E_value=8e-16; Accession=PF00401.11; Description=ATP synthase, DeltaEpsilon chain, long alpha-helix domain
  Pfam annotation: Domain name=ATP-synt_DE_N; Domain location=97-170; Score=90.3; E_value=6e-24; Accession=PF02823.7; Description=ATP synthase, DeltaEpsilon chain, beta-sandwich domain
  Pfam annotation: Domain name=ATP-synt_ab_C; Domain location=12-113; Score=160.6; E_value=4.1e-45; Accession=PF00306.18; Description=ATP synthase alphabeta chain, C terminal domain
  Pfam module annotation: Pfam domain module=ATP-synt_DE::ATP-synt_DE _N::ATP-synt_ab_C; Domain location=172-219::97-170::12-113
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVVKEIILSTNSGQIGVLPNHAPIATAVDIGILRIRLLKDQWLTMALMGGFARINNNEITVLVNDAEKGSDIDPQEAQQTLEIAEANLNKAEGKRQTIEANLALRRARTRVEAINVIS

SEQ ID NO: 120382 - protein, 233 aa, Glycine max
  Coding DNA Sequence Number=SeqID_28697
  Gene Ontology: Mol. function=homocysteine S-methyltransferase activity; Cellular component=intracellular; Biological process=folic acid and derivative biosynthetic process
  Homolog annotation: Hit_ID=Q7CXR2; Match level="QueryCoverage=89%, HitCoverage=16%, E-value=1e-111, Identity=96%"; Hit description =Methionine synthase
MEREVSTPAANRWCDDEPCAYGGKNHPRYEQVQAIYVTDASRAVGVVSALLSAEQKPAYIDGIRSEYAKVAEAHARNEREKQRLPLSRARENAHKIDWSSYSAVKPQFFGTKVFETYDLEELSRYIDWTPFFQTWELNGRFPAILEDEKQGEAARQLYADAQAMLAKIIEENWFRPRAVIGFWPANAVGDDIRLFTDESRKEELATFFTLRQQLSKRDGRPNVALSDFVAPGR

SEQ ID NO: 120383 - protein, 198 aa, Glycine max
  Coding DNA Sequence Number=SeqID_28698
MLIPRIPSLLLLREKKFMTRRPSTFTRHCSESGPCLSPSVADHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSNYYSITAYKIEKTYIGFRDNQARTDNFHHVKVTLYR

SEQ ID NO: 120384 - protein, 58 aa, Glycine max
  Coding DNA Sequence Number=SeqID_28699
MEDAPVSPRVTLPLKGRLRQLATPLGTVFFPTAAICFFEGDDTSRNHQERYDHLGNYH

SEQ ID NO: 120385 - protein, 298 aa, Glycine max
  Coding DNA Sequence Number=SeqID_28700
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=73%, HitCoverage=76%, E-value=1e-111, Identity=92%"; Hit description=Beta- lactamase TEM precursor
  Pfam annotation: Domain name=Beta-lactamase; Domain location=1-242; Score=143.0; E_value=8.5e-40; Accession=PF00144.15; Description=Beta- lactamase
  Pfam annotation: Domain name=Peptidase_S11; Domain location=1-218; Score=-128.3; E_value=0.081; Accession=PF00768.11; Description=D -alanyl-D-alanine carboxypeptidase
  Pfam module annotation: Pfam domain module=Beta-lactamase::Peptidase _S11; Domain location=1-242::1-218
AEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGHHFKNSVAPPTYLALLILLPVAAASGDKSCLTGATLPEGRKADRYPVSGRVGTGERTRELPGGNAWGAEPMENASNAAFL

SEQ ID NO: 120386 - protein, 325 aa, Glycine max
  Coding DNA Sequence Number=SeqID_28701
  Homolog annotation: Hit_ID=Q6WAY6; Match level="QueryCoverage=56%, HitCoverage=38%, E-value=8e-15, Identity=27%"; Hit description =Putative uncharacterized protein
MANQGDWVPFMDVLALLIFGVVLFPNVDGLIDLAAIDAFLAYHHSKESPVVAVLADLFDTFDRSSWPGIGGRTISWFPRWKEGKEGVLFSCGRYPNIPLVGTRGCINYNPTLAIRQLGYPMRGAPTEESMSPFLVRDLGARNSKTIQRIHKAWETPLRKDQELRGIRNGIIGGYHEWLKVRIRGLDWLAKLKVVSEENFEAPEEDEEVQALKSELGKAKLAKEKFKLAATHVWKECAGLREENAITARALEQETKRARKEEYGRNKFRGALWGSNNELKLRREERDQSRAHSMVLKEERSACSRSKRSLSQRLCETETNMLAIIA

SEQ ID NO: 120387 - protein, 34 aa, Glycine max
  Coding DNA Sequence Number=SeqID_28702
MHSSSFFQILPRAQSRSVALSRWLAKLEDWFSER

SEQ ID NO: 120388 - protein, 96 aa, Glycine max
  Coding DNA Sequence Number=SeqID_28703
MPISPCGRIAPTKTPSRPEEVQQGPRVSSSGYGPLSILQGARTPRQGHVIIGIAPARHPMDPKKSNRVLELSSSNYGSLSILRSTCHLQQGHQAPY

SEQ ID NO: 120389 - protein, 80 aa, Glycine max
  Coding DNA Sequence Number=SeqID_28704
MAQEEETSTDQIPEPSPAPIPDDAIPSAPTSELEQPISQDSPAAQPLEENEHVIGSMTENVSQFVRLIVKECIDRILVRV

SEQ ID NO: 120390 - protein, 396 aa, Glycine max
  Coding DNA Sequence Number=SeqID_28705
  Homolog annotation: Hit_ID=Q2HW90; Match level="QueryCoverage=36%, HitCoverage=26%, E-value=6e-13, Identity=34%"; Hit description =Putative uncharacterized protein
MASQEKWGPFADILALLIFGVVLFPNVDGLVDLAAIDAFLAYHHGKESPMVAILADLLDTFDWRCEKSSARIVCCLPALCVWLVSHLFQQDTRHPCPLQSYRSCAEKGRVDWDQHLAGIGGSAINWFPRWKEGKEGVLFSCGDYPNVPLIGTRVGSRRARSQGYTKNHKAWRSPLRKDKELRGIRNGVIGGDHGWLKIHTWGLDWLSKLKVIDEENFEAPEEDEEVRALKLELGKARLAKEKFKSAATHIWKECTELQEENAATARAFEQETKRARKEEYGREKFRGALWGSNNELKLRREERDRSRVHSMILKEELVACARSKRSLAQHLEATEQSMLAIIGQYKEELNQSMAHEQKLVEDFAQVYAEKEARGRVIDALHQEVTMWMAHTITVST

SEQ ID NO: 120391 - protein, 68 aa, Glycine max
  Coding DNA Sequence Number=SeqID_28706
DSTSDSPQISASPYQLDFTLYASGSYNAQWNAPGLLRDKHTLRFKSYSRRNGDFVVDLGMAFVDNWAV
